United States Patent 7,868,149 (PLANT GENOME SEQUENCE AND USES THEREOF) - sequence listing, part 10

SEQ ID NO: 4746 - DNA, 9260 bp, Oryza sativa
tagggcgaattcgagctcggtacccttactcctgcttcagtattcctaagctgttaagcacaggccgggctgtgaggaaaaatgattttggtaacctcatttaatgagggatggttgggagtgtgagggtggctgaggataaagtaggaagatattgaaatgagagataattattagaacaaacaatataactttaggaatccttatttgtagacataggattagagtctgattgccggtatgttgtcataagactttcaccgctagcttatttacaagtaatccgtgagatttttttttatatatctatgttcttattagtgatttaaacaccaacgttagaaaataaattaaagtactacgaaaactcctcaaaatcaactattttcaaattcaaattttatatgtgattcatacactaataagcaaatgataagaatagtataataatagaaatggattgcctggtttaagagggaagaaaaagggaagaacagtgatcgatggggagtgtcctccggcaggaactattttaaataaattcttcaattatctctaaattttaatcataccttttatatatgttgtgaactcacctcttcctccctctttcttcttttaccatgaatatatcaaaagaccgtttaaccattatggctatcttctttattacttatattttcttttaccactgtggccacatctagattatgttaccaccggtagttttgcttttcagcttattagatgcagccaaaatttagatttagatttagattttaaaacttaatttcataattgattttttatattttttattgtagtttatttttaacattagcttgctaagagcacacataaaaattttatatgcaattttttatcactaattcttataatcagttctacactaaacgatgggttttctcactgctccacttggctggcaccacctctacatgctcctccgccaccaacccacctaacatattccctgcctcctaatttatgacttctctagccaccattaaccctttatctctattgtcacaccttaaagtgtactttaaaaaaacagtataaacacaggcgactaagcaatcaaaaaataataaatatacataattagttgtttaaacaccaatgctgaaaatcaactagatggaaaaaatcctctcaaaatcaactctaaaattaaaattaaattatacaattttaatttgagagttaaagttaaattatataaacgagtagagagcgtcactacctagaacctagtatagcattacatgatctactctatcatcaagtacggatcctcctcaaatgttggacgattggtaataacaaatattatatacctcttatatactccctccttccaaaaatctgaaacctatttcattctttggtttttccaaaaatctaaatcctatttgtagtcactatatgctaaattaaattgttgatcggaaactaagaagtcattctaatacttattggttgcatgttcattggttttgccacatagtgagtgagctaattgcttcttggtattgatgaaaaagaaataggtctcagatttttggaaggagggagtacctcttagttcttgcttcaagctaccatgtaggatgatataatgagctagcagagataagacagagagagcagtaaccaccctcatgtaagtagcgacctctacatatataaactcataaagagatgagagaaagatacgaatagattgagtgaaaaaataaaaaatattatagtatattggggtaggtgtattaaaggtaatttgttgtatatactatctcttcattaatgagtaaataatatgaataaaattaaaggtgaccatcggttctactatatagaacttgctctaaggcagcagatgctggagagtacacaagcttatgtgtgaacgacgtagctacagatgaaaggaaaaatataacaaatgagatgagatatgcatgcgttttttttgaaaaagaaaaataagtgaaagacaaataaatgagtgtcatcatagccccacgtactccagttttagactggcattttcaggagctaaaatcaatagtgtgatcgaagacttcattatcaagttgaacagattaactaggagtacgtactgtcaattaattgaacaagatgtgcatgcgtacgattgtcctcgtcctgcaaagctttttctccaggattattgcagcttttgggtcgctgcaatctcatacaccaatcacccttctttttcccattctcctcgtgtaccatcaatgatcgataaaccaagtggctgtaccatcaatgatcaataaaccatgtggagacagtaaaaattggttcactttagatgttgtttttcatcgacagataaaaaggaaaaacatcgtgctaattaattaagcatctatttcaaggattattatttaggcatctactcaaactttagcttagtttgtccgattcttgtcacatatagtactctgaaaacagtgcttctatagtaaaatggtactatctatattatttgtttttattatgctagacttagttgcggtgtctgtagtacgacataatgcagacaattaggttctcatgttcaacatataatgttttagttttttctatcttagctaaatttttgcaagattaattatgatgtagtttaaaataaaaagttgtaggagactagcttgtcccgttggtttcatagaacaggatatataaaagaaataaaaaagatatatattacatagtcctatacagataagctggtagtaactagcaccatgaacacaaactaagtaggaccgatatattgacactaagatatactaaggaggtaagaatatattctctgtagactctagtattaattaggcttgaccaatgttcaacactaattcaaaatctttggaacctacaatctgaattaaacatagtacataatgaaacatctaaatttatgataacacatttatcagtcaatgataagagttagtaccgaccgtcagtgctaaagaagacacttcacattagatggtcggtaaagctggtgctaactgcctatctaaggcacctaggcactctatatgaccatcttggctagagtagatgtttcagagatcaagtggaattgaagctagagtagagaacatggaattgacatagtagagttaaaaaaaataaatgtaaatgtcttacttgaaaattgctagaattagtcatgatgtgtgatatgaataaaaaaggcaacgatgcattgcagtctttactatccatagtttcttggagctctattctccatctcacgagccagaaactttccattatcgctatatcactgtagaacatgtgcgacctgatctataaagatcatgtggactttactttaactcccacctttcatctagtgtctccatgaagaatgcaacacacactttttctttttgctttgtagcgagtggggtgtccaccattatcatcgtgtaccatattttctaattcttagatctcatgtcgcacttactataatatcaacttccacgacacctctcgcgacaaaactaattatatgacttcatactttttccccctaacagccaggtggtaaatgattatgtggaggcagtgaggcagcttgcttgccatgtccttgacctgctaggagagggcctaggcctcagggaccccacatccctgacaaggctcatcacagccactgacaacgactccctcatcaggatcaatcactaccctccatcctgcgccgccgccgccggcgaccacaagtccggcggcggcccggcgccgacggcggccatcgggttcggcgagcacaccgaccctcagatcctcagcgtcctgcgtgccaacgacgccgacggcctgcagctgcttctgccggacgccgccgccgccggcgacagcgtctgggtccccgtgccgcccgacccgtccgcgttcttcgtcaacgtcggtgatctccttcaggtcagttacaaattcaagtaattgatcgattgatgttactatttcgttaaggccctatttagatcccacgtaaaaattttacactatgttacatcgaacgtttgaatacctgcatgaagtattaaatataggctaaaaaataattaattgtgcagattgtgactaatttacgagatgaatcttttgagcctaattgctccataatttgataatatggtgctacagtaaacatttgctaataacaggttaattatgcttaataaattcgtctcgcggtttactgatggattctgtaattagtttttttattagtgcccgaacacccaatacgacaccatatataatatccgatgtgacacgccaaaattttataccctgatctaaacacgccccctaagttgtgttctttgttattgaaactttcgagggctcattcggaacgcaagattgaaaaaatatagaaataggaaaaatataggaataggataggaatacaagtataaaacagaggatttgaaaacataggaattttatgtgaataggtgtttggatagagtaaaggaaaaacataggtatctttaagaaaataggtgcactattacaaaattatcacatgctactattgaattaaacaacattaatcaacctaataacatgttttagttgcttgatggcatgatttgcctcgttcccacgcgaagggagagaaaaaagaggtcagtgtggattttttttttcctttgatctttcagtgatatgactagcgcaggaaatttcactacgtatttccaacgaacgttttcatgtgatccgaatgacgccacagtaaagtaatccatagtatctaaagtccttcatttttcctatgtttctcctccattccgaataagccctcaatttgtttgtacatatttttgcaggctttgacaaacgggaggctggtgagtatccggcacagggtggtggtcggcaccggcaagccgaggctgtcgaccatctacttcgcggcgccgccgctgcacgccaggatctcggctctcccggagacggtggccgccggcgcgccgcgccggtacagggccttcacctgggcggagtacaagaggaccatgtacacgctccgcctcagccacaaccgcctcgacctcttccacgccggcgacggcgacggcgatgccggcgttggggacgatgacgaccatgaatagctggacatgagagatcttggaactgtgcaatgcacacgaaattttggatcgctggaagtttgttgcaatttcgttggattgtaatatatttatggtgcagtaattactaattaagtttgtgactttgtagtaacagtgatcagtgtccttgtgcattagtgcatattgtataggctacagcataattatatgttctgtttcaaatttttgtcctaaagtcaaatattcataactttgattcattgatttctaaaaatttatttagtttaacatgataagattcatgtttttagattatctatgagaaatgctttcataatatatttttcacatgttattaaactatataaatttcacatagtttacatgttgtccaactaattctagaaatttattttgtttctacctttacttttgtgtgtatgtttgtgtgaagaaaatagaacttcccttctctcttaggtctgaatctcttccctgtttcaatttttgtttcttgctaatgttgcagatattgtcctttgcttaagccttgaagcaaaaaccttagtcttacctgcacgctgcactgaggaacgtagcagtcatagatgttgagatccaaaagattttcgttgtctttttcccttaattctcgtggaggtactacgttttggtgtgaaggcttactctcgttcgttgtttgctttttctttttcttttttggtttttttttcccttgcaagattccttttgttgaaaggggactcctgatctttcttgtagatcttttttcccccaagggattgttgcgtacatcttccggtcgactgaacgtaacactgaacctttctcccttcgcggccacggtatgtggttcatgtcccaaaattctgaaccttcctcaaggctttcagagatcataaccatgtaactaaatctttcagagatgtgtagctcaaaagattatatatttgcagttcttcaaccttatataggagtataaactttcttagctttattacgattatagatgttactaattcaacacaaaccaaacaccaaaagttgagtttgagatgatctgctcaagcaatctgacaagttttgaaggtcaagatagaaccagcaacaatgcaacaaggtagccaaggtgagtcttgcgcacatgcaagactacaacacaagatggggggcacaataaaaacgtgtgacagttccagcgtctcaactctcaacatccaacagaacataaatcgataatcataacattcatagcattgttatatttcatcaagataacaggaaaatggtgtcttggttcagtttgccaagtgatacaagatacagcttaaataatgacaatggatacaatggttagggcttcgcagcactcccgaattaggagctgctggtggaccgaacacaacaacaaacttcaatttcctgtgtacacgagagccacagacctgaatcggtgttgctctcgtcgaccaccggtatcacccagggtagctccaatcccatcgatggcagctcagcaaaaacgaatgagcgcgcatcgaggaaaatgaatggatggatatctagtgtaaacctatactaatgtacatggctatagtgtgttcgtctcaagttaattgtcgacaagtactcgtagtatacttgtgcgtgcagagtagcatgtataaaagggactctgctgttttactcgacgacatgggacttggctgcacggcgtgagcacctagttctcttcttagaaaggcagcatgcacagccttcaagcagctcgaggtcctcatcgcaggtcagaatagaagccagctcggggttttccaatagcatcttagaggtcagaaaaccagcaatagtccatgtctgatatgaccgagattgcttcccgatgaatcttccagagcgggtgtcatagtactctggccatttgtcagctgccagcttctcctcggccacagcaatggctcttcgggccaactctggtcttcccattttgatacaggccaatgtaaactgtagacaaataaaatacactggtaagggatgattcataagcataaaaggagcagaaagtttggaaacagtctgtcaatatctccatacctgccacagcagcgttggccaggatccaccattatgatatgaccatgggctgcatattaacaaaatgtttagatgtcaacaactgtggaaatgaaatagaaacacgtcgtatgaaaagctacacgaacaaactaagttgcccataaaaaatctgagtgcagcagggcatatggtgatatttaaaagataaatcagaagaggttttgagcccttgtttcggttattatgtgtttgctctgctaaacatttcttacaagataatatcagctggttacaatgtttatttagtggatactacatgtgttcactggatcagccaatgatttatgtgaaattatcattaactaagaggtcaggttgaacgtagatcatgaaaatactagcaataaagaccagttcaagaatccttacgtgttcttaggatcactgccggtaataatgcgccattcatcatcttccattgcggggtaacatatcttgaggggcatgtttgctatgagatcatcccatttctcatcaataaggctaagtattccctcagcttgttttggagtagttagagatgaagttattgcccaaaggttgccgagagagaagaacctgaaatccatgtgagctggctgcaggttcccgatgagatagccacctttttcaggaatccagtcaacaagccaagaagggatttgctcaggataaatgttgaatttgtttgttgcatcatgagagtattcttctgttttgtatctgtatatctcatttatcttcttcatgtcaacccagtagtattccctaatatgaaaggacagcgcactcagcctgttattaatggcacgaaggaggttttttgacccatcgttcataacaagcatttctcgtgagcatcgtagggcagagtagaacaaagcctgaaaagcaggtacaattggtcagttcggataatcttttgtatctagcttcaaagtagcagtatagaagtactgtctctaacagcacgttgatcccttcatgtcaggtttctttatcttaatagtgatataaaatagtaaatttatttactaagaacagaatttcctacagtaggctaaaccaattataaacaacattatcagttgctcagaaatatcattctgtaataatttctactaaaatccaacttacttgaatttcaagggggtgcccatgtattcccatcctcctgtctatcatgcatgatccgtctgtgaccagtaaagttggaaacatatcgaacccatcggacaaacacaagcttaagataagtttaatgccggtttgcacatctactctttcctgcagtgcattgtcccctgtaatcttgcagtatgccctcagcaaaataatccaccaaagtcctgtaaaattatttggggtaaactactttgataaatctgtcatagttgataaacgaatcaagtgagagagagagagagatttacctgaatccaccggagctacacgtccaatagctgactctccaaagtcagggtccaaaacttcctcaaatgcttcgttattgtcatcaagaggcacagccctaatcttaaagctagctggcatcaagccttgcccagggctgtaacaatcaacagtcttctcccagctctggccatcagacatagaaaaaaaatcagcaaataaaatcctaaaatgaattaactgccatgttgagacaataagaaaactaggctcaaaacaacatgaataagacagatttctgtaaccttactgttaagtgctagtgccatttgtataataggaaaattttgagaattttttatatgtatgtcagttaacatgtaagttttttccgttgaattattttcataatatcccgaaaattagctgggcccaattcatcactaacagtatttattgcactagcaattcatcattttgtgacaaattagctgctttgattcatat

SEQ ID NO: 4747 - DNA, 1587 bp, Oryza sativa
ggctctccgcaaaaaatccaataaagaggaaaggtaggtaactttaatgtaaatacggggtcggtgaggggtgtttctgcgaaagtgcgagcggggttcggtgcggtttaggtggtggaggaaagcgtaatggaggatggataggggggcagagtaggcggcctttttatagagtgcggtgtgtaggcgccacgctgggcccacctggttttaaaagtgcattgttttaaaaaaaattcaacgtttttttttcctctgtcctaattaggggaatcttggattggattttcgggacggtgaaattaccgtcgtgggactcgtgttttctattttccccttttctgcatctctggacagagagtttaattttgggctcgcagagtgtacgcattaattttggacgtgacaaatctgtagtcctttgacttgtaaatacattagggctgtgtttagcttttaaaattagggagacgtttagagaaagttggtagtttggaaaaaaaaattgagagtttatttgagtagaaaagttttagatgtgatggaaaattgagagtttaaaggaatagttctgtcaggcataacttgaacagtgcaatttactttaagtccctttcatgtgatcatttacttcctaatgtttatatattataggttaaaaatatgatcttttgattcgtaggaaaatacttaaaatttagagaatttgaatcctagagggaaaattcccaataaggccttcataagaaaggattaaattatatcaatttttttttgaaattcctataaaatgaaaaatcctacatagattttgaagaaaagttagtaagagctaaaacctttttaaaaaaatttctatcaattttatctctattatctgatttctatggttttcctgtagtctactaaaatgattatttgtgtgcaaaattaagtgtttttctatttctttgttttttttaatccaacctactaagaaaaccctaagtttgaaagttttggtttatatagatccggtgattctttttttccttcttacaaagttgacgaatagcatcattttgttcttggaataaaatggcttgctcaaatgaataacgtgtcatggcctaaatgagaaaagtcaaaactgggcaagggaaaatgggcagcgtgtgtaaaggattagtgggtatttctgtcattacgcaccaaagacagatcaaagaccagctcaaggagaaggaagacagctcgtgcgggccgctgtgtgagtcgtcagagaaaaaaaatacaaaagcgtgtcggggaaaacaattttctatacttaattaaaaaaaagtcgcccgcatccgtcaccaatcgctccgtacgtaccggcccattataccccttaaccggttacgcacactgacacgtcggtcccaccgagtggtgacggtccgcatggcccacaagtcagtagctactccgtagaatttttctccgtacgttacgaattagaacgcgcacccggtgccgtcacatgggatgcgcaccgcccaccggacgcgcgccgtgacgccgtgagcacgttttataataataaacctcggccgatattttttt

SEQ ID NO: 4748 - DNA, 948 bp, Oryza sativa
cttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtaccgttagttctgcttccatggttgacctcgtcaaaattgtctgtttgcaagacctccatgaaacagcaccaccacccagtgtgaaaacatatccactagtggctttgatctcattcacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagag

SEQ ID NO: 4749 - DNA, 3098 bp, Oryza sativa
tgctctccttgtccaactcaaataatttttgacaccctccaacttaatatcattttgcatcaactcaattttttgtactgattcagcatgaggaacaattgcattgatagtagtagaggtctcactgagtttctttgcaagcatatctaccaattttcccatcacctgttcaattccttgattttcccccattacagcaactacaactacatcccttctatttcttcccataacaacaatatcaagcaaaacatcagtagaatagttccaaccttcccaagtgattgatttaaccaccgcagtacagatcaagttacaatgaccaaattcctcaccttcttaagtgaccaacagaaccaagtgcagctctgcccccaaatctcgtgtgccccttcatttcttgttgtgagatctcaacctaaccttgcaatagcagacaaaagctacagcagctacacagcaaactaacccccccccctttttcttgcaacggcaacagcaaaagctcaccaaatcctcggcccacactcctctgcttcctccaccagtgcaccttgttgcatgcgctagcctctacctgtcctgctccctctggtcgccgtgagcccgtgagtccctgtactgccttcctggccgccgtctcctgcagcgcctttgcgtccctctcgcgacgctgctccagcgtgagcccgtcgtcccggcccttcaccgctggcttccgcgcctgcgccctctgccttccaacgcctccacgacgccggtgcgccacactcctgttgggctgtgtgtgtgttgtggcccaagaggcccatgtaccgatatgcttgcatatgtatagagtaagcaattgacagagggtgtgaagcttccagaaaaacaatcacaaatgtcttcatggtattagagcttggtcgccagcgactgcgtcgacactaaaccctagctggcggcggctatggccagagaagcgcggcgcaccggcggtgtacttaggggtgggcagaaaaagaccgagaccgagaaattcggtcatcaattcggtcctaggaggtgaaagaccgaattttgttcggtcaattcggttagtctcctcggttaaccgaatagaccaaaaagaccgaattaacaaaaaaaaagtataaatacaatctacaatccactaagttcaataggattaaactctaattttcacatccctacttcttctaggcatataacctaataagagtttttactcatacgtgcttacggatttttttttgtgatttttgtgttgaaaatttccattatttctctgcatatatgaaaatgttgctgaatttcggtcagaccgagaccgagaccgaaaagaccgagactgaatttgtcggtcctgacatttttgcgttgaaattcggtcttcacttttcaaagaccgaaataaccaaaaggccgaagaccgagaccgaaaatttcggttagaccgaacgcccacccctaggtgtactggcgtgtggtgctggagctcctgacgaggaagagagcgtgttgagggtggagacagtggcaactattgtggtgagggagcaaggcagcgacggttgctgtggtgagggagcgacagtgttgacggtggaggcaccggcagctgctgtggttgtgcttggaggaatccgacatggagagaaggtgtagctagctggaagcgccaacggcgaccgcatgcgcggagggcaagttgacgatggcgtgtggagtgaaggtgcgcttctactgttggcgattgtgtgtgtggagagaagatggtgatattgcttgctagcgtgtagaggtgctgattgagaaggtgcagctgccgcttgctgcttgagaaagtgttgcggatgctgcttagaaggtgagaattttttctactgctactgttgagaaggtgaggatttggtcagattgaagtctcacagcaataaaagaaggggaacagattaacttgtggaggtgagaagaagggatatagctgctattaacttgctgtaatgcgggaaaatcaagggattgaacaggtgatgggtaaattggtagatatgcttgctaagaaacttagtgagacctctaataccagcaatgcgattgtttcgcatgctgaatcagtaaaaaaattgagttgatgcaaaatgatattaaattagaaggagtcaaaaattatttgagttggtgaaggagagcattattgatcttgaagacaaagggattagaaggatatgttacaggggagataaaggagcctgacagtacattaagtgttgagtggaagacttggagtactaccaactctttaatattagcgtggttgttaacttcacttatccctactgttacaacaactgttgagaccatctctagtgcaagtgagatgtggaaaactctcactaatttttactcgggagaaggaaatgtgatgctaatggtggaggcacaaaagaagataagtgctttgaaacagggggaacgttctgttgcagaatatgttgcagaactgaagcatttgtggttagatttggatcattatgatcctcttgggttagaacaccccgtttgtatagcaaaaatgagaaaatggattgagtgcagaagggtcattgacttcttgaagggcctaaattcggagtttgaagggagaagagatgcaatatttcatcaaaccactcttcctacgttgatgaggctattgcaactatggcacatggggagcttaagaagaaagtattgcctagtgtcacaccatcttcaccaaatcccacatatgtagttgcacaaagtaaaaagatcagggagtgcttcaattgtggtgagatgggacaccttatgcgtgattgtcgtgctccacacaagcctagttatgggagaggaagatatggtgataagggcggggcaagaggtggaagaggtcatgcgggtagaggtaacagaggtagaggctatgagtatagaggtgatcacaaagctaatgtagtcactcttgaagagggttcttctagacctacaaatgttgatgttgccaaccttgttcattccacttcacataactcaaaccaagcatttatgtccatcaatagatctct

SEQ ID NO: 4750 - DNA, 1448 bp, Oryza sativa
actttatcatcagtgttatatattccttcctttccagtgaatttggtttcaaaaagttttcttgttgatcatatggactgttgggtctcttgatcgtgagaattgtttaattcaggagaggcaaacagggaagaaacttgggattggcatcagtcgtgatggactttggtacttggatcgaaaggggacaagtgaagatgtatgtcttgcattgatggcttccacaagtgaagaagagactaaggtattacttctacattgtcgactgaggcatatatcttttgaaactatgagtaagatgttccggcagaactgagtagattggataaacataagttagtatgtgatgcatgtgagtatgggaaacatacaagaacatcatatgtgagtaggggactccgaagtatattgccttatatgttgattcactcaaatgtatggatctcacccgtagtctctgtgagtggaatgaagtattttgttacatttattgattgctactctcgcatgtcatggttatatcttatgaggcataagaatgaggtgcttaaatgtttccagaacttttatacatatattaaaaatcattttaatgctaagattcagtttatcagaactgataatgtaggggagtatctgaatagtgaatttggtagacttctttcattggaaggaatattacatcagacttcttggcctgatacccctctgcaaaatggtgtcactgaaaggaaaaatcgtcgtattttggagataactcgttcattaatgtatgctatgaatgtacctaaatttctgtggagcgaggcaataatgacgacaacttatcttatcaaccgcacatcatcaaggatacttggaatgaatacaccatgtgagatgatattgggaaagaatgaatttattgttccacagctgcacttgctttgttagagatcatagaccttctgttggaaaacttgatcctcgagctgtcaaatgcttctttatatgctattcatctggccagaaggggtataagtgttggagtccatcagaacgacgaacctttgtaagtatggatgttacttttagagaatctatctcattttatggtgagaagacatatttaagttctttattcattgatcttgataattcaactagtggtcatgatagtcaacaaatggaaggtgaaatcttgggtccaaagggacataaactatcaaagaaagaaaagtttgtggttggttcaattccatgtcctatgagtagtcctattgcacaagagcaagaatggagtaagccatatgaagaggaaaatcttcaagtttacacaagtataacaaggtctccaataatccaacaagttgaagaggataatcaggtagtggaagatgtaagtcatgagtaagggactttggagtcagggggaggagacgaagaagttagagaagaatttaacttac

SEQ ID NO: 4751 - DNA, 7324 bp, Oryza sativa
  unsure (1)..(7324): unsure at all n locations
caagctatgctagatgaactagaggctcttaaaaagaacaaaacatggaatcttgtaccatttcctaaaggttgtatgtgtgttgtggcccaagagacccatgtacccatatgcttgtatatgtacagagtaaacaattgagagagggtatgaagcttctagaaaaacaatcacaaatgtcttcagctcgtccggccgcagcgccactgctgatatttcttaacgatattactagaaatataattcccagcaatggcgctataaatattctcggcctagaaccacacacacatgtacacagcccacacacacacatatacacagcccaacaaaatctaacagtagttgcaactctaaatgaaattctatctacacttaacagttcaatacactattgtcgtaaatcatacatttttattctgatatttagccatctttgtgaatattaggctaagtagacattaatatttatttgaattgtttaatttttgatttatcatgcagtgactccattctaaggtcatacaacttttcggtgctttctgtcttgccaatctattcgaagctcatcaaagcaggactcagaatttggctctacaggtgtgtttcctcttcctgtacctttagaccattttcctgttccaaatacatgcagacatgaacattttcatcacctatccaagcaagcatattttcccctgataacacttcttaaaacttatcagaaatataacgctgcttctatctgaattttaatccttcaaaacagctgctaaatagtgctgggaagtttaatacgagtaagattgttttgcatttagtggagatgccgacggtagggtcccagtgatcgggtcaaggtactgcgtggaagcgcttgggctgcatatcaagagggactggcaaccttggtacctgaacagacaggtctgaatttttgaactatcatcagtgatgttacattctagtagcaatgtagcactgatgtagttagtcaagttagttgatggatgtgaatctgtattctagtagcagtgtagcactgatctggaaatcacttgcaatataggttgcaggaagatttgtggagtacgatggcatgaccatggtgacgattagaggtgctggacatttggtaccccttaataaacctgaagaagggctcactctgattgacacatttcttcttgggtaaacagctctcaacacaccgatgaaaggtaaatttaggttaaaagaaagttgggactatttgtcctaaaagttgctcaatgagtgtcaaccattattgtttgagaaagaagtgtcaaccattattccaggagccatggcatagctgaaattattccttttaagggacagtttgaatttcagtctgatccttttgaatgctgctgttgcattctttcacttctttctatccagcctgaagctcttggtaacttttgttggtaaagcatctcaagtctcaagcaattacattgataagattgtgctaaacattcaaagaattaacaagggcaagttctagtctttgtttgaaaatatagggttgaaattatcattctcaacataaaactcaaacataaggaaaatatacagattaatgtatagggtggcatctagttgacacagacaattgcatacatgaagagcctacaatacatgtattgtttcatctatgtatgataatatcgatgacttattccttctttatttttatgtgtaagttttatctgggttgtatcatcggttgttttttgttggtagtcgcctgcctgaaagaaaggaattgattaccaccagtgcctgttctggcttgtcttgtggcactgcatgtccagctcctcttactgtggccattgtcaatccttgatactcaacaaatctcccagcaacctacattggatttgcataggtgaagaaattgtgcaatattacaaattgtaattcataattttacactttattttgattaatacacgtagatgacacggaatatgtaatagggtaacaacctgattgtttaggtaccatggttgccactgtgacttaacaggaaggccaagggcttctacgcagtaccgggatccaataactggaaccctgccatccacgtctccactgtaaaatcaaattgataattccctcgtgttggtcccaaattttgtgatgactttgatgaattcgaaattatacagaatttagtgagcataagtaaaagcaggtcctgaatgtaagtatgagtctacttgagtggcacttaaaaaatcactaaaccaactcatgacagtcaaaggcagggaaatgaaacaaacttttttgaaagcatgatgaagaaaaaatgagatataagggcaattgtcccttatagataatgtagtttgtagcataacataatatcttgatcaaattcttaaggcaaactagtatgcaagaaccaaacctgtagacccatattcgtaggccagccttgataagcttagagtaaataggaagaacagagaagaccgtgatgtcgtaattgtcgaatattgaataactgcaaatgtatggaggatgtcatttcttctatccatttagtatatctgatcaatcagaaattcacaaggaagctcatgcatatatgacctgcagatactccattttctgtccttgatcaatccactcgtattcgcatgaagtgatttctgcacatccatcttgttcatgtaatcttcgatatgtgacgaatagcacggatcataccctgagtacatcctcgtgcctttaagcctcttctgaaatttgcattcaattatcttcagttcattctgttttcatatttgctacagtacaaatactagttgttaagcattacagttaccttagcattcatatcagctgtactgtaggaggtggaaaagagggatgagtcatcagtgttgcacttaggtgcatacacattgaaaatatcgatcatatcgtactgatcatatatgtatcccattacatggttacactcattgctacggggtgataacctgaagtcgcaaacattgttgacatgcttatagagttgatctgagatcactgagtgactccaagcgaactcaactagtcccttgtagtcatagtaatcatcagtctctgcattgccaacctgcaaaatattgttggcatttgtgattggatcattgacagtttgttttgggagagcatactgaatgcataatatgcttaaattgaatggtatgaatgaggaaatgaaagtattataagataaaagaattgcttgtcagcgtttcaaactagaacaactcaataaacagagatccagcaaagcccacaaatacacaatcattcataaacatgttcgaggaaatagcactcacatataaggtctcaagctaatttccaatataacattctttcagcagaaatctgatgccaaaagaaaatttgatcagtttcataaggtacttacaataaatcctttcaaattgatatgctggtttgtttcaacatgcttgttgcgctcatacactacatcagcaagctgaggaacatagtgccctgttgcatcaaagttggtaagtgtctttccccacaaaataaaaagttggtaactgtcttattattcaaggttatgtttgcatgttgtgaaacacattggatgatgtggtttgcagcatatgccctgatacgtgtgtccactagatggccaccaatgtttaaatctgagtacttttgaccatatagtttgttgaataagccactctctcctttgacccttgataggactgttttgggtttagtgacagaagcaaacaaaaaatgagtattccaaccctaacaaaagatagctgtatttttcaacagaataacaaacatcaacttgttcaggacctaataaaggtggtatagtgggatccatgtattggtgtggactgaagacttcagggaataggatctggatgactacatgtattctaggctaaaccttttgactagagaatattgaggagtggaaagatggtggatttattcctgttttgcatgcttacactactcattaattaacaaaaggtgaaaatccggtatctttttctttttcttgtgggcttattcaacttttctatatttttgttggaagaaagggagctgtctgcacaatacctgcatagctctctccagagatgtagaagtcatggtttttgtactgaggaaacctcttgaaccaattcaccaagaaattgtaggtgtcctcagctgcgccgctcgaaaaatacagttaatgagcacaataacacaaatttttcagactttaagggaggtaagttgaagatcctgagactagataaataccgacaaaacggtcatcgatgctctctaggtcagacgaggtatttgtgtaggagaagccgactccaacaggagattccaagaacaacaaattggcctctgaaacatggagaggaacaattgcagattaattctgttagtcccacattgaccggtagcaactttacacatgacgtgacttcggagtgcaacatgatacgagcggtaaaagatgaacaataatatcgtaccgttattccatgcaaacttgttgaattccaaacctgttccatttccattgaccatgagaggacccaattcagaagctgctccatagcccacagatgagcaaccaggacctgaatatggaaattcagttgaatggcgatacaaaacaagaaacagtgaaagaaacacacatacaaaaatgacagggtaaatattctatgactacttagaaaggacgaactaaaccatcacacatcaggtgaataaacatatatagctgcagacaaatcaaagtacaactaatacttgtttgcttgctactgatcaatatgaatgaacaatccatcaagcaaagaaatgcatatgctcaatgcacaaatgacaacaacctccattaagccagagcaggagaggcttcttggaaggcagtgcctgagcctcaaagaaccagtagaagagtgccctgccattctggctgttcacagtgatgtagcctgagaactgagacatctgtgggctccttggctgcccagggaggaaggcaaccctatcagcctcctgctcatcctctgctgtgattgtctgcagcaatgagagagcaagcaagatgatgaagagtggatggtggcacagggatttgagccttggtgatgcacaagaggccataggatttttctcttttttttttttgttctcctcctcttgttctgttctgctctcctcagtgaaagagagtgcagaactctctgtgtccactaccagctcagtgtttggaggggggaagagatattgcagcatttgaacatatatagcaagttgtcatttgctggtatgtgtggcaattgagatacttttcttatgtgcaagtaagaaaatcagtattgttcccttcaaaaaagaaaatcagtattgtgcttgtaaaaagtccttgaccgatcagctgatagtgcagttaaaaaaatgtttaccccactgtaaatttgcactttccagtgtccacagagaagataagtttataaaaattctcaaaagaaaaaggtttagcacttgcgttggagaatatggtatatatcttttcaatattttgatattaactcagttgcatgattaaaaaaaagacaaatacatagctaaagcagttcgaacactatttaagcatgtatttatcattcacggattcactgaaatgcaattaagttctaacatagcccatttatatttattgattttctgagaacaaagaatcttcaagtttgaattttaacagacttttgccaatatgccaccaactaacctcacatgataataatcctttttgacattttccttcgtgagactataattaagttcagtcatgagcaacatgtgttccattttgtcggtctctcaaatctttagtatgaatcacaagccaatattaagtattgtctaaaaaagatttgagtgtttcttttcatattagtcgaatttaaggtcatcatgttgaaattcctttgtcatcttcatcgactttttcatcccctctaactgaatcaatccccatttggtcgccactacttccgcccctgaatgccacgatccctcgtcaccattgccaatgaggcacgccaatagggttgtaggtgggctagcatgcaaaatcatttctacaagcgatataagtgagttcacggattggctcacttattgggatacacccgcaccaattctctagcttgttctccacacatgtcatctcttcttggcactccatccccactccctacgcttcaattcgttgccaaactaaatttcatttagaattgtttccctctcctatctgaataatacctccatcccataataattgcatttctaccattctatttttttcccgaaaaattatatttgtgataagatgggacccaacaaatggaatgtgtaccctcaaccttccttttaattaagtttacaaatgaaatgtgtgcctcaaccttccttatataagtataggtatggaatatgcgcatgcagtgcagttattaaataggattactgtggtaaattatgtttgttatcaatctatctctattttttagaaatgcaattattatgggacggaggtaaactaaggcagaactcttgccttttgttaaaaaaaatctattcagaaatcataatatttattataggctggtttgccaaaagggaaatgtagcacctatttgctttgagaccagtaggagcaatctgcaaattggctagatcatgggccaggacaggagaaggctaaaatccagccggctatctcggcaaattgtaggcaaaatcttaccagtttatgctactactttacatgccaccaagaaggatcctggattctggtcgcttttcacatgattgctattgtcgcgaaatgacatcgattgcacaaattggagcaaaaataatgcccttcacaatgctcagcagtgattgtcttgttcgcaacacttgatgccgtttctgttgagttggctgggcaccgccacagccacacagccaacgacaaaataaaatttgtacaaaccaaacttctttcaaaaaaaaaaagcatgcaaatggctatgcaatttgtacaaaccaagcttgttttttttaaaaaaaactgtaccttgttatgaagagagattatcgaaaattgcagacgcaaatggctgcacatcattgttatgaagagaaagattgtaatgttcaaacgtcattttcgttggccccgggaannnnnnnnnnnnnnnnnnnnnnnnnnnnnnnn

SEQ ID NO: 4752 - DNA, 1469 bp, Oryza sativa
ggtaccccaatcttctccccaagaggattattttctttctagcaccctgcagaggacacaactgaccccagatgagctgctcaactatcgctttgagggtctaccatcatcatcatcatcaccatcgtcatcatcatcgtcgtcatcttcatcgtcgccacccgacctcttcctcttcgacgaggattgcgccttcgcggaatcatcatcgccatcatcgtcctcatcaatctcttcatcctcggcaccctcaccgttttcatctggctcgaagtcactggaatgctcctcgtcctctgcatcaccaagtggcttgaccagatactcagttcctagctcctgcagaaatttcatcaaaagcgtgtcatgactgattgaggtgaacgatattcggatattaagatgcatggtgaatctttaagcttaaattgccttcaaggcaaactctaatttgactaaacatgagaatagaaacaactttgggatcagactgacgtgcaaattttcatcattctgaaaataaatccataaaggatatctgagatgaattgttcatcatttcccaaacatgatagattcaataaggtcagtggaagatgagcaatcagggcctacttgtatgacaataccttgggaaacagacctagattcagcaaggttacacaggtacataaacagcaaaagactagatggaatatggattcaatgtccatgctaagcttattttgtcttccgtgataagttctgacccgcaatactttcagaaatagggaataggaatcttcctcagaaagcagtgaaatatcactagatctccaaagaactgcggaggaacaaatcagaccaggttgtcctctcagatctactgagaatgggatcggactgacgtgcaaggtttaatcacaggcagaagagatctaccctcagaaacaacctctggaataagtttttcgtcatatccctaaaataggagctaagcctttcagtagatgctctcaattctcgagcacatattcgaaagcatcagatagcaacgccatcttaatttgaccaaaaaaaactaggcagatcttttaagggagaaaatgcaaataaagaaagagaattggatcagaacggcaaatcagttcttttgcagcactgggtgagctcaaggctcatcctcagaaacagcctctgatataaatcatcatctccaaaagaacatgaacaaagcaaaaacaaaatccaaaatccaattactttataggtcaacaaactggtaccactcccccctcagatctaaaataggttctacttgcaaacagcaatctacgaagtggttttggatcagaacggcaaatcagttctttgcagcactgggagagccattggcccgtcctcagaaacagcttctgatacaaatcatcatctccaaaaacaaaatcctacactaatctttcacagatctagccttccaccataggaaa

SEQ ID NO: 4753 - DNA, 2459 bp, Oryza sativa
atgccctttggacttattattattgggggaggagatgggcctctgatgggctacaccacagaccacacaaacagcaggtggataagactagactagaaaagtagaaaacctaacatgtcctcataggaaattaccacatcagcgcaaaagtactgggaaaggataaacggtatggcagagaacaatcacccagatctacagaaaatacggaaacagggttttcgtacctctttttttttgccaaaaaaactgaacctttttactccaagatctatattttttttgcccaaaaaaggcttctttattcccagatctatagtttcctgagtggtaaaaacaactcacaaaaacaaaattaagttttgaccgtctacagaaatcgatatgcaaaaaaaaaaaaaaaaaaacgacctcagacttgcaaaaatctcgaccttctagaaaggttttttgagaggaaaagtcttcaaaactaagctgatacatctactgatgtgagagaacgctattgtattcaaaactaagcagatacatctactggagtattttagggacaaaggtgctgaacagatctgagaatagaactacttttccagatttgtgcaagagaaaattagcaagaaaacgcgcaggaagctgaagaatttcatactaatcgtaacagtagagcataaagatagatctatcagggcaggcaggaagaacacatgaacaaagcatactagcatatattcgagggatcaaggcgtgaaaaaaaattatacctcctgctcgtcgccctcgacttcctcctcttcctcttcgtcatcgtcgtcgtcgtcgtcatcatcatcgtcgtcgtcatcgtcgtcgccgccatccccctcctcgccgtcctcctcatcctcctcgtcggagatctctacgacggtgtgccccgccgcgcccttctccccctcctcggcgtcctcctcctcgtcgtccccctcctcctctccatccccctcctcgtcgccgtcgccctcttccccatctaccgcctcctcctcgacctcctcctccccgttcaccacctcttcctcctccaccgccgcctcctccgccttcttggccgccgccgctgcagcagcagcggccttcttccgggcaagctccgccgcccgctcgtccccctcctccacctcgaccgccggcttcatctcaagaagcgaatcaaaaaaaatcaagaagaagaaagaaatctctccctttgctttggtttggtgctgtggcggcggaaaaatcaggggaaaatttggggcgaatttgtaagcggcgcggggaagaacagggggcggggcggggcggatgcctgcggggagatcctggccgtccgagacaagaacagtcacgcggatcgatgacgtggcggacgatcggacggctgcgggggatcggttcgtgccttcgtggagggggaggactccggagtccggagacggggtaggaggagaacgctagggctgacgtcagcgtgagggagattcttttttcccaagaaaataaaaaaaaactctggattcacgctctcttctaaattctgattatagtaaaataaggccctgtttctttgagggactttaagaagaagtccccccacttaagtccctaaaagtccctagagaaacaaacaggagggactaaaaagtccctaatagggtattttccagaagtcccaaatggaggtgcttattgggaatatggtcattgtgcagtgcatttaatgaacttaagtcccttttagtccctataaccaaacagccatgaacttaattgattagtcctaagactaaaataagtccctaggacttatggatccaaacaccacctaaaatcagttggtatacattaagatttagatttatcgcccaaaaataacctgttgcatttttttatttactttcttagaatgtaaacatcccggcaaatgacctcatggtctaccaaaaatatttctcctaattaaacttctctttaaacaagaatttttaaagatagaattgtacagagttttctaaaatacatgtgtgtgtgtgtatatatatatatataggacactcatatggggcaccatggtgcccgggcaccatggtttcaaatgcacaaaatcacttaaatttttcaaaattttcaaattgtgagtatatacctagttataagaattcgattcatacctatacctatcaacaaaacaactcaaatttaactttatttcacaatccatgattacatacctaactaattatatgtatgcatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatgatgcccggacaccatatagcaccaaacaaat

SEQ ID NO: 4754 - DNA, 1606 bp, Oryza sativa
tggtacgctctctctccttttgggatcctcatagtatagtgtgttgcactgtgggtatccgaaaagtgatgaaataaacatgagtaaaacagatactgattctaagattaaattttaaatttcaaattctattacgggtacgttataagtcgattataagccgctcgatactgcagattcgaactaaacgaactctaagtattgtaagttaaaagattattggctaattcattcattatttttacaagaagcaagacactcattcaaatagtactagactggctccaaatctcaaataatcgtttggaggatgtggagttgaagcaaacgtttcgtgatccgataaaaagcacagaaatttaaaaaaaattgtagatgtggtgctgcctttcgctcgtagaaattcctaacttctcttcaaacaaagcgatgaattagcgtataattaattaaaaagaaaataaacactagactaatataaggccccctttaaataaaaggaattatgaaggaatttcataggattgaaatcctataggaaattttcctatgtagcaagattgaagttttctaaatcctacaaaatttctatggaatggcttattgcatacaggttttggaggaaacttaacaagagatccaacctcttcgtaaaaatcctttgagtttatctctctcatccgattcatgtatttttcctgtagtccaatcaaacgatcattcttatgtttgtcctgtgttttgcaatcctctgttttacccttacattcatgtcataattctatgtttttcctattccaccgtttttttattcctacgattcaaaggggccctaagtttgaaaacaattttcctatatatatattttttaaaaaaacatagtttcagggaatgcacgcgtaaaataagtatagagaaattagaaagacgaacaaataaacacaccctaaacccaattgcatagttgtactctctcacgagttttttttatggaaattgctatgcatacgaccaatgcgtacgacccacatccgactcaactaggacatagacacatttactatttttttatcccatatagaaggaagctaagtgcaaggattggtggatgaggtgtgattggatgctcgttgtacgcactggtcgaatgtatagtaggactctttttttaatgcccatttgttacggctcctactcgagcatagctgagaagtgactggaacaatgttcattgtgcttatttgaatctgattacaaagattttatatcggtttttgttattaaacaatgtgtttcatttaaacatttctatatataaatttattttataatattaaataattttattttccaagtttacaataactaaaactcaataatcccacccttttctcgttttgcgtgcacgggtttaatcctcatcttcagccaaatctaacgagagtgtacactaatttcttttaatgaaacgacaaaccattggcactgcaattagtgctttactccttagggcaagtactacgagcatccaagcacaagccctaagatgccacataggactaaatagtgaggtggaggagagaagaaggatgagagagaaatagtc

SEQ ID NO: 4755 - DNA, 990 bp, Oryza sativa
  unsure (1)..(990): unsure at all n locations
atagggcgaattcgagctcggtacccgaggagggcggtggtgagctactgcggcgagccggtggggacggtggcggcggaggaccccgagtgcacggagacgctcaactacgaccaggtgttcatcagggacttcgtgccctcggcgctcgccttcctcatgcgcggcgagaccgagatcgtccgcaacttcctcctccacaccctgcagctgcaggtgagccgattcagatcctgatcctgattcaaatttggggccaaacgatttcggattccaaagtaatcatcataccgtgggtactgagaactgctaattgcgtgcacgttaggttttcctgctagttggggggaggaaaatacagaattatgcatggttagatatatatgagaagtttactgccactttgggtctttgaatatcatgtttcagattgaatttgcttgctagatgtgattgtctagtcctatgacctatgatgaattcgtattctatatggctttagctactgtggggtagatggagataaggtttcccttttgcagaataatactatgtctctttctcacgtagtctgatgaaccagtagacagcctatatattattatatgaatcaaagcagctaatttgtcacaaaatgatgaattgctagtgcaataaatactgctagtgatgaattgggcccagctaattttcggaatattatgaaaataattcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4756 - DNA, 15386 bp, Oryza sativa
gtcgactctagaggatccccgcaagtatatcaatgataaaccttattatgcatatgactgcttagcattatattgagctttatcaaatgtatgtgactcgtgttagatatcattcatactctcaagatcaaggggtcatttccattttttccacatatataattaagctaagcttctacattggaaattggcttcccacaaaaattccattcaaataaactcctactttagactatgctttcttctcctagaaaatccttggcaaaaataaaaaaaatgagaaaaggagggaaaggcatggctatgaaaaaaaaagaaagaaataaagcttgctctcaaaacaatgagcatgaaaatggagaaggtatagtagaaaggataattatttctttattccatcattccataaaatatttttgcttttccattttccaccacaaataaagacccttgatctaggagtatgactgatgatcttcttgagtccatatttttggctttgcaatatatatgatgcaggtatgtcacaattttatccctgccgagctccacatatcagccttagaataggaaaaagttcagacacaatttgccttggtgaggacccacaaagacagaatacttgagtgacaagagagaaagtcaatatgagaaaaagagctagtttgcgaaaattcataaaatcccatgagtttgacaagtggaacaagaagggctggaatcgagatcgttccatttatcaattactcaagatggtaagttagccactgatagagttcacaggtgcaggtatggctttgaataatttatatgcttgaattatatcttggagaaattcattctacactaacctttactcagggacgagtaaagagctaagtgtggggggttttgttggcagttattaaatgccgattctatacctgcaacagtggcataaagtacagataattaacatccaacatagtgataggtgttgaatctcacatattccacaagtgttggtgtatattggtatgcaggtgttaaaccctgaagatgggaggggaaacaaacaaaagtgaggagaaacatgtatccacacaaggatgggttgtgaacttcatcaaaataccagagaatcagcccaaaactctgagaaatggatagaggagaaccaggaccatttacccccaagtaccccacccaatggcgcagcgatcttggagatcggcatcatcttctccaactccggccgccgagctccatcttcgatttctccctctccggtgagtcccaatccgattccctgccatggtagcctcgcatggacctctctaacacgaaagacatgaatgcatggtagtcctttgaagaaatcgagccatcgttgttcatccaaggtgaagcgccactgccgagacatttcgcgagccatcgtcgacgaccaagcttggccgacctcatccgtgcgccaggatgccgccgtgcgtcatcaccgtcggcggtgaacccctgcgatgcgacgctgccccgccgtggccgagccatcccggctcgggccagccgccgtcgcgaggaagaatggggaaaagaaaagaagagagagaggaagaacagtatgtgtccaggggcattttggtacttacacagctctttctctctccattttgaccggaaataataaaataatgggaggactgtccagcaacttattaccactttttgcagtgcccacgagcaaatacacgatcttcgggtgtctcatagcaaaggtcgcaatctttcggtgtcctgtagcaaattttgccatgattttcacatgcatggatcttctgaacacctagagataatggacatatcaatttcttcgcttgataagtgtttgtcggcaggaggttcgacttaggaagcataactctcaaaatatccatcaaatcattgaagcttgtgtccgatcatccatgtctggccttcaatctgagaagttcaagcacagagcgcaacaccgtatagtccttgtcgcatcctttcgcttcgtcgtaaagaagatccttcgctgttttttcaacgcttcccaattgtccaaccctcgtcttctaccagttaggacctctggttcaacatgccgcaacatatcttccagatcaaaatcaatatctgcatcgtctatactagagtcaccgcattccgggatggttccctgtgacatgtcttcgattataatattttacgcatcaccaaagcagaaatcatcagcctcttcgttacgaccaccgacttccccgtgaaaagtctatatctcgtagagagaatcccttatatgccactagaatttgaccagttcccttatatgccactcaaaattagcttctcccttatatgccactagttcaagtttttccacccttttatgccactcctaccactatagtgttagttgactgttagtcaaaggttagtttttttcgtaaatgactaatatgccctctcaactaaaaaatgtgtaaacttcaaaaaaatcataactaatttattttaaatcctctttgagtgaacaaaattttgtcaggaccagtgaaaaatgctctttatattaaaaatattgttggaaaactgcatgtttcatacttacattgaaaatttatttgcgatggtaatggctaaaattgcacgcgatgtagaaaaaatcaattttcatatgttgtatcccgtagctatattagtactaaaatacctattattggttgtagactaattctcaagggcaaatgcgtctttttacaatcaagttaacggtcaactgacggtggactgacggcaatggcataaaagggagaagaaacttgaaccggtggcacaaaagggataagccaatttgaagtggcatataaggaagccggttaatttagagtggcatataagagattctctctatctcgtaacccttcttaaatcctcgctctacgatgtgcgacaatacttaattcagatcttgcaatctttgcatgggcaaaaaatgcccctcaaattctccctcacagcatgtgcctttgccagctcaacgaatttgcctgcttccttcaagaacgtaggatgagttctttttgtgttgtacattcatgtccgatccatgacctagaatacagcttgtcatgaatacatccatgcccgattcaaaaatgagtgtatttaaacagagggaactaatcaaatagtaaattaaagttttatggacaatttaaacgagcgtacagaattttaaccattaatataatattgtccatttctaaaaaatgaaaaaaagtccttttatccgaatgaaaataaatttaatggaggcaaacccaacttttcaatttggatactaaatacttttaaaaacatgtaatggaaacattatacattagctaaaatataaaaaaaacaaaaagtgcctacactattccatttataaaagtgcaagtttcttcgaattgcaccgacgaaaacttacaaaaatggaagcaaataaaggagaagaacaagctctacaccttttatatggaacccaatcaaagatttgaggtcgaaaaccttcccccctaatttgtgggtgtttaggagagagaaaacaccgacatatatggcaacggtcgggctgggggtttatatagccccccgaccatcgcaagcggtcaccttacgtgggctgcacgggtggcgccggtcttcggcttgttctaggcggagctacttatggcccgcctggaagctataggggccggcgtccaagaaaatctcgcgtgtagtagtggcatgtggccgatatcgtgagtaccattgatatttatataaagtagcatatttgtagtgacatggatctaattaacccttttatttaaccaatcacttgtctttttacgctgattttatcggggcaaacagtggttgtgtgcttcgtgcgatgtggggaggagtggacttttgtcaagttttgggatatactccgatcctgatgtcctacattttttaaacccacatagtctaggaagaaaatagcgtgttttaggtgctctttgtctaggtttacaagcaaatacagtaagccaaaaaatctaaatctaaacaacagctttttcatttgtttttttttctaaaaccatgagtcactctatcactgttaaaccaaaagttagttaggccgaagaaacatttttaccttacgtgaagtaaaagtgtgactctaacattaaacttaagattttttttcagggattaaacttaagactttaaattcactaggttgtaaatcacataagctaaaaggataacttaaaatttctcaaaaaaagaaaggataacttaaaagcctataaatcaatctaaacaaaaaaaaaacccttaaataggtctcgaggcaacacgaagcctttgtatccagattttccataaaagatgctctacgggcctaaacttgtgtgcagatttcagcccaacgtccgcacggagcttaattagttcccaccacccacttgagccgccgccgctattcatccatggagccggcggcgacggtagcaatggatggatggtcggggccttgccgagtgccggatggtggcggtggccggagtcggaagagcgccggcgtacgtgggtggggagtaatttctgatccgtggatgcacaaccaccgtacgtgccagtaacgtataccgctccactttggtgcctgtttgggaaaagcgctgccccaaaagtccacagtttctaagaatatgtagttatatattctcaaaaatgaactaagaaattagaagctgaaggagctgggttttcagagcttttctagattctcaaaagctggttaccaaacagctgcttattagaatctaaagctccgtcaaacaggcgcttttatctccgctgttgagtacttcattttcaggtcatctaatcgctggagtcgtttgacgattgcaaggtacgtacatgtaggctcgagctaattaagctgcagctagctagccagctcaagccactacataccatttgagtgttctggtagtgattttggaggatttcaattaccaatattttttttatagaaccctgtggttcatagaaaaggaaagaacattttttggtaggattgtattccgacggcttaatttcgtataagaaaataagaaagaaggtttgatcttttgatgattttcattcctgtgggattagagaagaaaaaaagtccattttactgccccaaactaattcaatggatcacttaactccctaaactattttttaggctcattttaccccttgaactattaaaaatggttcactttactccttaataacatttcctttttttgttactttttatacaagttttattttaagctgaaatttgttagagtaatagttgacaccattaccaaagtttaaaaatattttgaaattttttttcatggtgttagcttgaactttaaaattttgatgtttaaatcagtttggagtggattcaacctatgcaaacagtgaggaaaaaaatcataaaagaatgtaagatgtaggttgtggatgcatttttattctaccaatttttcagtgcaaaatatgacttatacaatgagaactaaagaagagaaatagcgttaggggagtgaagcaaacatttttaatagtttagggtgtaaaatgagccaaaatatagggttaagtgcttcagtaaaatagtttgggggagtaaaataaactttttcattagaggaactcaatatttcaattcttgcgttattctattttttgtgtttttcctgtcctgtttttcacagataaactaaatacttacaaatatttggtatgtctgcactgtgctctgtggatcatgttctccgtgatcatcgatctctgtcaggcaagacgccaagaacacatccaccaaatctttgacccccgggagagaccatgccaagaaccacactccccaacacggacagaacacagaagatgcccctcggcaacagcgcgcggcgcagctaaaataaaattccttatcccctttgtgctcacatgtgcattgcatatatgcagccttgctgctcgcctgcaatgcaagtatgcaacctgtgatcctcctcctcttctcagtcagaggtgagccccctcctgtgacccctccaatgccgttcacatgatctcactctctctcgctctcactgtcgcacacattgagcagtgtgactcagtgagccacctctgcctttttacatgaccatgctgctcttgtcctagctgcacatttcacacttcacatggcaacagaagcagcagcaacagcaagatgtcttcttcttcctcttctttctcctctccaatctccacacaagcagcagcaactcatctttgctgctcttctccttctcttcttcttctcttcactccagagtttgcactgctatgctgctgctggttacaatgagcagcaggaagctgatagggtggccttcctccccgggcagccaagcagcccgaaggtctctcagttctcaggctacatcactgtgaacaggcagaatggcagggcactcttctactggttctttgaggcccaggcactgccctctcagaagcctctcctgctctggctcaatggaggttgtgcaataatgtctgaatcatttacttctgcaatagaaatgtgaactttttggtacacatttgttacatgagtgcatatgtgcatgcagggccaggttgctcatcagttggatatggagctgcctctgaactagggcccctcagagttagcagaaatggagctgggcttgagttcaacaaatttgcatggaacaaaggttgtgcaaaaactaagcatttttgtttcttataattgttccaattggtttgagcaaattaataaaatgctatacgcatgtcactgtttttcacattgttcttgccagaggccaatttgctgttcttggagtccccagttggggttggcttctcctacaccaacacatcctctgacctcaccaaactgaatgatggttttgtaggtaattcagtattgttattggtaaagtatatttttcttgaccattgtttgtcacatttgagatgtttttggcgccttccttccttgtagccgaggacgcatataatttcctggtaaattggttggacagatttccacagtacaaagaccatgaattctatatttcaggagagagctatgcaggtaattcttcacatgaacatgaaagtcgtctcttgcccccttggccttctttttgttgttttgattagaacaaccaaccttgaaattgtagcctacatgtctgaaaaggttcaggaaatgatgctaatgcatcaaattcagattatagttgacctttccaattaggaatttattagtaatacttgtatctattccgtaataaccatgaattggctttgagataaactaattcaaatttttactagatttgagccaatagttcagattatgcatataagatagtttgctgagccctaatatgtctactacaagtttctagaagttcaaaattttagttgcaggtaatatagtgatctgtcctgtaaccataaaaaaaaagcatatttaggtgcttaggaagaaggatatcataatccgtgaaaatagaagcaaagtgaatatgtcctggttaacatcatgacttgacatcattttcatactatttagatatgaaggcgtgtcctcattttccaaaatgaaatgtttcattcctgcaagatcctcatcccattgagcactactagtggtattgactggtcatactagaattatgtgatatctcatatgcggtagtaaaaaagatgccctataattccttttccctgtacatcaccaacaagaattttcgaattaatgcaggtcactatgtgccacagcttgcagaccttgtctatgagaggaacaaagacaagaaggccaacagatatatcaaactgaaagggttcattgtgagtacatccattcactgattagtttgccagtattgctggtttggcttcattctttcatatttcaaaactggatggcaatattatttggtaaagtccattttaatggactcaaaaactcttcgttaagaatccgagagctgaaagtacatttcacctataatattttagcaacatattgacagtaatgatgatgctttttctagataatggtctttaatttagataaaaatcagtggaacatcagaaaagagtatttcatctattattgaaggtccaacaggaaaaataaaatcttgcagttctcgaaataagttctaaactttctggaatcataacattggtacttgggcccaaatacaggttggtaatccacttactgatgatcagtacgactcaaaaggtcttgttgaatatgcttggagccacgcagttgtgtcagatggaatttatgagcgcgtcaagaaggtgtgcaacttcaagatctcaaactggacgaatgattgcaatgaagccatgagtagtattttcagacaataccaagagattgacatctacaatatctatgcacccaagtgcaatcttgctcaaacatcaagagtagctgctttcgatcacgcactcgaagcaagcgatcaggttgatgacaaatagttcaaattagttctgcttctgaaattctaaggcttgttgtttgacttggtaggaacaattcagtaggaggattaggatgttctcaggatatgacgcgtgctactcatcatatgctgagaagtacttcaacaagccagacgtgcagaaagcattccatgcaaatgcaaatgggatgctccctggaaaatggaaggtttgcaggtgaattggcttcttttctttctttttttttaacttaagaatcggcttaaatttcttccactaaaaatatttagagtggcaactgtagatttgttaaactcttaaaattttatattttcttttaaatctgaagtccttctctattgcatattcagctatacatatacgaggggcatatatggaccctttttgggcctagaaccacacacacatgtacacagcccacacccacaaatatacactgcccaacagtccccctcaagatgggcgataaatatctatcatgcccatctcgctacatgacgacatacactatttaacacctaaagccttcgttaaacaatcaaccacttgttctctagaattcacaaagtttaacttcaaggttttgtcatctatcctttctttaataaagaagcgatcggtctccacatgttttgttcgatcatgttggactgaattggtagcaatattaatggctgatttgctgtcgcaccataacttcatgggaatgtttatcatcaacttcaattcagttagaagatctcttacccataacaactcgctcaaactaatcgacattgacttgtattctgcctcagcagttgaacgagacaccaccaattgtttcttgcttctccaagatactaaattgccacgaacaaatacacaatagcctgatattgaccttctatcatcaagacagttgccctgatctgcatcacagtatccctccacatcaagatgtcaattttcttgaaccataagcccttacctaggcttcccttcaaatatctcaaaattctatacacagcatccatgtgaccacttctaggatctgttacgaatctgcttgcgagtttgggaatttaggattagaggagcagattcgaacagagagaaaggggtaggaggaaggggaagaacagaagagagaacttggagcaggggaagatgcagtagttagggaggaatagttttctgttcacttgttcgatgccttttcccctctgctcactcgtgcttatatactcgcacgtttacattctggacctaagcccattccggcccagttactctcacattaggcctgcgtactcttgctggtcgcgtcttcattggattacttgccgtgagtaatgtcggacctggtacagtaccggtgacattcccctcttcttcagaaacggcttgtccccaagccggtgcttcagggaaacgcgcacgcagtgcagcaccatcctcccaggttgcttcagcggacgtctgaccagaccaacgaatcttgagttgttccacagctccagcgcctttcttgactgcacgacgagcaagaatttgaactggtagcgcttcatcttcagttaacgctggcaggtcttgaatcgacgagtcaggagctggtgaagaagcctgacagagctgtgagacatgtactactggatgaatagcacaagttgtcggtagttgcaggcgataagccacgcttccaatgcgcgccaagatctgaaagggaccaaaataacggaaagccaatttgtgattagaacgtcctgtcaaggagaactgagcatgcggctgtgccttcaggaacacccagtcaccaacttcaaactcacgatcagaacgtttcttgtcagcctggaacttcatacgttgctgagctcgtaacagatgttgtcgcagcaaactggtaatcacttcccgttccttcagccagtcttgcaaatctggaacagcacactcaaagcgatcgagcacaccaaaatgccgaggagaatgaccatataatacctcaaatggtgatttgtccagagccgaatggaaggcagtattgtaccagaattccgccaaagcgagccaacgataccacctcttagggcaagcgtgcacaaagcatctcaaaaaggtttccaagcactgatttacccattcggtttggccgtccgtttgaggatggactgtttgccaagcatgcttgggcactggaagaggctgtaagaaacctgggtaccgaacccgttctgctttggcctgtttacagatggaacaagccgacacaaactggcgcacagcttttctgagtccaggccaagcaaataacttattcactcgactgaaggttgcctgagtaccagaatgacccccaattgctgcattgtgcagtgcagtcagaaccttagtctgtaactccacattgttacccaaccaaatccttcccttatggtagataatgccattctgtaatctgtactcagggagcgcctctggacttaacgagagcttagtcaacagttgagaggaaacttgatcctgagcatatcccagctgcacatctgccaaccaaactggaatacaggaagacaccgcactgagttgaaacacatcggttgactgattgcgtgacaaagcatcggcggctttattttccagtcccttcttatagacaattcttcttatagacaattctgtattgtaaaccaagcagtttggtcagagcacgctgttgccaaggtgttactaatctttgatcatccaaatgaatcaaactgcgctggtcagtacggattataaactctccaaactgcaagtaagagcgccattgttccacagcgagaagaatcgccaagcactccttctcgtaagtggacagcccttgatttcgaggccccaaagatttactgagaaaggctaacggatgaccagcttgcatcagcacagcgccaacacccttatcacacgcatcagtctcaatttcaaaaactttggagaaatccggtagtgctaggacaggagccgaaactagagcttccttcaaggcatcaaaagacgcttgatgctccgacgtccaaacaaacaccacattcgtcttgagcagatcagtaaggggcctgctgataataccaaaagagcgtacaaacttccgatagtaccccgcaagacccaaaaatcctcgcacttccttcacattacagggtactgcccagttgcgcaccgcttgaatattctttgagtcagtggccacaccttctgcactaataacatgcccaagatatgttagacttgcacgggcgaacgagcatttgcttctcttgaccttaagttgatgatcagttagcaattgaaacacccgtcgcagcaaggctacatggtcgtccaaattttgactatagattaagatgtcatctataaacaccaacactcctttgcgaagcaatggagctaagatctgattcatcaatccttggaaggtagccggggctccggtaaggccgtaggacataaccctgaattcgtagtgtccattgtgcgtcttaaacgctgttttgtgctcatcttctgggcgcatccggatctgatgatagccagctcttaaatccaaactcgtgaataaacaggagcccgccaattcatcaagcaactcatcgataattggcaaagggtagcgattcttgactgtaattgcattaaggtggcggtagtcaatacagaatcgccaagtaaggtccttcttaagcaccagcagaacaggtgatgaaaaaggactagagctgggttgtatgattccctgttggagcatatccgcaacttgccgttcaatctcatctttttgagctggattatatcgataaggtcgcaagttaacaggttttgctcctggcagtaaaggaattgaatggtcaaagaccctggccggtggtaaaccttgtggctcatcaaagacatgaacaaattctttcaacaactggtcgacagcctgaggtacttctgtatttgttgtttccttgatcagagaacacaactcaaccacttgcatcacagcttcccgatgaatcagtccttgaacttgattgacagatagagatgtacagctgctaatatcagctctaacacctcgcaaacaaacatccttttgtgcatgtttaaatctcagagtcttagccctccaatcaatttgcataggactgtgttgctcaagccaatccattccaagtattacgtcataacttccaagaggtaacactttcaggttgttctgaaaagaaacaccctgaaccagccaaagacaattctgcatttctttgttacattggagtattcccccatcagcaacccgaactcgaaaagattgcacagttttctgattgcctcttatcttgcctgccatttcttcagatataaagctatgagtgctgccagagtctacaagcatcattatctcatactgttgtattaatccttgcagcctcaaagttccagaagattcagtccctagcatagcttctttagaaatctgacagacttcgctaacagtttcagaagccctttctgtcagctcatcagttccagcggatttggtttccccatccgattcctcaagcaggtcgagtaactcctccacaacatgtaactgcacagttggcccacacttatgttccctactccatttttccccacaagtgtgacacaatcccttagccttgcgataagcacatagtgctgccactcgatcctccagaggctgagttctgtcatcaactcgcccaccagctcgcccaggagtgaaagcaacattccccacagtacgctgtccgacccgatgagaaaaacctccatcaatccgacgcgaatcccgtcgtcccgcttccaacacctcttcctgtaaacaagcaaggtccacagcagtatccaaatcgtttggacgatgtaaaattacggctgcgcgaacttcaggtttcagtccatcaaggaattcagtaatgaagaatactgaattccaggatggatgatgagcatagagttgatgcatcagctcattgaatttttctgcataactaagaacggttccctcctgcctaagcctcttgaactgtctaatgagactctgaaattcctccctcccgaacttagcacaaacagcctccgagaaatcattccaccccatcaattccacatgagcattggtggattgcaaccacactagagcactccccgaaaattgcaaagcagcaaccccaacccacacatccgggctaatcccacttactcggaaataagtttcgcatttcattttccaggctctagggttctctccttcaaattgtgggcaatctactctagcattacccccatggaatcccttggccgggagagacgttggagagaaatcatctccagacgccttcccccgattcatcgttgcaacgttgcggcctcacggccctgaactcgcgtccgcccctttggaggccgtctcctcctccttcggcaccgtcggcgtgggtagaagagggggcagatccgctggcttgacggcgagaattggattgcgggatatccgctccacttgctggcgcaggtcgccgaggtcgtcccgcatctccgtcatggccttgtccaccgccggtttccagctcgcgagctccaccaccataggcttgatttcctccaaggatcccatcgaagcttggatggcggtattctgcttctggattgtcgccatggccgccgcgagttccgccaattgttgctccatctcttgggacttgagttgcgcacgggaatagtatctaggtttgtcgaggtactccaggatggatggctctgatacctattgttacgaatctgcttgcgagtttgggaatttaggattagaggagcagattcgaacagagagaaaggggtaggaggaaggggaagaacagaagagagaacttggagcaggggaagatgcagtagttagggaggaatagttttctgttcacttgttcgatgccttttcccctctgctcactcgtgcttatatactcgcacgtttacattctggacctaagcccattccggcccagttactctcacattaggcctgcgtactcttgctggtcgcgtcttcattggattacttgccgtgagtaatgtcggacctggtacagtaccggtgacaggattatgcatatactgacttatcacacttacagcatgggttatatcaggtcttgtatgacacaagtatatcacctgtcccacaagtctttgataactctctttatttactgggtctcctaattcagcacacaacttatggttttgttcaatttgtgtagaggctggtcgacaaccaagcatacctgtgtcactgagtagatctaacgcatactttcattgtgaaagtactatccctctaggagatcttgcaatctcaatgcctaagtatttcagctgacccaaattcttaagttcaaattccttacttagattttcttttaatcttgctatctctatagaatcatccccaatgataatcatgtcatccacatacacggcaaagatagtagcgtgacatcccttatgatgatagaatgatgtatgatccccattacattgcttataacccatgccacatattcatagtgaaaaaaacgtgaccggtagatgacccggtcaccatgctggttcactggtttcacggttcaaccgtgaaccggtcggtcgaaccgcagtttactaagtacatgtaatatatatgtaatatatgtatttctgtactgtcacataca

SEQ ID NO: 4757 - DNA, 864 bp, Oryza sativa
ggctagtttaggcggttgaaagtggttcaaatgcatgtccggtctttctattcgaccgaaccgtgccaacctccagttccggttgaaccgccgatccggtccggttttttacactaggcacgcattacacgttgaaaacaatcaaaccattctcctggtgattgtttgagaccatataaagatttcttcaacctcaacacttttttccttcagtttgtgaagtgctaaatccaggtgggatatccatatacaccacttcttgaaggtctccatgtaaaaatgcatttttgacatctaattgatgcagtgaccaatcaaaattagttgtacaagtttcatcataatcaattccatatgtttgactataccccttagcaacaagccttgctttctacctttccttctttccattaaggttttgctttattgtatatacccacttacagttgacaactttcttcccttcaggaaatggtacaagattccatgttttgttcttctcaagagcctctagatcatccagcatagtttgatgtcattttggatcttgctttgcttctctccaattctttagaattcccactaaatctaccgatgctacaaaggccttatatgtagatgacaaagagtcataagaaatatagttggatatgttattctcatcattaccctcatcttgagcttcaaaaccatatcttagggaggtttacctacattgctttttacaccctttctgacggcaattggtaagttagattcttcttctctaacttcatcctcttctccccctaactccaaaggcacttgcacatgacttgcatctcccactacttaattatcctctacaacttattggatcactgg

SEQ ID NO: 4758 - DNA, 2039 bp, Oryza sativa
ctttgtttatcatgattacactagttgaactatcaagatcaacataaaaaagaacttaaatctattttctcatcataaaatggaacaaattctctaaaagtaacatccgtacttacaaatgttcattgttctgatggactccaacacttataccccttctggccagaggaataacctatgaagatcaagttttgcaacataaggtctgttgtttctgacaaagcatgtgcaaccaaacacctttggtggaagaacaaatacattcttgtgaaatatcatctcatatggtgtcttcatcccaagtattcccgatggtgtacgattgataagatatgttgctgccattacagccacactccacaagaatttaggtacattcatagtatacatcaatgaacgagctgtctccaaatgatgatgatttttcttctcagccaccccattttgtggaggagtatcaggacaagaagtttgatgtaatattccttctgatgaaagaaagttactaaattcttatttatatactcccctccattgtcagttctaataaactaaacccgagcattaaaatgatttttaatgtatgcataaaaattctgaaaacatttaagcataaaaattctggaagcatttaagcacctcgtccttgtgcctcataagatatatccatgtcatgcgagagtagcaatcaataaaggtgacaaaatacttcattccactcatagaaaccacaggtgaggtccaaatatctgagtgaattagcataaagggcaacatacttcggagtcctctactcacatatgacatttttgtatgtttcccatactcacaagcatcacatactaacttatgtttatccactctactgaactctactggaaatattttacttataatttcaaaagatatatgtcccaatcgacagtgcaaaaataacaccttagctcttcttcacttgtggaagccatcaaagctagacacatggcttcattagtccttccccgatccaaatacgaaagtccatcatgcctgacaccaatcccaagtttcttccctgtttgcctctcctgaattaaacaattctcacgatcaagggagacttgacagtccatatgatcaacaagaaaactttttgaaaccaaattcactggaaaggaagaaatatataacactgatgataaagtgattgaaggagtacactgcactgtaccctctcccttaagtgggcatgatgttccatcggcaatttgaattgtttctttacgtgtaaatgggtatggtttatatgatgcaaatgccccacgcatactcgttacatgtgtaatgcactagagtctaatatccaatttggataagaaccattgatggacataaatgcttgatttgaattatctgaggtggaatgaacaaagttggtaacatcaacatttataggttcagaagaacccccttcaagagtgaccacattagctttgtgatcacctctgtactcatagcctctacctctgttatctctactttcataacctcttccacctcttgctcctcctctatcaccatttcttcctcttccataactaggcttgtgagaagcacgacaatcacacataagatgccccatttcaccacaattaaagcactctctagttttattaccttgtacaattgcataggtgggacttgatgaagacgatgtggcataggaaatagtttcttcttaagctcctcttgtgccatagttgcaatagccacatctaaggtaggaagagtggtttggtgaaacattgcatctcttcttcctttgaactccggatttaagcccttcaaaaactcaaggacccttttacgctctacccatttcttcatttttgctatgtaattagaatgctctaacccaagaggatcataataatctaaatcaaatcacaaacacttcaactctgcgacatattctgccataggcgctccccttgtttcaaagcacttatcttctcttgtgccaccatcattagcatcatattaccttcttctgagtatag

SEQ ID NO: 4759 - DNA, 577 bp, Oryza sativa
cagcaaactagccccccacctgttttcttgcaacggcaacagccaaagctcgccaaatcctagggccacactcctatgcttcttcaaccagtgcgccttgttgcatgcgctagcttccacatgtcctgctccctctggtcacagtgagcccgtgagtccctgtattgccttcctgaccgccgtctcatgcagtgcgtttgagtccctctcaagaagctggtacagcgtgagtccgtcgtcccggcccttcaccgttggctaccgagcatgagccatcggccttccatcgcatccacgacgacggtgcgccacactcgtgttaggcagtgtgtgtgttgtggcccaaaaggcccatgtctcgatctgcctgcatatgtatgaagtaagcaattgacagagggtgtgaagcttcaagagaatcaatcacaaatgtctgcatggcatcagagctgggtcgccagcgaccgcgtcgacactaaaccttagctgccgtcggttatggccagataagcggggcgcacagacggtgtacttaggggtggccagaaaaagaccgggtaccgagctcgaattcggc

SEQ ID NO: 4760 - DNA, 545 bp, Oryza sativa
  unsure (1)..(545): unsure at all n locations
tgctttggtgatgcgtaaaatattataatcgaagacatgtcacagggaaccatcccggaatgcggtgactctagtatagacgatgcaaatattgattttgatctggaagatatgttgcggcatgttgaaccagaggtcctaactggtagaagacgagggttggacaattgggaagcgttgaaaaaacagcgaaggatcttctttacgacgaagcgaaaggatgcgacaaggactatacggtgttgcgctctgtgcttgaacttctcagattgaaggccagacatggatgatcggacacaagctttaatgatttgatggatattttgagagttatgcttcctaagtcgaacctcctgccgacaaacacttatcaagcgaagaaattgatatgtccattatctctaggtgttcagaagatccatgcatgtgaaaatcatggcaaaatttgctacaggacannnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4761 - DNA, 1858 bp, Oryza sativa
  unsure (1)..(1858): unsure at all n locations
accctaagggatcaaactaattttcagtggcatataaaggattctctctatcaagaagggagtataacgaattctgatcagcagatcagaggtctatcaatactactactccatcccagaaaaaacgaattcctagctatgaatctaaacacatatgtgtctaggttcgtaggtaggattggtctttttttttttaagacggaggggatacttttttttgtttttttctcgaaggtcatgctcagacaagaaagggcacgtttggatcctaggtaagggccaccctagccttgcctggcagggctatccgtttggaacttgctccctccgtccttaaaaaaaaaagacaaaccctgattttcgtgcccaacgtttgaccgtccgtcttatttgaaaaaattatgaaaaaaattaaaaagacaagtcacgcataaaatattaatcatattttatcatctaataacaatgaaaatacgaattataaaaaaatttcatataagacggacagtcaaagttggacacggaaacccagggtttgccttttttttttttgagacggagagagtagtaaaacagcctggcttttaggggcgagttagctctgcagggcgagaaaaaccttgctggctagggagagccgatttggctcgctttcgatggaaaatttcactcgcgcgaaaatattgtctgcgggcgacgcggacttctccggaatcgctgatattctctccccaatcaggagacgaactcattggcagcagctcggtctggaggcgatctcatcaacgtagactcctatatttgatttctcctttaggtgtgtttagttcacgccaaagttgaaagtttagttgaaattagaacgatgtgatggaaaagttaaaagtttatgtgtgtagaaaaattttgatgcgatgcaaaagttagaagtttaaagaaaaaatttagaactaaactcggcctttatcgtcagcttctaaccccttctttctcagatacatggtgtgctgtcttgttcaatcgctctgtcaggaagtaggtagagttagaaaagaggatccccgatatcgtttgctttgtgctagatgcagcctttgcgttgccaagatcatttattatgatggtacttgattaaggaattctcttgatttctcatttgtgaatcctaaaatatggttgcacatagctttgaggtacttatagactactagcaaaagaatggctatggaaaaaaaaaccattgcaagattattaacatgaccagtgccttataatttttagacaaaaaaaggaagcaaaataatcatgggcaaagcaagaatttgtgaaggatccaaactgctagccacggcaagactagtaagctggcaataagatggcttagccatgctgagtagggttgaaagtgatttagataattttcgcccgaccggacctttttttttggattcggatagtttcgatcggatatatccggaaattttcgaattcggaatttttttaaatatgaaaacgaatatgatataggttatatccgtcagaatcagatatctgtcggatattatccggtattttccatcggatatccgacttacacataagtctgccatagcccataacccatcccaactaaagaggacgcaaatcaaacttcttggcaaaactgaatttcgaattgaattttatgatactaaatgaactcatatgaaaattgtcaaaaacaaagttgcagaactcattaagatctactaattttattttggtcatttctctatccgagtttcattgaactatataaaatttgaattttaaaatataataaannnnnnnnnnnnnnnnnnnnnnnnnnnnnnnnnnn

SEQ ID NO: 4762 - DNA, 1130 bp, Oryza sativa
ataaaaaataattcccacctaaaagagtaatttatctagggactacaactcctacctttttcatgtcatccaaattgccatacaaaattgtgaaataattaaacaactatgttgcatcattatatattatttggttagcatgcatagctaaattggatctataacatgtaagtgaaaaagaacaaatttaacaatgaataacataccaattatgagaaaatagattgtacctttagtcggatgtaacaatatccaattacctatgtcttttggaaatgtgctcaactgacgaaacaaattaaatcggctgatttttaacgtaagcgctataaaatatattatacattgccattaatttaaggactcagagagttttttaacacaagttttagtacattttggatggaaacagatgaatgttgatatatatggcttccatacctttcatatataaatataaatttgtctattttatacatgtagacagttaaaaatatgaatatatatatatatatatatatatatatatatatatatatatatatatatattaaatttgtttgatgctccatggtgcccatgctccaattatatccaccattcagctgctttaggatttgtgcactcaaaacacaacgtttgaatctgttagcgggtttaacccgataaaagatattcaatagctggtttgtgccatctttccatttatttatccctgcatgatttgcatgtatccatttccatataattatatttatatatatatatatatatatatatatatatatatatatatatatgaacattaataggctacaaacacgttcattcttcgtacacatgcagaagcaacattaaaatccatgtagacattacgatatactaaaatataaataaattttatgattagttacttaaaaatacaagcaacgctatactggatcgcgtgacaactccgataaaattgcagccatatataggacacatacaacgacatttttggactttagaaaataaagattttccttacataagcaacgcctgcccacttgagagatggtcagatggggaaatttgagtctagattcaagacacaaaacaagatgagcctcgcggacacgcccacgccg

SEQ ID NO: 4763 - DNA, 1130 bp, Oryza sativa
gcgcctgacccacgtcgacgagccgcaccggggtgaagagaaagaccgggtgataagagagataagggagagagagcgcgcgctacacactgacaagtgggtcccaccacgttgagtcagcttgtcagccgggtcaacaatgccacatcggatgaaaccgccagcagaaccaccgagggaggtgatttgctctggttttcagagatgaagaaggcgttatatccggttttccgattgagggatgttattcacgcaaacgcaagagatgagggaggcaaaatggacttattcctaccaggaaaaagtacataaggtccctcatcgggtcaccaaatcaattataaaatcgtccctaaaccagaacatcatatatatagtatcccccaacttacaaaacagctaattttaggtcgttaggcagtattgactctggttgactcgggttttatccgacatggcaactgagtcagtgttggatctacatgggcttcacatgttagccttaggcggttttgctgctgcaaccgaatccaattattcaatggcaattgcatcaggggcagctttctcggtgaggccgtgcgtcgcgtctgcgtcagccgctggtgcctcgagggccgggcaattgggaacagcggctacggaggaggtgggaagtggtgggtgccactgctggggtggtcggaacatcggtgttggcgatggatgagcggcgggaggcgatggtggagtggtacatgcagtcgtggaagctccgccgcggcaaagaagaacgacagccccgctgctccgccatcaacgaccgcgcctcctccatcggatgcgctacctcattttttcttcctcctcctccattgatttttcttcctcctctctatatcctgtcagaggaagacaggcggcggcagcggtggcggcgagggtagtcagagaaggggcgccggctgggtacctactccgcccaagccatggtggaggaaagtcgaataggccgcccttgtggtgtggcacgtggaccgacgccgagaggatgggcgacgatggtgcagcgcgccagctttttcacaccacacggggtcgcatgctactgctgctgcaagctacaagagtcagcagacgcaacgaagaaa

SEQ ID NO: 4764 - DNA, 820 bp, Oryza sativa
  unsure (1)..(820): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgcaatatttcatcaaaccactcttcctacgttgatgaggctattgcaactatggcacatggggagcttaagaagaaagtattgcctagtgtcacaccatcttcaccaaatcccacatatgtagttgcacaaagtaaaaagatcagggagtgcttcaattgtggtgagatgggacaccttatgcgtgattgtcgtgctccacacaagcctagttatgggagaggaagatatggtgataagggcggggcaagaggtggaagaggtcatgcgggtagaggtaacagaggtagaggctatgagtatagaggtgatcacaaagctaatgtagtcactcttgaagagggttcttctagacctacaaatgttgatgttgccaaccttgttcattccacttcacataactcaaaccaagcatttatgtccatcaatagatctctttcaaattggatactagactcgggtgtatccagacatgtcacgggtatgtgtggagaatttgcatcatataaaccatacccatttacatgaaaagaaagaattcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4765 - DNA, 586 bp, Oryza sativa
  unsure (1)..(586): unsure at all n locations
nnnnnnnnnnnnnnnnnnnnnnnnnnnnnnnnctggggtcagttgtgtcctctgcagggtgctagaaagaaaataatcctcttggggagaagattgttggtaaatgcttgtagctttaggacatctgtggtttaggtttagcagctcaaaaacttgagagacagtccatcatgttagtcgttagtgcatactgctgatgtgtttgattaacagcctctttgagaacatcatctgtatgaggaaagatatgagaggcttgctttatgctttgtgtagcttctaattcaggtctctggaatttcttggtgcttcgtactgaatcctgcctgccaccatgatgtttctctttaccaaatttttttttgtcttactatttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4766 - DNA, 417 bp, Oryza sativa
gggcgcctctatttagacaccgaatgctgactgaattgttgacctgacaccagatgataggagcgtagttctagtccaatctgcaacgtttttcttggcatctgaaaaataaccacaataaactcagagccatagttaaaagttcaagcagagtgcaatgtcttatatgccaggcacagatgtcaacatgcttgggtagcctagaagctgacttagacaatgggaaagctagaagtgatatctgaagctgacagaatgaatgtatttcctggcatacaatgtacttccccatggaattatccagttaaagacattcagagctatgaaaacacaaggtacgtaaacagagaagaaccatctaaaactgatcagaataggtacacaaaacaatgatggcttcaggataaaggcaactgg

SEQ ID NO: 4767 - DNA, 12474 bp, Oryza sativa
  unsure (1)..(12474): unsure at all n locations
nnnnnnnnnnnnnnnnnnnnnnnnnnnnnnnnnnnnnnnnnnnnnnnnnnnnnnnnnnnnnnnaaataaattgaaaacaccaaaaaaaaaaacttgatatcataggtagtagcagaaagacttgatattttgataattcgtggattaaaacgatcattgaattcatctgcaatataatgtattcaagcaaaagagaagtgtaagaatttgtaaccatgcaaaatgaaatgggattttttcgcaggcacaacgatccttttgctctgctactactgatatgctttgacattaacatccaacaatctagtggagaaacaaagatgaatttgcattgtttggctgacacagaacgggtgccgatggagccacggaggagcggtcgatgcagcatcgccggaggtggcagtggcagtggcggtacgtactccctcggcgatggccttgctggcggcgcgctgcacgtcgggcagctggtggtcggagtctggagtggagacgacgggggcgagcgggacgtggagcagccaggcagagttggcgaagtcgaggctggcggaggccccgcacagggcgagcatggcggcgtcgtgcgcgcgcggtctccttgacggtgtcgaacgtgccaacccagagacgctcaccgcgcgcggctgcccgggaggccgggacacgcaccttgcacacccaccggcccgcgcacccacgccgccgaacccccggggaacactgggtgcctcgtctcctggaacttggtccgcgccgccggccgcttcgacgacgacggcgtcgccgtcacggaggaggtcatcaattggctggtggcggcggtgttcttctccatggcgcgtgcgacgtctcaagcagttggttggtgttggcggcggcgacaacgggggcgagggcgtccgcgcgtacctcctccgcctccccgccggccacagccgcgcgccgccatcaccgacggcagtgacttgatggcgtcgtcgtcgagtcgatctcagtgatgatggccacagccgcgcgctgacatcgccaaccgcacgagagggatgggaaggccggcgagctcgcgccgccctaagcccgcgcgccgccaccctccagccgtgcatgccgccgcctgtgcgagagcagagagcgagagggagtaaaggggaaagatagcatgtgcttacgtggacacctaacatgtagggtccacgtgggtcccacgctgactcagccgtcacctgggacaaaactggggacagaaccgctgaagaacctagtttgcactggttttgtacgttaagggatacgttgtatccgattttgcggtcaggggacaattttgtaattcgatgacaagttgagggaccttcggtgtactttttccattgttttttttttgtcttttttaagggtctggtttcactgtttcaggcagccttgaatgaagtttatttgttacaagctctgtttcaaaatataacaaattctagcatttaaagtttatcttaaaatataacaacttcttctcctacgttcttttctcgatcaatcacaaacttctaccattcaaattctctatctacatactattctcaatcagtaataacttttcatcaccatttaatttcactaacatttttaatacatgtgtctaatgttagaatcattatatttatttttgagcggaggtcgcagtggataattattattcgttttgcatgtgcaaactgcaaagccctctagttttggcatgtctccaatccatgtattgatatattatggaaaatgcagtttgtaaatttaaataatgtgatttagtgatctaattttagtctcgaatgtcaacaaaatgtctttgtcgtcctaattatcctactctatttcatactaaagtttaaattaatttttggagctagagacatcaactcgaaataaaaagaaaatccttgtagtttacattttttttcaataggtgttttatatatgattctaaaggaaagatagacgagggcaatgtagaatcataatatgccatggattgtctgtggtaggtaacgtttcatttacgtcatgaaattttttaatttatatcatgttttgaaatctatgatgttgacatgacggaaattcattcatcacctattgtacatcttctttgaagaaaatatttgttttctgtcattgagcttgtgatgacccttctatcatcattgagcttatgactcttattttcatcactatcgaacctaagaaacatcatcttggcctataagggcaatatagtatcattttggactatgctcaattgtaagctcggctagaggtaagcctagtccatctgaaacatagcaattgacacactgttgacatgttaagggccatgtagtgagcaatctacgtatggctaagtccaattgcaagtccggttagatttaggtctgacccatataaggcatagcattttatacactacttcaatccaattcgttaatccatttgcagtagtatcaaatactcctgcaaatggcttaacgaataggctcaagcattttatataaaggttataggccagttaacatctaataaatcctagtggacatctaatacaatggccaacctagccacacgtcctagcaggtttactaacaaaaaaaaacattataagttcactgaccaaaacagaaccggttcagtaacatcagcatgttgaccatacatgcctttggtagcaaaataaacaggtccaatacatcattgaccaaattgagccacaactcactgaccaaaacaaagtcatgtccagatcacaatcttattattaatatatggaaattacttggaaaaagttcgtgttttggggggtaagtttccagcatatatgaactttcttgtgtatgtattgccaaaattaatgtactctgattaggatccccataacctattgtatgtacaatattatggtttccattcattttgtttgttttgcaaggctgtatccctaaaggaagggctggaatgaacatgtgtatcattaaagatttcaatcaacaggtagcttgccaatcccagtagatttgcgcagaccgggatattttattccattatctaaaaaaataaaaataaagtaaagatgggctgagatgctcaatgaagataacggaacgcaatacatgttgtattgtatttatattgcattcacataaaaataaagtaaaataattaatacataagaacatccaagatatagaatagggtacatatttccagagctgcctaaccctagccggttacaggatggccagagcaccggccaaccgcgcattgcatcacatgctgcagggaaaatcgacaaaagtttgaccgtgtgcctgtgtacaatacggcgtcgacattggcactgccatagtcaccggtgtggcaaatgggtcgagcgtcaagcgacaagcaatgaagacgaacagcagggctcaggcaaaagggcacgtaatcataaaattagaagatgaaatgacgatcggttgcatcatatttgacttggagcactttatttatttatttatttattttatgaattgttttattgcctagcaggcgatggataatgtgagtggccaatactaactacaacggaaatacatatttgttttaatattatagagacacttttttaaatgccttgtagaggcattttcaaaaatttctcataagtaccttagagtgaattgtctctgtagaggcattttataagatgtctttatgtcttgtggcatttttatagagatattcttttgtctacaagagtgtagaggtattttctagagacattaaattataccacaaccatattaaccaatgtaaaaaaagagataaaaatattttcccttgctattaacaatccttgtgtttataacctcttgggtaaatcatttttatcttccatacactaaccaactcaatttcatgttatatttaaacatttgtgccttatgttatttatatctattacttagtatatattaacattataaaaagtgattctatagagcttaaaatgcctcaaaaaataattttacataacatgcagtttttataagtgccaaaagaatgactctataagataaaattaaataaaatatactgaaaatatcttgatttcaaagtaccaaaagttttctaggcacaaagtgccactaaaaatataactacactataaaactcctgattttaaaggcaattcaaaaagtgtctctacaaaagtgtctctctatgggggttttgttgtagtgactaggagggagttgtcgtaactttgccaaccgaccaaccctgtccaatgggtatatatgtccacctgtgccagattggcacactacatggatacattaacatgaagttaaacctgatagtcagcaaattaaagtgtctaactggtgtttgtctaccggcagttcatttttttaaggcttcaaagaacagatggccggtatttttttattcttgtgttctaaaggagtacttgctaagaaacccacaaccggaatagaaaccagacatatttaaggtccaccccacatggcagacacaccttttatcttatattgcaactttgcaaataatcaaatacatgttttacacttattaaaaaaatcacacccaaaaaatctctctatacatatttgtgaattgtgcgatggctcgaatggagctaacgtagattccttttgtccttattgatcaagaccagcaactatccttctcctcgaagcaatcaatgtttcaatctcgttccttgttgcatctccattaccagatctccgtagagtcgcaatttgcctatcgatgcttctcacctgtatagtacaaataaattaaattcatgtaatcgtgagaaagtatttctcaaagtttaatctcaaacaatattttaaataaatacgccatataattaaaaaataacggttttggtagagtgggatttattctcagtgttatttcttgctaatatatagacgacaagactttacaagtgcacaacatagtgttcaacatatttgtttttcttgatctttgtcacaaaatagattgaaattaaagtaaaatgatctagctgacctttcgatatggccagcgtaatacgccatgtttacgacagatgcctttgagagcagtggcacatatatccagctttttagcagccttggcgatgggtagttcaaagtagggggcaatgtcgctaagctgaagctgcttagttttctccctctagaatagatcaaatttagttaataacagtacacatatagaatagtaatgcttaattagaagtattttttatgtttttcatggttctgatcgattgtgtagataactggaatttcttatagtaacttttggtgttttgccgtacctccatagtgtgttgacaagaggtacacagattaatacacataataaaaaaaaatattatgccacctctcagtaccttctcaatcccctactcatcctagctactcattttcttagagcatatcatatcttgatatactttattctcgaatagatgaaatgcatcttaatattttttttacggggaaaatgcatcttaatataactgtagtaaaacttccaaatcttaaattattaataattaatgtaaaagtgttaacatacatattggggtatatgtgaaaatgatatgagtggatttgccataaaaaacacttttattcttacgtttaaatactcttttatgaatatatagcttgaaaatgtgacgatgaaaaatgtctattaattgaagactgtgttgatatccaatatgtcgtagatatacagcatcatttttttctttttgtttccctcaaattttgataaccattatttcttcagttacccagttaagtaatagagtgaaaagagtatcattagatctatcatggaaagaaaagtactttaagaatgcctaatatatgtttgtctatctgcacaaatatttgtagagaaaagatgagtagttcaataaattaaaagtgtcaactctatcatatatttaaaggcaaaatttgctacaggacatccgagaaatatgtaattagctatgagacatcgtaaagacgcgactttgcctgtggacactccaaaagtatggtaatttgctgtaagacactagatgtattaaaatataatattcacccaattgatgattgagaaataacataaaatgacagttttgccctattcttattctccgttctctctcggtcttcttcgacgctcctctcacactactacaggattgattttcttggacgccacccccattttgtttccatgcggtccgtaagttagaccgcacggaaaagtggggcgagcgaagccaggttctcgcccgcacacgaaaatcaattttcgtgtgcgggtcacttaacaggcccgcacacgaaaataaccctattttcgcatgcgggcctcctaatccacccgcacggaaaaatagcgtccctcccatcctattcaaaataatttaacttccttctcttccccccggccccttctctcctctctctctcccttatcttctcacattccttctcctccactcattttcctctctctctcaccttcttcttgtgcctacttctccacaggatggacggcggtgagctcggcggcggcggcggcggcgcaggcggcacgggcagcccgtggctcctcccctcccctcccctccccggcgagtgcgcgggcggtggatccggcgggcaggcgggtgacgacgggcggctgcggctcctccccggcagcgacgggagtgcccgtccctgcccggatccgacggccagccgccctccctccgccatggatccagcgcaggagaccggcgggagcggcggggacgacctgatctagggttttctgtttttttctgaaattttatttttttcgattttttgtttttgcatgcgggcaatataagcacccgtttcgcgtgcggttgcgccaccgcacacaaaaatagcgattttcgcagacgaattgctctagacgggccgaagttccgcacgtgaaaatccaaatcgactgcactggaaaactatgtgtgtagtagtgtcatgtccgcaccctgctaccagtgaaatcgcaagccacgcccgccgccacggagagtcctccctgacacggtggaaggagagcacgctgaggagctagctggacgtaccacgcagatgcggcgcgcctggcgccagcactcgcgccaagtcgccagtcgccatagggcgcgaacgcgacgtcgcgcgcggccgtagcgcgcgaaggcgcccagttcacgtgcctgcataaactcctcgatcggccgcggatgccgtcgtccgagtcggagcagcagctagcatcaggccgtgcgccgtggcgagggaccggagcatgcggcatgcagcgcgccaagtaggtggaggcgaccgagcagcagcaggagtccccgcgcggcaacgtgcagcaaagcgtttgtttgcttggttgtagccgcgcgcgacagcaggctcgatggatggctggggcagcacgtagctgacacgtacgtttgttacgttatagcctagcaactccggccagcaaatgggagcaagtgaactacgtactccatccatttcataggcaactgagaagcatccaaagaaaaccgaggaagggagaaaattgttattttatatcgtttctctctcatcaattgaatagatattatattttaatgcgtctagtgttctgcaacaaattatcattcttttttaagtgtctttaggtaaattcacgattttacgatgtcccacagctaattatatatttttttaagtgttctatagcaaattttgccatatttaaaagatagatcggaggtactatattatacgtacctggattgcaagtgcactcctggtagcgagatggaagcgttgttggacgtgatgactggtatgacttgcttgggaaggccctgcaaatacacaaatgtaccaaacatgcatgatggggttagccatggcaaagctagctaggtaattcaactccagaactgaattttaatcgattcatgaacgattatttagcaatgtgctccctccgctccattttagaagatgctttgactttttttttctaaatcaaacttattttaattcgataaaatttatagaaaaatatatcaacatttttcaacaccaaactaacatactatcaatttccagggtttgatttttattacactacttccaatcggttgcttgaaagaacagtaattggaagccaaaacttttttagggtggaaaccaaaagaggttattgtgcccaaagtttgttatattattgtactttgcgtgaaatatatgtgatgtacggcatgaattgaattaaaactcaattgcacaaattatagaaaattatttttttgctaacatgaaaattgaaaagttattaaaacaaatagaattaggttcaatagaactaatctagtgttataagagttactacattttcctataaatttgataaattttaacataggaaaaagttaaatcaacttacaatacaaatatataatataactagctaaatgtctgtgcttaatttgctatggataaaagaaaaatcacaatattttctaaaataaataaaacacattttccataaaaatatgttatccacattttttggaaaatgtggctaccaacattaattttatatgcgactatccatttagatttagttatttataatattaagaagtgcaaggagtaataactaaaaattgtaataggagtagatggtatgacagattcactatcattggagctagcctttaaatttttgaaggagtatagattaagatcacgatcgaaattgcactacgtacatgtgcagaatgcaacctgatgctggcggctggatagcagtagtgtctaggacgacgagtcgacgatcaccactgccattgttgttagttgttgctgcttgatctgctgccacaaggcaacgtgatgattctagcattggcaggacggcagcattgtggacgacgagttgaccatgatcaccattgccattagttctttcttctgctgctgctgctgctgatgacgatgctcttctatgtgcgtcgtcgtcgccgacatggctgctgcaaggcgccatggtggtgcagagggcgtcgtggaacgccgacagcgagtcctgcacgacggcgaagccgccgccggctcgccggagtgcgtactccgtcaggtactgcttcacccagtcgtagccccgccctctgaaactgcgattcattggatggatatatatagtggattaatcaatcgatcagcttgcatcaaatcacttgcatatactacctccgttttaattagatgataccattgactttcgaatacacttaaatttgatcatttgtcttatttaaaaaatgtacattggtatcatttatttcattgtgagttgttttatcactaaaagtattataagcatgatttatatcttaacatttgcacaaaaaatttaaataagacgaatggttaaacgtgtttaaaagttaatgaagccatctattcaaaaaatggagagagtataagatttaatcaggacaagaaatctagagaaaataatgtcattttaggtattactttgagttaatcaatttactcgggtgatgatcttacttgatgatggagtgatgtgccagcgccggagccggggccgaggcgctgacacggtacacgtccagtattgcatggtagaactcaccactagcgacgccgccatgaatgcaaagcttcgtgatctccaaccctagaagttcataataagaacaaccagattaaagcgaagtatctcgactaatgtttggtacatatcattagcattttttttaatattaattaatgctcatcccattatttggcattatttgttttcatccatgatcaacatcgagaagatttaatgtgatgtaccattggaatgcactacttctcttagcacttggcaaccactgcaatagtcctcctgcggcggcgccagcgccggagcggcggacgacgacgtcgacgcgccaccgtactcgccgtcgattttagagcagttattaccaaacgcggtcgaccagtccacaagatcgtcgacgaaggaaccaggcttattaatccggccgccgccggctccgtccacgctcatgtgcaccggcgctggcgccggcggagcgccgtcgtcgtcgacgtctccaaggacggagagatcgagcagttctaacacgtcgaagttgtccaggagcggcgacgggaagaagtcgagttccaagtgctccccacctccatcggcggcgccgttgccgccgtcgcccgccatagccgccggcgaccagcctgacggccgcttcgatcaccttacgaattcgatcaagggcggccggaacggcggcgcgccgtgcgcgagggagcggagtggagatagagatttgagggggcgcgagggcgggagtgaaatggcgggagatgtgtgtagagatgagaaggggtgcgacgcggtggagtttttttttagcggttctgacagttatttttgtcggcggctatcacccgttaacggagatccttactgtctagtatgcgctattctttttttttttgactttgtattaggactgataaagtagggacattctattttttttctttgtattggtttgtgtgagatgggtgaaaaataaacttactttgggatggaggaagtaacaaatatcaccaaagtcacaggaaaaattacacatatactttaaataatatacacctatgtgtagtgttaacctcaaattcattttattttaacttagagaaacaatattacttatagttttaatagtatcaatctatcaatgtttttttattgatgttctctatgtatgaatttaaaaattggattttacaggtagatgtaatactattgaaagtacatgtacaatattttctaaaattttatgatattgttgttgtatttgctagttagtgtgtacggtatcacaaagatttgtgtgtataggatactttttggacatacactcaacatgtgtgtttattgaagtgagtgtatgtatgtcgtgagtgcttacgatttattttgttatccatgtccactgaaaacacaaatatatattcccacaatccccagaattcccggaatggctcacacatttcacatctattcacgtataattcacaatcacataaattccaagcctaagtaatttgcaagtccaatgaagaattggatgtctcacacttagtaatccaaatgataccaacatacacaacacatacataggcatcaaaaattgttttgcacaaaatatataaacaaatttcacttaatcaacagtttttacacaaacatttaaaattgtgcccctatcttgaacggatggtgccttttggattgatgagttcatccagcacaaaggcagcggctattcctactctaatgttatagaagttgtcttgagaaatattcttaattgttgcttgtaatagaggcatcaagttagaattataggcgcatcatgttagtacgaggaaattttttggcatgatatagatgaatgcctatcatggttatggataccacatacccaatagtaatcgactaagctcggtgagcccaccatataccaagtcttatacggaaccataccttgtatatagaaggaattccgaataaggaatgacacacagaattctacatagaaacgacaggaactacttggattgtatccatattggtctccctagttcaacttagatatggggacatctattggtataaatacaagacccctaggaggagaggaaaaagacatagacacacaagccagaacaaaccaatacaccgccaggcatcgacatcagagataagcttagacagacccaatatggtgcctgcggaggccaacaagagggatctagtgtcatatctgatctcgatgagttcgtactcgaggaggaagactaacctgtcgtcgactacgtgttggttatctatgccgccaagtcgacgacaactagataggttatttcaaatattgtacttgtgcgattctgatgaatatagagcaaaaccggctttagccaacaggagtagggctattacctatcagataaggggcccgaatctgtataaaaatccttatctccatctctgtacctcaatctcgaatataccctagtaccaacgatctccataccatgcaaataccgttgttgcgacctcagacgtcgacaatgcctttgtgacgagaaattggacattgtgccactgccaaaagagggtttcgctcaaatgctactacgcaaattggtttcgttaaaaagctactcccaaccgatgcccaacccgttgttttgcgatattcggcatttcacatgatttccaccttttttt

SEQ ID NO: 4768 - DNA, 5767 bp, Oryza sativa
  unsure (1)..(5767): unsure at all n locations
ggtgaccggagcaactaggttcagtggtagagagaggaggaagggagagaagacgggaaagagagccgaaggaggaggtcctggtagtggaggcaacgagccctttcgccaaatcatccgaggagcaatccgccgccgccgcccgagaagaaagaagttgagccagccgtaggggaggcgctaaccgccgatgctgccgccgacaactccccacccgcggccattgtcagctcctagccccgtggccgccgttgaggaggagagcggcgccgcgggagctcctggccatgtagtgtgatgccttcgcagtgtccctgtccacgcagcttgggccgccgacgaggaggaggatagcggcgccgaagtgcgaaaaatggtggaaattctgtgaaatggcgaatatggctaaacaacggtttggcatcattgggagtggctttttaacgaatctaattcacggagtggcatttgagcgaaacccttttggcagtggcacaatgtctaatttctcctttgtgacatgccgctggcctctattataatggatcgttcacgatgcccagttgtgtactagtcgagtgacaatcggacaattaccattttttaaaaggaaagttgggtttaattacaattttaatcggatggaatattgaaagattaaattgtgattgatttggaaaaccttttttcatgtgtattctttaccagtacgtcttatataacaactcgaattttatggcaaacagtcgagtatgaaatgtgtaaaaacccagactttttttttttacagaattcgatttgaacgtagctataccgagatgatgatttctgagcttgaaaaaaaaggatttgtaaaatgagaactaaaagaaattgagaattttctcagagtacaattaaaacttgtaaaccaggaaaaatttaatgttattaattcgaaccagaaacctgattaaaaaattaggaatttagagagaagggaggaccttcgttactgggccgaagcccctatctaaagtgagggaccttcacatcctctgccaatggcccatgctacagcactgtgccgttgagcaatcttagcccttcttttctaatcaacgttatagataaataatagatttttattttgttcttcccgttgaatttcatttctatcatttccttcctcccacgagaaagagctgactctttctctaaacttcccacaaaaattaaaatagcgattaattagttgaacgcaacatatacaaaactagaagatttttttttagctcttgcaacctgtctacatgaattcattcttgatttccgtatgaaagaaagcaagacagagatcaaaagggggaagaaacaagcccatacgtatccagttatccacgatgaaattggtaattaacaccgtaaactggaatactcccttcattgtaaattgatttacatatttattaggtacaccaatatcaagaaaatctaataactctctcatactatatttactctagcaacaaactcgatgcatgcaccattcccactattttctagccaataacaaatcaagatattgcatgtgggttataaatatttgtgtgcatggatgcatgcattaatgtccatttactccaatgcacaaataacgaatagactcaatgaataaatacaaatatgtagataatttaggaataacctaaaaaaactatatgtagatcaatttggaatggagggagtaaaagagtacatgactgcagacattacaacagcttgatagcttggagacataaagatgcatgagaaggatttgagcttcttttgcataaacttaatcttgtccgttcgttccgaaagagcagccatgattaccccaacggcactagcgccatagcatggaccaacggcagaggatgcgaacccccaaagtgaagcccgtccctccgggcacagattgttatggtccttgtggcccaacttccccaaacattacatttgataattacgtttaaatctttgtaaatttgcaaatatattccattttggacacgcaagatcggtctctatatatcatccgcactgatttataaaagtataattatataaatatactagatgaaaccctgcgcattgcagcgggaatttagtatgataacaataaaaaaaataaataacatgtaaaatagctagataacatcagattaagtaaattaatgtggtttatgataatttaaatttaaatagtatatagaatggtgattaaaatgtaaaaagtaaggtggcatgactttatagaagaagaaaagtagagagatagtttggaccgtagattaatcatctaaaagctaaaaacaactgatgtgatatgacttaattagaggaaaaaaggagaaagataattcggaccaaaatcatttaagcactaagtgaggatgaacaatataagtatataggatatcataaaaacataaaaagatatacattgaaacattatgtaaattatattggatgataatttaacatgtttgtatttgaaaatatcttaaattataaaaactataaagatatagcatgtttgcatgatgtttaaatgtgatgattgttagtgaatgatgatgtggcatcttgttaattagtggatgatgatgtggcatcttgttagtgaatgatgatttatcatttttgcatgttaagcttaaggagttagttagaggaaaaaaaggagaaagataatttgaaccatagattaatcatttaagcactaactaagtgaggatgaactatataaatatgtaggatattataaaacatagtaaagatatacattgaaacattatgtgaattatgtgggatgataatttaacatgcttgtattttaaaagctcttaaattataaaaactataaaattatagataatataacatgtttgcatgatgtttaaatgtgatgattgttagtggatgatgatgtggcatcttgttaattactccctccagtttgggtttatttgtcgtttcggacgtgatttcaaaaaccaagaagtcgttaggtagggttgttatttcctatttcgtccctattaaatacagttatgtgtagcatgcaaacaagcaactactactactctctcagttgggttagtgcattcatcttggtgtgttgggtcctgagttcgattcttgctctagacacataccccattgatttttgtcttggcgattatgcatggcaccatgcatgcatgcatgcagcccatgcagcttcagtgcagatagcacgcgaggcggcgagggcatacgaaaattaaaccagccaattttattcaatctgtgcttatgcgcgcgtttttccgccaaaagttttcgtttctgcttatttgccacgctaatttgccgcgcgctgcgcgtgtatttatactgtatacacccgtacttgtagacacaccaaaatatacgagtccacatcaagcaggttgaatagagaaatggatctgaatatggagccacagaatgacgacaattttactgatgagatggaatacggtatgaagcattgtcttttttcttcttttggcgcataccagcttctctgccgtgtacctacatgttcttggcactctaggtgatttaaacttggatgatggacttgatttcaatttggaagatttgattgatttcaacttggaaccacacacagaagatgttgatggtaactagtcttttctttcatcttatatccgtagagtattcttctttgcatcacacctacatgttcttgtatggtaactagatgatgtcattctggatgctgaatctgatgtcaatttggaagctgagattgagtttaacatggaaggtgggattgatttgaacttggaaccacccttcactacaagaaaatatacaattagctaccgtatatttagttaccaagaagtttggtgcctagatattaatcaatagtaaccaacatgctaataccttggttgctgtagttgtcagcacgttacttaagttaaacagtaccaattacctctacagttaccaagttactggccagtacttggtcactagtcacatgacaacatatagcaaccaaggcatgtacctgatatttgaatatgtggagtactggagtgcaaaacacacttcctcttgatccccatccagaaacaaatcgagaggcaagggcaaggtctgcggctggcggcggcaccgtcgacggagttttgcggggacgacgacgccgncgncgncgacgctcggtggaggagtccttcgcggcccctgtgctagcgcccaggaatcggtggtctctgcgacggcagcgcccgagggatcgctggtggtttagctacaacgtcgtcggggcaagcagttgattcattgcaggcagcaggaggagtctccactttgattcaaggtaagtggttaaattctcctgatattctatgtttgcacacaaacaatttgtttaactggatgtgtcttgaacctgatctataacccaaatgaatcctgatctataacccaaatgaatgtttgtaggcactattattcaatggtttttgtgtgagatttgatctgctataacatgagtgtgacttacaaatctggttgactgcactaatttgattagcacacagtatttctaagctataaagaggggaaaataactaggttaaagacacatgacttccacctgcttttgcagcgaatacttccaattggaattcgagggtatttgcagaaagacatttgtgatgcactattacagttaggtagcttttttcgtcaactatgctctaagtcattgaagcttgatgtgctggaaaagttagaagaacaaataatatttgtgttgtgtaaattgaaaatgatttttccacctgcattttttgatattgtggtacacttagcagtctatttaccacaacaaccaagacttagtggacctgtacagtatagatgaatgtttttttattgaaaggtatgtgttgattaggatccttctctttgttctataattttgtcgttgtactgtagtaagtgtatattattggtatgtaggttccttggtactttgaaaggcatggtgagcaatagggcacatccagagggttcaatcgcggaagcctatattatgaaggagtgctcaacattttgctctatgtatctcaatggaattgagacaaggttcaatagggaagagagaaactatgatggagagaggcaattcgctgatcgctactcaatattttcatctagattccgtgcttttggtcacaaggatgacgtaatcctaacacaagatcaatataattccctgtgttggtacgtgctcaataattgtgaagaactgcaagggttcctatagtaagtaaaataaaatgatatttcagtaatagttacaaataattacatagttacttgtactaatatatcacatgtcgcaacaacattttagtgagcatgaggacgttttagaggcacaaggcgtgggaaatatagcaaatagacagcaacaagagtttgctacatggctgcgccaaagagtaagctcacacttggcttcacataaactatatgtccattgtttgcattagctaacatgcattatttttggcaattaggttatagatttgcgcaaggatggttcatcccaagtatctgattgtttatatgcccttgcaattggaccatacaaaaaattacataaatactctggatgtattattggtggagttagatttttaacaaaggagcgggaggaaggtcg

SEQ ID NO: 4769 - DNA, 4319 bp, Oryza sativa
ttgcagaaccgggactaaaaggtgttacgaactgtgaagacgctttctccagcagtggatgtttcaaataagcccaaaatacctccacagacagaaggggtctttttttttttgaacattgacagaaggggttgatgactaattgatcctacactcctattacaggtttctcttcttttttgtgtgttgtatttgtgcattttttaactgtttcaaggtggttacacacaaattttcatacctttaagaatcccacagtaattaaagccaatcagttgccatcccatctaactctctataattatggtctcatttgggcagtttttagaaaatatattgcagactattggaatggagcagagaaacaattaacaaacttgatctatattaggtatagagacaaattcgattgataatcgttgaaagagagaaaacactttcatagaccatggccatgcacaaccgacaacagattgctagcaaagatttggttaaaggttcaataactaaaggggagctctatggttaaaactacagagtacattgaattctatcgtttagtatcttgcaactatggccattaagtcaaggcaggaaattaatgtactaaatggtcatgcatgcagtacataaattagttgatttggagtacgcaagtcatccggcaaaaatttctgcagcgcaaaagtaccaaagtgtacttgtaattatatcatttaatttaccaaagtgtaccctagaccccaagacaactgccagctaagatataattttcgcttacagcaaaataaagacaaccgcaagtgaaaacattttttggattttaaaaaaataaaaatcgtgctcctcaacgccatcgtcggcgggacgaggaggtcgacaaggaggtgggtcgccaattccagatatgcttcccctgtgccatcgccgagtgttggtatttcttaactatattactagaaatataaattcctagcaatagcgctagaaatggtcctgatatatatatggttacagaaggaatccgcaagcgcacgaatatacgattatagcattttacccgagtattttaaggtatcgtattatttaatcccaaaagaagattgtaagagagaactatcactactggagaagtgctcatctctcccggttcgcaaccccctttacccccgggtagcgaaccgggagggagaatccgggactaaagatggcggcctttagtcccggttcaaatacctgggagtaaatctccatctttagtcccggttggtgacaccaaccgggactaaagatggctgagccacgtggtatatataggttcaccgagtttaaacgtgtacatgaccagagctgtttcgataggtgcgtcctctagcaactgctccatacttagtcccgtatctttcaagaagttgcatatctctagttgtgccggttctacgactaacggttcaacctcttgtcacggctgttgccccagctgagggacttcctttccgcatttcactactgaaggcttggctttaagagccttcctcaatgttcgatcatagtcagaaactttgaccggtttgcccggttcggccatcttaataaagtgatcctgaacctctggggctatagggatcttcttttccggactacgtggcttcaactgctccctaactttcgctctaacggcttcatcgagctcctctggagtcaagtcgtacgcccttttcttgagagcggggagccgtggctcgtcagatctggctttcttcttcgcccttgatggtgcgggttcatatgggcgggaccttgacggtgtagacttggcagcaggtgcacgcggaggagtagttgcccgcgggcccgacggtgcagacttggcagctggtgcacgcggaggagatggtggtgcaggggaaggagccggaggagactgacgaggcggtgatggcggaggagactgtgcttgcggcggggaaggaggagcgggtggccgttcttgcccaggaaacacgatgtacttcttacgccagagtatgatggcgtgggctgtgtctccaagtttcttctccccgtctcctccggggatgtcaagctcgagatcctcgtaggttcgttccaccagctctatctcgaccttcgcatatccatgtggaatgggcctgcaatggtatgtactcgaagggtctgtgggtatggccatgcctgacgcgaccttcacaagaaatatagttcattaattactaatcaacatatatatgtaacaaatttcgcatttcgcataccttgatagacaagttcctgaatggagtatgcatatcgcagggtgttcgctacgtgacatcatcaacggggaagtgggttgcttcgtgagctgccactgcctcaatgccctctgatccaacttggcccgttgatgcgcagctgctgcggttgcccgaggggctcaccatgacgggcgcttgtgtttccattccgcgctgctcagccaggcgttggtccacttgtcttgtcacctcctcttgcatccttgcctcgtaggtggacaccctgtactcaagatcgacgatcttagactctgtatccctcttgctcctcatccgactcctatacgtgtggatgtcctctttgaatccatatttccaaggaatgacgccttttcctcgcgttcgtcctggatgctcaggattctgtagtgcaagggtgagctcgtccttttctctgtcgggctggaaagtcccctgcgtagaggcttcaattgcatccgcaagtcggcgtgctgcatctcgaatctcatcgccgaatatgagggagccatcgcctggattgagcgatccaccgtgtgcatagaaccagttcctcgatcgctcaggccaattagccgtggtcggctcgataccccttgctatcaactcagcttccaacttgtcccacttggggattgcctttccatatccgcctgacccaagccggtgatggtatttcttcttagctgcattggctttgttcttttctatctgtgcttgcccttgcgctccagtcttgtatgccacaaacgcatcccagtgatccctaagcttgttatgcacgttgaaatcaggtgtcaagcccttgaggatgtatctcttgtacagatctgatttgtagctctggaatagttctgccattttcttcagggtccattctttgcatctaggacgatctgcctcagggatcgtgaatgtctccagcatggtggtccacaacatgtccttctctgtgtcagagagaaagctatcttcatcccctcgtgacctagttcgacgccagtacactatgctgatggggacgttgtctctcacgacccaaccacaatgattcacaaactttcgtcctatacccgccagggctactggttcgccgtctggggcaatctcagtaacgatgtgccttccctcaagcttcttcgcgggacctattttcccgcgtggcctcttctgtccggccgacggttgactatcagtcccctcctcggtcccctcctggttagcctcctggttaccctcatcgttgccctcctcgttcaggtattggttgggatcctcgttcccctcatcatccacccagtactgactgctgccctctgcgatcgtgtctaacaggaattgttcgtcatcgcggtctgccatttgtgcgtgcaaagaaaaaaagacagtgaggtcatggacatcaacatgtacagctcatacgtctaaaccctacaagtatacatgtataattcgctaagtcgttgttctcgttaagtcgttaagtcgctaagtcgtcgttctcgctaagtcgctaactcgctaagtcgctaagtcgttgtccgtcaaagtcgctaagtcgtcgttcgtgaaagtcgctaagtcactaagtcgtcgttcgtgaaagtcgctaagtcgtcattcgtgaaagtcgctaagtcgttgtctgtcaaagtcgctaagtcgtcattcatgaaagtcgtttagtcactaagacgtcgttctcgctaagtcgctaagtcgtcgttcgtgaaagtcgttaagtcgctaagtcgctaagacgtcgttctcgctaagtcgctaagtcgttcgtgaaagtcgttaagtcgctaagtcgtcgttcgtgaaagtcgttaagtcgtttagtcgctaagacgtcgttctcgctaagtcgctaagtcgctaagtcgtcgttcgtgaaagtcgttaagtcgctaagtcgctaagacgtcgttctcgctaagtcgctaggtcgctaagtcatcgttcgctaaaacgttctcgttcaaacgttccaccgtggagtcggcggtggagtcggcg

SEQ ID NO: 4770 - DNA, 19266 bp, Oryza sativa
  unsure (1)..(19266): unsure at all n locations
cgggacaaaagatgttttcccgctattccaaaatttgtattggtcccggatactgttaataaccgggactaaagatgtgtacacaaaaccgatttatggtcttcttaaattgtcttacaagtcgaaataaataccaataaatccaatataattagcacatggccgatttataaataaatagaaataaacaggatatacctaagtaaatggtctcaaagtataaataaatagaaataatcatttataattaacataaggccaatttaattatattcaaagtgtaaatatatagaaattatcatttataattaagatatggcctacttaattgttttcaaagtggaaataaataccagtaatcagttataaataacatattgcctaattaattgtattcaaagtgtaaataaatggaagtaaccatttataaatatcatatggttgaaaaatagtaatacattacaaattaagcagttgagaataatatattgatccaaattgttcgactttcaatacaatacaaataatttacatcttccatcaaacaatctaggtcactgtcttcctcacgtagtttctcctcactattgttccttcgctatgatcgttgcgtgagtacggcgtgtcctcctttgatagtatgatgctcgggtcaaccgtcactgcaaacggaggttgctcctcaaacagatcgtaattttcgtcagtcttatcctcgactccaacgattttcctcttgcctgggagaatgtaacaccccgattttcgttcgggattaaaaatcattaaataatgcattttgtagaaatttaataaaagttaaagcaatttaatcaagtgaaatattgagggaattaaaaatttcctttaaaaatcattggccgagaatattttgtaatattctttgtgccctaaatattctctgaaattttcccgtgaattttcggagctcaataagtaattataataatacaaagttcatttaatcaatttaaataaaaagaaaagaaattaaaatctccctttctttgtctttgggccgccccagcccaattcccttcccctcccgcgggccgcgccctctctctccctctcccggccggccttcctcccctctcttgggccgtcggcccgtttcccctctccctcgcgaagtctgttttacgtcccccttccaactctccctccctctctccccgataggtgggacccgtggaccccacctgtcatccccttcctccagctccaactgccgccatggccgcccgagccgccccacgacgccggcgttttcgcccaccttctccaccccgcgcgcgcgcgctcgtccgtgggacctcgccgcccacgtccgcgccgttttcccccacctctcccctccaaaaccgccacccacaccccacgatgccgcccacgccaccggcggttgccgccccgactccgcctctcccgggctcggtccagcctcccctcccctataaaaacattccccgcacctccctctccattttcccctctctcccgagccctcccgtgcacgaaaaccaccccgccaccgtcgcaccttccgccgccgctcgccgacgacccttcagccggtcgccacagccgctcccaccaccgcctttccgcgcgaccgccaccagcggtttcgccgcgtcgtgccgcaccccggcatccgctccatttcccctccccgcctccgaagcacagtcgccacgcgcaccacctctttccactgccgccgccgactccagtcgccgcttggcgccgctcctagccaccccaagtcgcgctgttgccgccgctcgcttcgtagcgccgagcagcacctcggccgccgcttttcatggccgggatcctgccggaacacggttcccctcgcgccggtgagcatccgcgcccgttctcacctccgaccagcgattcatgccgctgggagccctctctccccctcctaacctctctcccatccttcctaggtcctttcggccgccgtccgccggttcccgctcgcggaacgccgccgggccgccgttctgccttcgtcccgaggagcaccgacgccgagctcccccgtctttccccgcccctcgtcgccacgtctttggtgagctactcctcttcctctttgcctccctcctctgtctcccgtgcgcgctgccgcgcctgtggccgccgccggcgaccaccgggccgtgcgcggccaccgttaggtcggccggccggcttgccgccgccccgcttgcctgggccgcccggatccccttgccgcgcctcactgccgctttctcacatgcaccggccgtcgccgcaggaggccgcgccgccgcgagccgtcgctcagccgggccggcctgagccgtgcccgtgctcagccgcgccaccccgtggtcccggtccacggtggaccgattcccttgacccgctgacgtgtggggtccgcctgtcagcgccggcctctttgatgacgtcagcgcttaagctttttcctttgagaaaataaataattattgcgcaataatttggtttaattatagaaatccattaaaatggctcaaaacttctaaaattcgtatctaattcattcgaactccgattgagccattcaacttgtaaaattcatctaaaattgagctctacatgtttgtttagtttttatgtacttttttcttggtttttattagagtttttcctcgttttgcgtgccagcgtgtagaatccgtcgtttcggaagtccgtggtcgcgaggaaaagagttcggaagatcaaagtgaagaagcaaggcaagtcacacattccccttgagcatgttgatcccaatttacaaaagttttactgtttgcaaataaatatgcatgttttgctaattacatgggatcagggtttacctatctgctcgcttgtgccatatttacttgatatatgtcctttgtcaacattgggtaataaatcgactagctcatgttacttatgtgacctagctagaactatatgcttagccatacttaattaccactagctcagttgatgggataattacagtattagaccttttagtatcagaatgagctgcgtgctcgagacatctggccatgcttcatggtcataattatccaactaaaatgtgactgaaaggtgggctgtgggtgcatggttttgctagtcgcacccatggcaattatggaccggttcacgggaaaccctggaagaatttttcgtacttaccacaagccagcgtgggcaacggctgggcttgtagtgtagctttcctctagccgacgcatccaggcaagggtgggcgtgatggagcggggtgggccctgcgacggcctctgtcgcttccggattcacttaggcacgagaggggactgcccgctgccttgcgaggagtgggggtgaaacctgaggtgtggtgtgcttggctagagagggttatgcgaagggtcctgtcacggcctctttccagtatgtcgtggtggcatgtcggcgcacggaaacgtgtcgtggggctgtgtcttgtgggtacagttgtacacctctgatcagagtaaaactattcaaatagccgtgcccgcggttatgggcggtcgaccagattcaccgtgattagtcccaccttaatgaatcgactcaatgcactgtagttcaggtgggttggttgggcctgttcaatgtggtgtagcgttgatcagtggagattcaatattaccttaattactcaacagttttagtgttttgctcaataaaatgttttacaactgcctttatgcaaatagccacaaaccgtccttgtgtccccttgcacgtctgcattgttggtgaggcttgctgagtacggtggttgtactcagtcttgctattattcccccttttcagaagtgtagtgcttctgagctgaagacgaggttagaagaccaaggctcagaccccagttgagttttgcctgtggagtggagctgaagccccgctaggatcgtctttttctgctgctgctgcttttgtttcggtgtgaggactaagtgcctcttctgtaagtattttacgctttatttacgtttggaactgtatattacttgtcgttttgtgtacactggctggtcctggacagggatttaatacacaaaaaggtctgaaaatttgggctaaatttctgggtgtgacagagaacaacatggcgtcttggctcatcgggccctttccccttctttggtttgctatccatgtccttcacgtaaaaaacttgcgttacatcattggctagaacgaatggttcatctgagtatcctaccttgtttaggtcaaccattgtcatcccgctgtcatcaatcgttatgcctccaccagtcagcctaacccattggcaccgaaacagagggaccttcaggggtccatactctagttcccaaatgttgtcgatgacaccgtaatacgtgctagttggaccatcgtgtcctatggcattgatacgaacaccactgttctggttcgtgctctttttgtcttgggctcttgtgtaaaaagtgtatccattgatttcataaccttggaatgtagttaccgagctggagggtcccctagccaagaaggctagttgtcggtcaatcgtctcgttacccaggaggtgttctcgcagccaagcggggaagtatcaatatgatggcgtgtaatccaggcttcggacttgccactgttttctgagcgaacaattgcaaggtgctcatcgatgtaaggagcaaccaacgaagattgttgcaaaaccgtgaaatgtgctttacggaataaatcgttgtctacagtcataattgctctccttccaagtgtgccctttccccgtagtctcccctcatggattgattcgggtaccccgattggctcgaggtcttcaataaaatctacgcagaactcaatgacctcctttggtcaataccccttcgtgatgctttgcttccgacgagaacggttacgaacgtacttctttagagcgcccatgtacctctcgaaaggaaacatgttgtgtangtacacaggaccgagaataccaatctcttttacaaggtggctcagaagatgcgttattatattgaagaatgacggtggaaagatcaactcaaagctgacaaggcattgcaccacgtcatgctgaagggcggctaaactttctagatcgatgactttctgtgaaattgcgttcatgaaagcacaaagcttcgttattgttgcctgcacattatcaggaaggataccacgaattataacaggaagcagctgtgtcataagcacgtgacagtcatgagactttaggtttgtgaacttcttatccttcgtgcttattattctctttacattagaggagtatccggacggtaccttgatgctctctaggcattgaaacatactctccttctcttccttgcttagggtgtagctcgccggacttaagtaatagcttcatttctcgttcggttccggatgaaggccctcgcgctgttccatatgcttgagatcattgcgtgcttcgagtgtatctttggacttcccatatacacctaagaagcccagcaggtttatgcaaaggttcttagtgaggtgcatcacgttgattgcgtggcgaacgtccaagacctcccaatagggtagctcccaaaaaatagagtttttcttccacatcgccgcgtgaccatcttcgctctctataggttggctgctaggctcctttccaaatactactttcagatccttcaccatttcgaacactgctttcccgttgcgatgtttaggcttagtacgatggtctgccttctgttcaaagtgcttgccttttttccgtacagggtggtttgcagcaaggaatcgacgatggcccatgtacacaaccttcctgcaatgcttcagataagtactttcagtttcatccaaacagtgagtgcaagcgttgtaccccttgtttgattgtccggataggttactaagcgcaggccaatcgttaattgtaacgaatagcaacgctcgtaggttaattgctcctgcttgtcctcatcccacacggggacgccctctttcctccacagcactttcaaatcttcaaccaatggtcttaggtacacatcaatgtcgttatcaggttgcttcgggccttgaataataatcggcatcatgatgtacttccgcttcatgcatagccaagggggaagattgtagatgcacatggtgactggccaggtgctatggccactgctcatctctccaaacggattcattccatccgtgcttaaaccgaacctcatgtttcgtgcatcctcgccgaagtctttaaatgttctgtcgatatttcgccactgcgactcgtcagcggggtgtctcagcatcccatcctgtttacgttcttctgcgtgccaccgcatcattctagcatgtgatttgttcttgaaaaaccgcttcagccttggtattatagggaaataccatatcaccttagcaggaattctcttcttcaaaggctgtccgtcaacttcacctagatcatttcgtcttattttgtatcgtagtgctttgcaaacagggcatgcttctaggttttggtactcaccgcgatacaggatacagtcgttcggacatgcgtgaatcttctgtacttccagacctagagggcagactgtcttcttagcttcgtacgtactttcgggcaattcgttccccttcggaagaatgttcttaacgagtttcaataactcgccgaatgccttgtcacttacaccatttttagccttccattgcaagaattctaggatggtactcaactttttgtagcccttctcgcaacctgggtacaacgctgttttgtggtccgctaacatgcgctctagtttctgcacctccttttcactttcgcagtcctcctgtaagacccgcaatatttgaccaagttcatcagcaccgtcattcccttcaacatccagctccgcctcgcccattgtgttttcttcaaatccgccatactgagccaagtccggaatgttctcatcttctacttcatcttcttccattgcaaccccaacctctccgtgcgaggtccaacaattgtagctacgcatgaacccccactgaaacaggtgggcatgaatagttcgtgtggtggaatactccttctggtttttgcacttgtcgcatggacagcttataaaaccgttacgcttgttatcattggccccacccaaaaaataatgcacgccatcaataaactctttcgaccgccgatccgcgtacatccattgccgatccatctatatgaaatacatataaatcgtaattatacaaaatccaagatttacaaggtaattacataataatacaataattgaattaattattcatacaattaatcattattattaaattcattgtacatatttttcatgttttaattacattataaacaaatatttaatatgtttttcttattttaatattaaattagcttagttttataatttcatacaaaattatatgtaattattcaaacaagtatttataatcttctttattccctacacacactttctctctcatcatcttccatcacattttctagagggaaaaatatgtaaaaaaaatagctccaaatgtagatggtaagcaaaacaaagagtaggatgaagttgctaaccatttgaagacctcaaatttatatattaccaccaaaaaaatttgcttaaaattttgacagcacctccctccctcaaagcttaattttgaagcaatggctcgggcgggaggaggaagaaggggtatataaagctatgcaactttagtcccggttggtgttaccaaccaggcataaagatctcaaatcactttagtcccggtttgtattaccaaccaggactaaagatatgatctttagtcccggttgactaaagatcccaagccccccgacagaggtctgacatgccctgtcaggaggcgaaccgggactaaagatgatctttagttccggttggtaccgggactaaaaatcccttcgtcccgttgaggtaataaaccgggactaataagccactttagtcccggttcgttttggaaccgggactattgtggaaattggccgaccctccaaagacctcttctccagtagtgtatgctaatagtgtccacttgtatgatcagggtataagtagggattaatatatttataagagtagagtgatatagcaaagaactcatatctctcaaaaatcaatcctacgctatgcagaagaagaaatagaaaaaaaaaatcaattcctatactagaagtatacactcaatgctagtttacatctgctagtatacaactatgtagccaatacccctaatagtgccctcctggtgtttcgagagaccacctcaggttgccgcgttccttatgacaacctgtcatggccgtccaaccggggctaaatatagaagagtaccttccccatgaaagtttcttaggaatatatactatctcggaggaatacccatactgagctatcaccatcagtggcccacctcgactggcctgtagcatatatgcctagatatgatgcttaataatctagacaccatgtcttcattattaaatactactctatatcccccgagatgacatagagcaaccgagcattcggacactaaaaccacaccattgcacatctgtggtaggctaactacacaactgtaccgatacagatataaagtaaagccaatactcagataaactaaagtactgagagtatataaataataaaatttcattgcttccgaaagccttacaaaagtataaataaaagctactacagccatacccaaattcctctgaagactccgagagctattctattatactccacttagcactagaatactaaactaaagtatagagagaaatgctgagcttgcttgagtgtgtgttgagatgaattgagctcctccttatatagccttccaataacggttatggtagttggaattgtcggaaatgcctcgcaactgtcattgagaatgcatcacaagcgtacgcgtggaggaccgagctgaggcggcgctgccagggttcggctgaacccctgcccagcagacctccaaactttccagggtcactgacaggtgggtctctatgacagttgtgacagttatggtggttttcgggacggttacagctaacatgtgggcccatcttatccttaagcttgcttaggagtgaaatgtgcacgagaaacttgtatgtacgtataggatacgttgccatgtttctaatatatccatgatgttggagatgggatgatgtttcagaaaagcgtaaaatgccttcactgacagaaggggttgatgactaattggtcctgctacaggtttctcttctcttttgagtgttgtctccttgcacatactccctctattccataaaaaaacgaatctaggattgtatatgacatattctagtataacgaatctggacagaggtatgcccagattcatagctcctgaggaggtagctgagtctagcctgggaggccagagaaggaagaagatgcctaggcctgatatggaggaaaaatgaatttggatcttttgtgtgtttatgcagaccttaatcagatttttatcgatcatgtaatggtctgtatttgggcaagaacttttgtgtcatatcagttaaatgttccacttatgtacattttgaatatttgggatgctcctttattacagactggttgtgctagttctgtttattccagtctcttctatcaagtttatcatgaataactttaaatcttggaatgtgctctgttggaatattcgaggaatgaatgctgaatccaagttgctctctctgaggcagaaaattgaagatagtggttgccaggtttgttgcattcaagaaactaaaaaagaccactttgatttatctgatatcaggaaatttgcccctaagaatttagatagtttttattttgccccctccagtggagcttcaggacgtattctgattatttggtcctctcgagtttttgtggggacagtgatagaggttaacctcttttcagttaccattgattttacctcaaggcactctgcccagaaatggacccttacatgtgtatatggcccttgtagttcccctaaaagagcaaattttgtttcttggttcagaagtgtgcaaattgctgaccaccaaaattggattttcttgggggattttaatttctatagatatgtgcaagacagaaataaagatggtgcagatatgaatgacattttcatctttaatgatatcattagcatccttggccttctggaaatccctcttaaaggcagaaaattcacctggagtaatatgcagcagaatcctcttcttgagagattagattgggttttcacttcagtctcttggatagtggattatccaaacacattagtgatgcctttaaccagaaacatccctgatcatgttccatgtgtagtgaaaattgacacaaaaatccccaaatcccctattttcagatttgaaaattattgggcagagatggatgtgttttttatattgttcaggcagtttggtctttagatcctggtttcgatgatcttgccaagtgcatttctttcaaattgaaagtgcttaggaaaaagctccttgcttggagtaagaatctgtcaaagttgatgggattgctaaaaaactgcaacaaagtggtggactttctggatttagtcgaagaaaacagaatgctatcagtctatgagtggaatttcagagaaacagttaaggtacagattttgaaattattggaattgaggaacatctattggaaaaaaaggtgcaccaatagatggatgatgttgggggaggaaaatacaaaattctttcagtcaatagccactgaaaggttcagaatcaacactatctcacaaatgcttgatcatgatggacagattatacatcttcatgagcagaaggcttctttgtttcatcacagctttaagaacaggatgggtgtttctaattccccacagatggcttttgacttggactctctttttggcagacatatagatttgaacagcttggttgacatgttttcaactcaggaaattgatagtctcatctccattattccagctgacaaagcaccagggccggatggtttcaatggttttttcatgaaaaaatgttagcatatcatagctcaggactattatagactggcagctcattttcatgctggaaatgttgatttggaaatccttaatagctctttcataaccctggttccaaagaaaccctccccagagactgttaatgatttcagacccatttctcttatgggtataagtctaaaaatcttaactaaattgctagccgacagacttcaaggggtaatttttaaactagtgtgtgataaccaatatggtttcatcaaaggaaaaaccatacaggattgtcttgtctggtcttttgaatatattcaccaatgttagcagtcaaaatgagaaatcgtcctcttgaagttagactttgaaaaagcctttgataccattgagcattctgcaattctttcagttatgcagcatatgggttttcctccaaaatggattgagtgggtacagatggttttctctactgcttcttctgctgtgttattgaatggggtgccagggaattctttcaaatgcagaagaggagtcagacaaggggatcctctctcacctctgctttttgtgttgggggcagagctgttgcaaagaataatcaacaaagcttttcatcaaggccttctgtcaaaaccaattgatgaaagcagtggggatggtttcccaatcattcagtatgctgatgacaccttgatattgttaaaagcatctcagaaagaagtcttctatttcaaggctattttgaatatgtttgctcaatccacaggcctcaaggtaaactataataaatcaactctgtacccacttaatatgcctcaggacaaagttgtcttactatctagcattttgggatgtaagatcggttctcttccattcacttatttggggttacctttgggaaccaccaggcctagagtggtagactttgctccgttggtagacagggttgaaaggaggctgacatcaagctccatttgtttacctcaaggaggaagattaactttgatcaactcagtcttgtcttctatcccaacctactacatgtcctcagtgcagctaccagttacagtcatcaaggccattgacacagctcgtaagaattgtttgtggagagggaataaccattcttctacaaggaaatctctagctttctgggatagggtttgcatgcctaaggagaaaggaggcttaggagtgatcaatctgagagttcaaaacacagcccttcttctaaagcatatggtcaagttctataatggtgctgatttaccatgggtgaaattaatctcacaatcatattatgattctaaagttccacacttgatgatgaataagggttcattttggtggagggacatcacatctcttgcagacatatttagggggatagcaaaatgcgaaatcaggacaggaagaacttcccttttctggaatgatctatggaatgatgattttaagtgcactagctaccccaatctctttgctgtgactatgtataagtctgactcagtaaaggccatgtgttcaagacccctagaagactcatttgcccttcccctatcagatgaggcttattcggaattcttgcatcttcaggagggacagtttgactttacaatcagggatgggggatgcttggaattttatctggggctcagataagtacacagctaagaaattctataagctaaattattctgcattgcaaccccctagacccatgatttggctatggaaaacaaaatgtgtcatgaagatcaaagtctttgcctggctaatgttctgtgataggctcaatacaagagatatgctggatagaagacattgtgccaaagaagatgatgatctcacgtgtgttttgtgcaatgcgaactacagagagacaaggcttcacctcttcttcttatgtcctttcagcatcaggtgttggcaatacctaggaattgagtggaataataatttggagtttttccaaatgatctccctagcaagaatcaaacttgctcagaagggtttcttggaaattttctttttggcagcttggcacatctagaagcaaaggaatggcttcatatttcagaacattcagccctccttccaggcatggagatctctttttgtcaaagaagttcttctgcatatgtgcagaatgaatgatcctttaaagcaaactgtttttaattgggtacaagccttatagtctttctgtgtgacccacttgtaatctctgtaaccttgtaaatattttctttatttataaaattacactgatgggcaaagccctggcagttttcttgataaaaaaaagatgtgtcacatctagtactatgttgattttttatgggacggtggcaatatataagtgatgttcacactcacacatatatatgttttcaatatttgtgcatgttttaactatttcaaggtggttacacacaaattttcatacctataagaaacccacagtaattaaagccaatcagttgccatcccatatctaactctctataattatggtctcatttgggcattttttagaaaatatatatgcagactattggcatggagcagaaacaatcgacaaacttgatctatattaggtatagagacaaattcgatgataactcgttgaaagagagaaaacacattcatagaccatggccatgtacaaccgacaacatattactagcaaagatttggtaaaaggttcaataactataggggagctctatggttaaaactacagagtacattgaattatgtcgtctatcttgcaactatggtcattaagtcaagggaggaaattaatgtactaaatggtcatgcaataaatatatttctgcagctcaaaagtaccaaagtgtgtacacatgtaaatatatcaaatatatatcatatgctcaactgctcgtgagtctgtgagagagcaatgaatcgagctaggcaacaagatatcaacagctccagatgaacaaaacagacaacgccatacagaaagttgtacacacattttcagttttgtgtcaaatttgtcgccgagtgcgggcaaaagaacttataaagattattctttctgtattcgtaatttgacattgcttgtgatggctcttcgaaagcacattttcctcctacttttggtagtactccctccatacttacaaaagaagttgttttggacagcgacacggtctccaaaacactactttgacttcttatttctataaaaatatttattaaaaagtgatatatgtatacttttatgaaagtatttttcaagacaaatctattcatgtaatattcagaaaacctagacaacggtatcctgttggaacgggatatccttctatgagacagtacctgatacctgatacctgttatggtactgactgcatgttacccgatacctatgatacttgttacccgatatatgtgatacctaggacctaatacctgtacctgtgatactcgtgcaagagaatagttactatgtctatcccgttgcaacgggatccagttttgtagcagccctctataatgttttacattttcaaactcaataacttaagagttattcatgatttatatttccaatatttgacttaaacattgtcctaaacgactttctttacgagtacggagggagaacatggtagttagatgaagcatatatatatcttgctcagagatcgatgaattaggtcatgtccaacgggcgtacccctagcctcccaagtctgatatgggctaaaaaggcggtgaggaccatgcgtgcgcctggatcaatctacagactacaggcaccgtgcatccccgcgcgagacgccactctgagttgcgttgcgttgcgttgagcaggatagggcgcctgtgcagctctcacttggtgcagctttaaattagaccgggcccatttaaggatattgtatccattagggaaataaggtctttttgtatggcctaggcccacatagcaaacgggggtatggcctgcgttggccatagccttacacccatggtctttacatttgggatatatggaacatataaaaataaaaataaaagcagtgtggaacaaagtccaaatataaaataaactaagcaagcaagaaagaaaacacaaaatacaagctaagggtttgcaagagagagaaggttaggaacttctcttctgcgcacgtaaaacaaaatggctctttaacgcataattaattaagtattacatatatatagaaaaacttgaaatacaaatttgcgtgtttttaaaaaacaactttcttataggtttgtttttcttttaaaacgttgtttagtggttcagaacgcagtgtggattccctcaaaaaaaatccctaaaaaaaaaagaacgcagcgtggaaaacgagtaggcagaagtgaggaaacatgtactccctccgtactcgtaaagaaagtcgttttgcacagcgacatggtcttcaaaacacaactttgatttcttgtttctataaaaatatttattaaaaagtgatatatgtatacttttataaaattatttttcaagacaaatctattcatataatttttacatttttaaactcaacaacttgagagttattcatgatttatattcctaaaatttgacttaaccattgtcctaaacgacttcctttatgagtatggagggagtagtatacaacgcaccctagattataccctattgctatttcgtcatccaaagtgaaaaagtcatcagcacgcgttcgacttcaaacttttacgcaaccctcctgctacacgaagtagtccaagagggtcccgtaattgtataaaagtggagacacaaagtttaggggtgagactctctttcactattcaatcctccaatcaactgtacaatgagtagccccctcctctctttatatagtgcaatccaatatatagaaagttcggtgatgggcccaataagtgtatttgggccaggccttcatgggccaagcccaaagtttcttaacactcccccttgggcactcaccgcgtgatgtccatgcctcattaaaactccataaaaacccagtgggaaaaaattggagaaagagtacatagcatacgcatgtatgtcgcacagattgcctcattaaaaaccttgataagaaactgcaggaaaacttatcaaagggaacaagagtacaatccatccaaattcttgtatcgattttcttaatcggttttgggtacttgattcttcagttcaagcttttgttgatagactggcagaattctccccctgaattctgtatctctttaagtgtgaaccatcaaaactcgttgcacatatcttttcaaaagatagttcgagtgatgcttcaatggttaaatcttacatgatttttccataacttatagagtttgtatagtctattagtgctggtgcgacacacatatcatttatcttcttgataatgattttggggtttggacaaagctcgaaccatgttacttgctagaaatggtgaactatatccaaggaacctatgtattttcacattctgatatactatggttcacttcttcatgtgttgtaggttttcgggcctaagcaacataggtttctacctattttatctcaaactcgttcggagggagtgagctttctttctttatgcgatgatatgcggatcatcaacttggtttgggacttgatgcttgtatgcgagtgccctaatccaaaatttctttaaccattcattgtcaactatagaccatctttgcgggttgatcttttagttgattttcaacttcaggttgactgccaatgatttgctgtatgaagagaacattgcccatagcaggtctcataccaattcctattggttgtatgtgacacttatgcgagtatccatggatctattctttggcatgggcatgatcctttcattttaccggcgttggtgtgcactccaactgctggttttcttcctcaatagaaagatgtggtatgcctattctgaggttccataccatttgccagctctgaactggctcccactcaaattctggggttacttttagtgactatgagcttgagagttcctttttgtcccgttttcaccagacgtctccggttactttagggatttaaggagccgaagttcttgtcccattatttttctcgaggcctctggacaagatgaggtatacctttgcattcttcggtatttcatcctcctccggtgcattatattcgggtaatgcaactgagtcatgctctccgaatcacaaaagtgatagacagttatccaattcttatgtgtgcttttcatactttcattcacacgtgcttgattaaatgtgcatccatcctttcatttgaccattttccctgacatttatcattttaagggttatttctccccctaaatgactggaaataatccttcttattgtcaaggagtttaggctacgttcgtacctctgttaaaaatttccaatttttctgagggagcccttacggtcgtggagtatgtacatgtgtcaagtcaacaccagtattcttttaagtggacaacacatttcgaatagtccagatattgataattcgctgtctttggatctacgagtccattccagtggcgggaatttcaataacgatgaagtggacatttttagtcctattcttgtggacatccggtacttagtgctttttttaatatgctgatgccaacatgcatgatcttgcaggattggtttggtaagagcgtagtgtttattagacaaattgcagctttttcataagcgcaatatgtatcggatgatccattaaaaagggctaaatatgcatgtgaattcatgtggtatacgagaattcattacgatatacctttcaaggtatgtcgaaattcatgtggtggtcgatgtttggcacgcatccgatgttcgatggtatgcgcgaccagagtgaccacggggtatgtagccagtgcaactatggcgcatggtaggagttgcatgacgcgtgttgacgcggcataattcgtccagtccgccagcacaacggggttgctagttggtgcatagtacggcatgtagagcgcggcgctagtagcggccttagtgcgcgtcataatgctgtatgatgcacgccaatgtctggcgcaagtctggcgcgaggcgctcagtgcacgtgacaaatgtctcatcgctgcaatactacaggcgatgtggcattgtttgtgcaatattcatttgtaagatactaaattctaagaactgactatgaaatagtctactttagcctacatttcttagtgaggacgttgacctcgcatgcttaggtgatgagtatgcttctctcattttttagttcctaacagggaacttttgtgcgagagtttgcaattctcaagagatttgaggtgtaatcgcttttctacgggaaaaacaatatcctttacaatcattgcgtgcggttgtgaaggtagttcacgtctttgcatagaccgaacttgtctcatgtctctcaagattacactttgtggtgcttttgttccacaatgttcctcttcatcttaggctatacatattgtctatgagaataaagtaaaacatcactatgtcaggacaaggagtaaactttatcatagagcaaaatgcaacaaaatattggaaataaagtctagccatgcaaggcgaatcacgaaataaatgttatgctctcatagagcttacaaaaccattattcaaattgttcctaatgcaacttagttcatgaaataaagtaggggcatcaaatactcaaatggaatcaaccagagtatcgagctctgcaaagatatgcttctgtgtgacatccttttcatttgttgtgcctgctgcagctgcaggggcgtcaagtggagtagtggtgaagggagtggccgtagtgtgagcctcaaccatgtgtgcttctacggacgccttggccttcctgctggcctggtaagcgtcgacgacatgctggggctcctcgcagatacggctctagtggccccaaatgccacacttgtaacatgtctggtactgttggccatatggcttgtcattgcgaggtggcttggcttccttcttgcccttgcc

SEQ ID NO: 4771 - DNA, 4004 bp, Oryza sativa
  unsure (1)..(4004): unsure at all n locations
accctcctgctacacgaagtaatccaagagggtcccgtaattatataaaagtagagactcaaagtttaggggtgagactctctttcactattcaatcatccgatcaactgtataatgagtagccccctcctctctttatatagtgcaatctaatatatggaaagtttggtgataggcccaataaatatatttaggccaggccttcatgggccaagcccaaagtttcttactcagaactaccagaaccctacgggcgcatagcgcgcacaactttctatattccagcacactggcggattaattcaccatccagcgacccggacgactgctcgggtattcagcggataatcaattgggttctataaatttagaaggattgaaatgaattttttatagtaaatagtagctacccgtcgtttctgattttttttagtcaaacatttttggatttgatgaagtttatataaaatttagcaacatccataccatcaaattaatttaattaaatataacattgaatatattgtggtaatatatatcttttgtcacaactacagaaatcataataagtaccagttgaaaatcccacgtagatgccgaatttcctagcgggcacatcacaggcggtactaatgaggaggacacaaatatgctggtttaactgacaccattgagatatacggtttgaaaaaaaaaagctggctcgactcgagttgagctgatgattgaaagccaccaaaaataaatcgaaaaattcaacaacaaaaaggagacaagttcacgatagagaatcaacgagttcatagatcaaaatcaaaatattcatcgataacttcacatcattgaatcaaacatcatcgacaagttcacatcaaataattcaaaaaccaaattaaataatgcaccaattacactggagaactctgcccgccgccatcgcgcattgaagaggaaggggaggctgccacaaaggagagaagggaggctgccgcccctgcataggggagaaggggatgtcgtgggcaggtgagggaaacaccgccgaggggagatgaggtggatgtcatcccgttgagccgcgctgctgaggggaggcgttggtggacgttgcctcctccgctcgctctgttgcctttccatcgagcccccaccgaggggaggcactctgaggaggcaaggccatggagaggtgagggaggtgccgccgaggggaggcgagatggatgccacctcctcccacttgctcagccatcgtcccttcaaaccgtgccaatagatgtggggatgtgggggagagattgagaaggagagagccggctaggtggagaggaggctgccttgcctgcttgccctgctagggagacggagctagccgccgcttgcaaaccggacttggacgggagagaggagatgggagagggagatggagacttgagagggagacaagagacaggaggataagaagagagcgaagagaccgagaagataaggacgagagtgaccctattcagttcggctccttcctagagtgttggttgtttaaaaaaccgatgctttttatcttgtataaggtgccggttgttattaaaatccatctatgtctgacaacacttattggtgctgcgtaatattaaaaaccgatacctatatcgtcacataggtgtctgttctcccaaacggtgctatatgagcacacgttcggacgagaaaaacattataggtggtggttttattttttcataagtttagttagacttaaaagagtaaaaaaaaatcaaaacaaattaaaatatgaaacaaagggagtttgctgggactttataatttgggtaaagttcaccagctgtctctcaactttacgtcgagtttgtataacatccctaatccccaatactagaaatcttcaccccttaactataaaaaaccgtgcaatttgggttccatgggatctctggtttcgctgcgtggcatcatagtccacaaaataaaaataaaaaaaatcatggagcccacatgtaagtgactaagaaaaaaagtgtggcccctcatttcttctttctctctttttttttctctcctctcttctgttttcttttttttttctcttctcttcagcaatcctaggagggtggcggcggcagaaaggggagagacgatcggcaagcccggccaagctccaccgctgcctctagcgcctcatgacaagaggagggagcgggggagaggggaggcggctggcgggagattggggaggggagaggcacaatcacggggatggcgaggcaatgggggacggggggcgcggtggggtgacggggatggcaaggggacaagggatgggcacatgccgggcgggcgtcacgacggtgacccagtgcgatggggacggcaaggcgagcggcttggtgatggggaacagggcgcggggcaagccggccgggcatcgcaaaccggcggtctccgtgggtgacgatatgctgctcgaggtggagcgacggtgtgacctggggtcacccatgtcactgactgcttccaccaccatttcatggccaccgtcgctgctgtcccctgacgtaccctatgagatcttgcgcggccgcatagcccatggctcgctgccgtcttcatagcctgcaccggtcgaacgcctgctgttacggctcgatgggggagacgacgacgctgccaccaaggatgcaccgagcgagcgctgacatgtgaacgtacgcgaaaccggggataaattgagtccatactgcttgggacctttttttgcacggtttgagataggtgaggggtagagatttttggtattactgattgggacctcagggacgacaggtgaacttattaattctttaaaatttctcgggatcgaccactgttccatcattactttgttgatcagatcatatgggtgttacgttttgttggaccacatttgttggcccgactatatttcatggcccaatctagcttcccgggcaaaatttatctgggctttgctggctctgttgatgggctatatatcttggcctatatattgatgaggaataagttcatctgaggtcccttaacttgtcaaccaatccgattttcgtccttcaaccagaaaaccggatacaacgagtccctcgactgtcaaaaccagtgcagatgaggtctctcggcggttttgatggcggttttggctgacgtggcgcctacgtggctaatttgacttagtcttcatctgatgtggcattgacgtggcgtttacgtggcaatttgatcctgaaaataataaaactcgtgggacccacatgtcagtctctcacacagaataataaaaaaatggtgggacccacgtgggccccacctgtcattgtcaatcctcttcttccttctctctccctatctcccctcttcatctctcccctctgctccctcctctcgtcggcggagtcgcggagataaaggacggcgtggggaggcgcggcctcctctactcccgcccccttgggcatacgccggcggctgccgcccctctcctcgtcgcgcgccgatgcgtcttagcagctcttgcctctctcctcgcgatctgttcgccggcatgctcattgcatcacacccacgagcgcggcctgcgacgggcgctgccggcatgctagctgcgaagacgccgtccgtggcggtggcagcggttcagagagatggtggatggagctgtggcaggactggaacgcctacaagaccaccaccaccactcgccactcgttgttcgctcgcccaccatggccatcgcgacggcgctccgcaagctctcgcccacgtaggcgccacgttagccaaaaccgccatcaaaaccgccgagggaccttatctgcactggttttgaaagttgagggactcgttgtatctggtttttcggtttttcggttgaaggacgaaaatcggatnnnnnnnnnnnnnnnnnnnnnnnnnnnnnnnnnnnnnnnnnnnnnnnnnnnnnnnnnnnnnnnnnn

SEQ ID NO: 4772 - DNA, 18020 bp, Oryza sativa
  unsure (1)..(18020): unsure at all n locations
aaacttattcctattgatgatcgtcactgaaagatgtacgtacacgagaccgagcgcttgctcgggtgacaaagcgtcgctggtgggcacgctgggttcgacccttgtgctcgcccgggggatttttcccctctttccccggactgacttcggttggtcccggctagataataaggtatacatgtgcacgttttccgtgcattgaggtctagtgcctccaatcttattcctaacgtgtgttaggaacgcgtacgcatgtgtgtgcgtgtgtcgtggtgtgagtgcggtgtgtgtaagtgtgcgtacgcataataaattatgggattaattatgttggcttattaaacagatgcaaatgcatgcgcgagttttctattttctatagaaactcttcattaattgtagtacacgtacgtactccctccgtcataaaagagcgaatgagtttagacagaggtatgccacatttagtattagatgagttttttttaataggtggagggagtatataaaggcactgctacgttttaataaaataacatcattgacttttaattaacacaatggttgactattcatcatattcaaataatttatataaatattatttattttattgtgatgtattttatcattacataaactttaaatatgatttatactatagcacatttatactaatattttaataagacaaatgatcaaactcttttttttaagttaaggatgtcatttatcaaaaaattgaagtataatgtcatcgcgtagtgacgcaactttcgtcttcttgtggcaggaaaaagggttaattagatccatgtcactgtaactttgctaaattaaaaaaataccattactatttatcatatctgctacgtgtcattaaaaatttctaaaatttaaaccataccactccagtcaccttttccatcctcttgcctcacgccgtctctattccgtcctcatcccctaatctccatgactatgcgctgctcagccgcctccgcagccccaccaggcgcgacttcaccgctaccgccggcaacgcgcggctccgacgcctccacggccacgcgagcctagtccgcgagcctagtgccggacccacgcgtccgcgcctgccgccctccccctcgcttccgcgcgcgcatctgacgactcctccgcgaaccccgccaggccgggccacgaccgcgccgccctgtcctccgcgactgcgccccgccaagcacgacgcagccaagccaagctggcattggccatgctgtgagcattggccatgccgtgcaggagcactgggccgagccaatccggccacgccaagccgcgggagcgcctcgccaactccggggcgtgggcagcagccaaacaaaaacaagaagaaaaattaaaaagaagcaaacaacatcgctgcgacggcaaacaaggaagagccataagaagaagaagaagaagaagaagaagaaaggaaagctgcgacggccatgcccacggaagccgcaacgacgacgccgagcttgcccaccgtgcaacgcccgaacctccgagcagctagccctttggtccgcgccagccgcatgctcggccacgccgtcgacagagcttccatcttgctccgttcctccacagagcttccctcgccgcgacgacgcacgcccgttgctccgcgatggccgcatgcccggccatgttctcagcagcacctccaccgcaccctcgtcctccgcagcgctgccctcgccgggacggctgcatgcccgttgctctgcacgcgtcgaggggtggaggccggccgcgcgcggaagcggcggagccggctgagcagcgcatagccgtcgagatggacgattagggggatgaggacgggaacaacacggcgtgaggcaggagaacggaaatggtagccggagtggcatggttttaattttataaatttttagtggtatgaagcaaatatgacgaatagtggtggtatttttttaatttagtaaaattgcagtggcatggatccaattaaccccaggaaaaaaaacctgagaaaaaaaaagagtggttattgtacttaatttctgctcgagcagagcttacgcttctgcggcatgttttcagtcacataagtcgatgaagaaaaatattaatctccataaaattcaatgttggttacttaactagctagtatatatgtaacaaaagaaaatcactcttgtcaatcaactttcattagtacgaaaatctcaacaccacttattagtagctagctagggtcgagtcattacacttggtaactagctatatgtaattccaattgcccttctgaatagggctaacaccgatctagcactgggaaatactacaatcacaaacattaacacagaagcactactcatgcaccctagacacattttccattttgggaaagtgtcatctaataaccaccatatatatgtcctacaacattttatgacatatatatatatgtttctttttctctctttaatatataataactaattaatttgccttcagttgggaggctaattaacaattaatgttggatagatggctgccggacatggcagttggatgatggatgtagatcatgtcatgacctgtacctccggccgccgcagccgccctccctctggcagttgaagtaggcggcggcgacgggggagccgaggctgtagcaggcggcgaagtccctggtgttgaagttggagcgccaccccggcgcgtagatggactgccgcactgtctgccggaacacgatgaacaccaaccggtggatccccgctgtcggccgcgggctctcgtacgccaccacctccgtccctaaatatatatgcacatccattaatttatattacctcccttttttaatatacccgttggctattttacaaacgtttgatcattcgtcatattcaaattttaatatacctcagatgctagtatctcgatcgaggtacctgaattcttaagatggccgtaatatttctctaagtttaagccttttgagctagttcgattttttatggttggatactattagtttactcacctttactcgtatcgcctccttctggtacgtcagttaccaacctatacaatcaacaacaattaattaactctcagcctaagaatatagtaataacttctataaataaagttagggtaaccacaatgtgatataaaactattcctaggtagtaagcaataaaataactttattgcccaccaacgagcattgtagaaactgacgaggtaggtgcacgtacaggtaatggtgactaggtaggtgcacctacaggtgcctagagattggtctttttttcacttatgggctctaccttatattcatctgttacattcacacattatgatatatgtacagctacggcccactaatttctggccgcctattttattaccaactttgacaattgctgttataaaaagaacttatacagtagaaaaaaataaattattttagaaatgtgccaccagtagtcaagtgagcggtttgagtgaaatgagtgcgcgactatggatgacgatatattcctaatatttttttgtgcttggcatgagaagaaaacataggtgactcgcagtatatatagatgaaatggagagaagatagctagctctatctagctactagaggatagcatacttaccaatgaaggtattcccttttggaagggttgctggggctaggtgcatcagggtccaccattacctaagtaacaaatcatggtgtaaaaattgttaataaatccatgctatgactttcttttcataattttaggagcgactttttagacttgtttttgatcaattaaatgacacgtaagaaaggaccatatatatatgcattgtagttgacagttgactagcaaaactttgtctccagatgaaggtttgaagatgtgtaccatctatttttagttaaaacaaagttgaaaactaacatcccctgcattaagaaaacattatagtagcatatatgtatatactccctccatccaaaagtttaagacattttccttttatcagcaaaactaagggagaaattaacttatctccatataattaaaaaaaaattatatgcatgactgtttggtttcgatcaacaatttaattattcacacatatggacggtacaaatttgtcatttggcatcttttgcaaaacaagagaaataaaatatgctctagacttttggacaaattaaggaagagagtgcatatatatatatgttcaaatttgacatgcccgaaaatgcagctagctgtatgtgtttgtgtaaacgactcacgagcgtgtagagcgccctcccatcgcggcctccggtgatctggacggccggctcgccggcgacctgcgacggcctgagctccgacccgctcgtcatctcgcggtggttgtagaacagcctcagcagcgccgacgcgccgaagtggtccaccacgtcgccgacgatgctccccaccaccagcgggtccctcgacatgctcatcgccgccgccgccgctagctctacactcaatgccaccggcgatcgacgaggaagctagagctagatatactcaagttgtagtagtgcaatgtgatatgatgttaattggtggggtttgcagtgagtgtgttgtgttggtggagagggtgatatgtactcctatttatacccaggccacactggctttcttggctcatcctatgttgattttccatggaataatggaatatttctacatagatatagagatagatatagttagccagctagctatctatctatctatcttatatggttcaaagatgcgaatgcatccaatcataatttcaaagatcctggtatgaaccagaaataaaccaagcgagagatcatcttgtgatatcatgggacttgataataatcacatttgtttaatttatttaaagagtcgatttatgatcggatcggatggacaatgtgttgccaacaaggagtcggtttccgatccaacggtttgggtttcgacgcggcgttggaatattaggatggatgatatatatgcgattcctgatgatccttgatgagttcttggggaatctactttttgtaaagatcatctcaatcctttaggcttggatagcggctattataataagctacttcaataagttgtctgtttctttcagcttactcccaataatctggattataataattccaaactgaaagaaatagggcctaacgcatgtgtgtgtaaccatgcactcataaccaggggtttgcaatttcgaaacaggagtttttgctggtgggggccgaaagaatcgaaatcaccgaaatttcagtatttttttggccgatatttttggaaatttgatgactcttgaatgaatttgaataaacttcgaccaaattcaaaaaaaaaaccaaaaatttcggacgagatatgtgcttgccggtgaggagcgaaattaccgaaattttgaaaattttcccgatttcattccaaaattgcaatcactgctcgtaactccacgtactactatatataccaaatgaaattccatcatatagaaaaacagttatttttgcaaggaaatagtgaaatttctatacatataatactttggttctgatcaaaatggcaagtttgcctgttttatattaagaactgaaaaactgacaattttaaccaacatatttaattagcatatagaaaaatttaatgaaacatcggtatatatatggttattttcatgcatagatgcatgcacccaattaacaaaaccgaggtgcagtgcacctgaagaaaaaggagaagagttaaaagtggtaagatctgatgtgcattaaggagaaaggattgtgtatagctagagcgcacatgcatagcagatgtctaacctggtgtgtgatggaaaattaacaacttcaacaaaagttaagatctgttgccatgatcgatcactaagacatatacatacatatatgccaagaggccctgcacatatgcagcagatagccaagactcttacaccatcctatactgtaaagtgttgtgctttccggccgcctctagaagatatgagaatttgtgctcgtgacaaatataatgttgagctaggtagccaaagcaaaccaggaataatgggctccaatgctgtgctttctcttcttttcttcaaaaggaaaactatgttatgcatcatatcttttgattccttggccctagctacttttattcttgatcagttgtaatatgtatgatctccactattttggtacaatttttttaatgacacaatgcaaaggtgtgcttagcgcgtgtcaaactcatatgtcctatgatgtgacagaaacattatcaatgttctttatcactacctccatttataaagacttcatttatggctatgaagctaaaaatgaagtatttttggatgacataatattagttacttgggaaattaaaagaatttttacaagataaattaaaatcttggaacttccatgcatggtaacaatacttcatttttagccctgttaccgagttatttaggcacacggtagacttccgttccctggtagtgcctgctgaaattgtaagtactgcagttttcttgaaaaaatatttgtagttattccaatgatctatattatatattggcgtagcacaaaaataatatattattgaacctaataaagttgtgcttgagcgaaaagaaattctctaaactttaatttacttatggcttgcgacaagatatattagttatttttatatgtagttagagtattgtcatgattattccgtaattaaataacacctagattatttgaatttcaactacatactgtgcttaacgtacgcaagttcttgtttattattttgagatttaatttccgctgcatattatatccgaagcaattttgaatttcaagctttgattttaggatcaattttaggggtgttatttttgtcactttgcccagctctcttttcgtcatgctaaaaacacaagtaaaaatctaccaacaatattgctagcattaaattaaactttaaaatttaaaacctttttagttcagagccacctctcgatgtggtggactggcaaggtgtacatgcttatcactactacctccatcccaaaaatatagtgacctagaattggatgtgacacaacctctatttaaatacattgtactgggatgtgtacgatgtgtctcatccagtcctagtttgcaatattttgggatgaagggagtagctagctagcagtcccattgtcttttaagctgttactaaaatttgaatttcaagacttaaattttgagttgattttggatttttaatcatagtttatttttcaccattcgcttttaaatttctaaggacacatatatatttttttaacattttttttgccgataagccattatagcttataatgagccatttccagttagttttagaaaaacagaagagctaggtttccagtcctattgtctactcacactgtgcaagctaggtagatgtagagtgtgaactttgcaggctgttgtagagttatcaaatctgttagtaatatgccttagagacaatcttagagataattgtatcacgtaccatgttttataaatttacaataaagtgttcctgataagttattattgatcaatgaatatgatttatacatgagattatctgtatatatatatgttacaatttctaaatgatccttatcaaatgtgaaacaaatatgattataagattcaactcatgtattaattgatgatcatgtttactagactatggtatggagatactaaatcgataatgtggacacgtgttggagaatatattgttggatagacccattgacacactgtcaggattattataatgtgatatcagttagtcttaattaattaggtgttggtgttgaatccttgcacctaatattatcatggttcctaattgtaatggcttacactgggactggtaaatgctattccataactgcttagttataaaggtagtcttccaatttgttattaagcatgtagtgggatgtaaataatcatgaagggatttttccatcccatataatgggagagatatcttctgagtatctcgatgtaatagattatgaaactgtatagccatttcgagatgcctgaagtgctggttaggatttgaataatctaatacaagatcgagtaattgagacgatggcacaaatctagctttgagcttgatcaataccataaggtaaaaggtgtcatacccatttacgcactaaaggttaagttgatatgatctttatgtttactcggtgggtcaattcgtttggctaagggttattgttgacatgtggactgaaaatggattttcaaattgcaaccgaaaatacatgaacctaaggggctgtgcacttaatgggttaaaacaagacaactggatatagaaataatagtgtcttaattcggatagaactcataatgggccttggggactgattaaaggtcctatatgttcaggagcgaggggccacataggtaagagacacacatgcatgtaaaccctagccaccactcttaatcacgggagtcaaaaccctagttgcgtgcaggtgctaccacatccacgcacgacgttcctccctagacgtgtggatacaagtagaggctttgctaattgatgttggaatgcgaggcggcaaacacgcaaggaggagacactcgcacaagaaggagatgatcgggttgctaagattgactacttcctcttcaccgacgcatgctacatatgattggtctgcaatgcctcttgttctgctgttcagctcatctagtagtaacaatccatgatatgttactcgcatggttcttggtttatatggtacaaaattttttttttacgttatcatagcatatactcgtaacctatatcatccttcttgtttgtatgatctggacattatctatatatgaagtacaaaaacacatgcatgagtacaagtacttgtggatactggtgtgtgagtgcgaatataagtgcctaccttatctatattaccaatataaaggtacaacctacaacatcataaagctcaacatgcaaagatgtcacatcattatccattagtaattattgcatcttaaacctcatgcaaaacatgttatatcttctatattttaaagctttcaaatacaagcatgttacaaagggtttcatggaaatattcttccttgccttgtggcacatctggaagcagagaaatgggctcatttttcataatattatgccttcatttcaatcctggagatcctttttatgaatgaagttcttctgtatatgtgcagaatgaaggagcctctaaagcaaatagtttttgattggttacaaactctgtattattttggtgatttccttaattataaccatgtacatattttttattatttaatgaaattacactactaggcaaagtcctggtagtattcacagtaaaaaaatattatcccatataatttacataatatttcaagatatatctcttcatcattttatatagttcatccccatttagttaatattttctatcttctatcattaaaccatatcattttaattgtttatagcctttagatgattaatctatagttcgaattatttttctcattttcttaacccatgaagccacattaccttacttttatttttcaattatcaatctatataatatttaaattatcataaaaccacatcaattcaatggtttatagacttttcaatgattgataaaaaatacaaattcacatctagctacgttacacactattttttattattatcatattaaactttcgtagcaacgcacagggtttcatgtagggattaagatgaacacggccggatagtatcttggctttactaataagccatgtcatcaagtcaataattgagcaaactaattaagtatcaacgcttatcttttggagaagactaaatattttctttagctacttatataagtatctattaatctagctcctttagaaactatatgtgcgtcgatcttcttttatgcggatcatgcattattgcaatagcaagattattttagtcagatatactgatacagaggaatgagaatatatagtgctatatatatttgccaaaaggagtgagaatatatatgagtgagaggtagatgccagcatgacgtatagtcgatttgtttttcaatctgtgtattcatgacgtctagaggatttgcatatatgtgccaatgcagttattatatacttaaagtgcattatttgcgtttgcatttagtaagaccaataattgaccaaaccaacacacgcagatatggcggcccattacgaacgtttctttttcatggaaagagagacgggcatttgcaaaacggatatgtcttcacttaggccactaaataactactacatctgtcccaaattataccaagttttaatcatatactccctccgtcccaaaatatttgacaccgttgacttttaaaacatgtttgaccattcatcttattaaaataattaagtaattattaattcttttcctatcatttgattcattgttaaatataatactaccacgcactcaagtttttgaataatattcataaaattttttaaatgagacgaacggtaaaatatatttaactaattcaacggcgtcaaatattcagggaaggatggagtaggacatactggtttgtttcaaaatacaacaattctaaagtcataaaacaaatgatattccatatacgtaacgagaagttattatattttgggtcagagtagtactaattgattaattaaacataacactaattaactacctattaacttaagaaaaaaaaagtctaaactactttcgaggagacctcttcatgggcatataaaaattagtctaaactaccttctcgcctctatgccattggccaaactggccacattgactgcctaataggctgatactccctctgtactataaaaattcaaattttgcggataaatttgagcatagtatacgtcgagaaacatccacgggatttgagtttttatgagacaggatgtacgtgtgttgtctgccttcgcctccatccaactggccctagtgatgatgtgatcattgagtataggcatataactacaataaggaatacaaaatgttcctaagatgcacaatatttatgttagatttatgagatatttaactatttgccacacttatacgagtgacaataaaggatttaccactgaacctatatgtaacagacacatgaggtccacatgttatagactgcgagtggtaaatccttaattgccacatcttaaaagtgataaatagttaaatgcccctagatttataggttgtgtattcgagataactatatatcataataattgagtcgtatttcttaggattatatagccatgtataggattgtatttctaatatattcctctaattgaagatcctttgtattaatacatgattaccccgacgccccctcccctatcccacattgggtgaaaggtgtttcccctaatgcattctacatgaacccagataataataatgtacttcttcatgatcaacagaaccctcatcttgacttaattatgcgcatattatgctacgtgaaaggcaccctcaatactggcctccacatcggcatcggtccattcaatccttgactgcgtactctaatacggattgggcttgttgccttgattcatggtgctatattttcgtatcatgtgtcttcctcagtgatgatctagtttattggtcttccaagcgcaagacgatggtctcccactctggtgctaagacggaatatcgtgcgatggctcatgctgctgctgatcagtgttctcgactgcgctagctcctatatgaacttcatgttccgttcacttttgcaccagttgtctattacaacaactttaatgttgtttgtataacagccaacctagtgcatcatcctcacatgaactacatcaggattgatctcctttgaataaaattgttcttgcaatgttctctcatttgaattacagagatcatcgaccacacgtcacaattagtatggtatcgtttgtggtgtaacgattcgatggtgtcctagacttgttttagttggaagcacttcatcaacatcgcaatcaaccaaagtaggattatttatcctctttatcagaagattgggccacaagtgacaggtaattagttgtcttatctcggtaaaaaaattagccgtcttatcccccgccatgtcggttgccaccaccgccacgctagctatcgtctctggttcagtccgtcgacttggcctccgccgtgctgaccaccaccttggccatgttggctgccacctcctccacattggccatcgacttagccaccaaccctgatatcagtcccctcgtatacatgcgctctgccaagctaatcgcctctgcctccatttcaactgccccagctctcgtatacactattgttgctgctatcgccctcatcctccttgaagccctgcttcggcggcatggcgttggagaggtcgtcgttagttccccatttttcagtaggtgtggtggtggtggtggcgtaggcgagaggaaatccccatccgtggacacctcttggtgccccaactcactgctagtgatgatgtactgatattttcatgggaatcaatggctatctgaaacagagaagagagaagtgcggcgagaacagccttaagatcccggatcgcataggaaaataagcctatttttgcatgcggctccttaagtggcccatccgcgaaaatattttttttcacgtgagtctattaaggagctgtatgtgaaaacagagatcgaattttataggagccaccagttaattacggctcttcctgacgaacttaatgcatactccctctgtttcaaaatgtttgacaccgttgactttttagcatatgcttgaccgttcgtcttattaaaaaaaattgtaaaatatgtaaaactatatgtgtatatgaaagtatatttaaccatgaatcaaatgatatgaaaagaataaataattacttaaattttttgaataagacgaatggtcaaacacatacttaaaatgtcaacggtgttaaatattttgaaacggagggagtactatttttcttttgggcggctagtgtaattaagaggagacagtgaaaaccgtcttttaactagtgttgatgaataaaaaagattaagagtggccttcaaaagtctttgatacatttagttatgctgttttatttaagggtgatcgatacgtagtgagaaaataaagtactagcggtgctgatttattcctttagtcccagattcacccttcgcataattagcaatatggatacataagatagcttttgaattgacacatttaccaagggtaattaaccacgtgcttcttatatagctggaggcaattcaccaagttaattacctacagctggagacaattaacgtcgtagtgagtagtgacccttgcataaattaataatcctaatatggatccagtgtggtgggttgcacttttttcttttgtatcaagtactaaatccgccctttcattttctctataaattgatgatacgtgcatgcaatataattaatggtgatataattgagtttgtgaatatgaaagttggccaagatattgatcgatttaagaaattgatgatttgggatttggtactttatgtatatgcccattacatatactgggttgacacaatttgagtcagagatcgtgataactggacacgtgatggcagtccgatatgtacgtcgtcgtacttgttatcaaagagagacaatgtgctaataacgaacaggctcaagagggtattggttgagttttgtttttttttttttggttaggagtacttaactgtgtatatgcccattacatatactgggttgacacaatttgagtctatgatataggaagaaattgtgtttgaaatatggcttttgttttatttgttcataccgctacttaaaaaatgattttatttctaacgccacacttcttaattcgttggtggatgaaagaaaaaacgctagtgaaaatacaagagattcctagttagtgaccacttgtgaaaaatacattttcgcaagcggtcgtcttaatatgtccatttgcaaaaataactctatttttatgtgtaatctcttaagtggcactaaataacaccgcccgtaaaaagatttggctctcaattcccacgcatacaccttcctcatccgcttcctcctcgtccttcctcatcctaccccatagccacacacttctctcctccaccttccacaccagtggtggcatccactagcggcgggcggagcttgggcgaggctcataggttgtgtcaaagatcgggcgaggcgcgcaaacggcggcgacttggtttggcggcggatggaccagtggcagagctcgagcgaggcacgcatggtgactcatgtgggcggcagtccggccactgtaactcgcgtggtgatgagaatactaggtcctgatcttccgataggtattgataactctcgatttggtggaaacttgacacacacgatctggcttccgatcaacacgatctgaaccctgcaatcgtagcatcacatctcctctggttatcacccgtgtactaccgggttgacctcgctgagaaggctaatccctgcatacgaatcgaagaacacaagcaagaataagatatattgcaacacaattgcatataaatgattaagcactccaatttggggttccataaaccgaactagcggcgaaactgcaatggcagaaataatctaagcaaaacccaactctaaactatgaaagctactgaacaaatatgatttgggacgtcctagggttgccctaggacacacaccgcattggacttagcccacgacacaattacatggcccaataccaaatcagattcggactagatgatgtatgtggcttgttttgtagattcccgacagctcggtgagatttttgatgtgagaccaacaccatctcaaagtatactccataaactttccaacaagtgcttatgggccccgagattccttatagatcagtggctaagtccgtttgaagttgatgctgtcaggaggtccgaatccgaatccaaaacgtgtagaacttttctcttgttttttgtggaccaaaaatgatgtggtgacgtaggagtggacttggagaaggtcttggtttggtctccaatcaactttttttatcatccatgcattccttacactcgttcgcttttccttcatccacacaactacctctgcaaatgagaagatataaaactcatggtgtaataatgtttgttcaaatatataataagtaaatttaacattgaacatatcactactaggaaaacaacttttcatggtgtttgggaaaattttttcctggcggctacgagatgaaaccgctagtgcaaaaaatagaggggatggggggtggggggtcatgggctgtgacaaaaacctatcttccctagcaaccgccttaagctggccgctagcgaagatatggtatttttactagcggccctcttaacttgacgctagtgaaaacaccaatcttcgttggccgagtgacgatgtcggcctctagcgaaaatgaacctattttcgctggtggtaggaacagtattttgcagtattaaaatcccacctacccggtgctgcccacagaaacactcgctattttctcctcctctctccctccgctcctctttctctcctccttctcctccgtctccccctccctccccacaggcggcggcggcggctcaggcggcggcgctcaggcgggcagagctgcgatgctgcacggtggcggcgacgacggcgatgcttgggcgggccggagagctgcgatgcgaggcgggcgcaaccacggtggacgtgcgatgggaggcgggcgtgcggcaacggcgacacgaggtgggcgcaaccacggcggaccagctatggcaacgacgatgaccttgggccgcgggtcctcagccaggaggggctcgggcgcgggcgcggcatatacggccgccgtagggccgtgtgcggcgaatccaaccgtgggaggggcgcgtgcggcggattgggccgtggtgacccagctctccctcccctccctctctcagatccggtggtgaccttgccttcccctccccttcaggcgacgtcagctccctccagcctcgaggcggcgacgatgatggtgacagggggcggatccggtggtgcgatggttggagaccggcgacgtcctccctcccctttcatccctcttctccctctccctgatctggccgtagggagacggtggtggcagcaacctccatggtcgccggcaatgatgtttgcatgttgaaaatgctatgtgacaaatcgatgatatttggatcccgtgaaaaattgatgtttgcatgttcatgtttggatgttgatgtgaatatggattagacttgaatctgatcttgatgtggatttgaaaattgaaaatgcagcgggtttctgaatgtttttgctggcggttagagggtatgtggcatgtggttaattttattttttttcctcaaaatcaattatcgctggcggccggcatagcacaactgctagcaaaatttgattatcgctagcggtcctcataaggctgcagccagcgaagataattttcgctggccggctgtcttaagccggctgccagcgaagatacgtctttgctggcggctgacttaagacggccgccaacgaagatatgtctttgctggcagtcgataaccgccagcgaatattttgatcttcactggcctttgctttgtggcggcgccaaatgccgccagcgaagacccaaaatagccaccccaaaagatggttttcgtagtagtgtatgcatttttggttgatgaatactatataagttagtcatggtcatagttgtgtcctcatcatgtgggtatcggatttggcggtggcaattcgcgtgtgtgatggatccagcgctgatgactcacatgggcagcaaggcgcaagtggtagatctggggacggcaaccaagatccatcgccgacttctcccttctccaccatgacggtgttgcatgaatgcactgacaaccgtgctccgacgagacgtgtatcgtctgcctctttcttctttatatttgttcttcctgttctcttgcggatccatgttgtttgatccgtggatttaggaccatggaaatagttaaggagctagtgttgctgggggagcaggttttctgtaattgtttttaaaaagtgaagtatggtttagtaataaagttatcataaaactataggcttaacatcaatttaatgacaatacttggacgtttagaaatcaaccataacattagtgttaagaatttaaactccaaaatatatagtttttttataattttattattaaatctatacttatgcgatacttagccttaaacctgtaattttgtgataaatttattgtttaatctgtggttttgtgatacatcgccttaaatttatagttgtgtgataatttggtcaaaatacatgtagttctgtgaaatgtgctgacgctcatggtgtatgtttatatatgaaaaatgatgcaaaattttgaaagattagataatgaattcccaccatttttttattattctgtgtgagagactgacatgtgggtcccacgagttttattattttcaggatcaaattgccacgtaaacgccacgtcaatgccacatcagatgaagactaagtcaaattagccacgtaggcgccacgtcagccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4773 - DNA, 1994 bp, Oryza sativa
cacccataatgaaataaaatgagttgattccaatatactactatattctactcctcttggagtagtgtcatacactactacgaaaaccatctttcgtgggggccattttgtgtttccgctggcggaaatcgcagctgccagaaagcaaaggccagtgaaaatgtcgattttcgctagcggttatttaccgccagccaaaatgcatcttcgctagcggccgagaaaggaacgcccaccagcagagagatgtcttcactggcggtagccttaggacggccgccagcgaagacatgtctttgctggcggcggacataacgcagccgccagcaaagaagtatctccacttgcgttagccttaggtcggccgccagtgaagataattctttgctggcggctcacagtattttaggccacgtggcacgctaggaaaaatgaagtaaggcttctgtggatggacacgtggcccgacagcgaagatatggactgtcctagttctaacacgtggcccgccagtgaagatgcaatttttttaaaaaaattaaaacattattatatatactatttttccttttcttcgtgtgcgtatttcagagtcaggcatggttgatataactaattgagctatcgacagagtatgttctctttcgcgtattttagagccacgcattgaggatatatgaagcagaataatatacatatatataaatattcggaagcacctatatatatgtacattgacaaattaaattcgaccgacgacataacatttacaagtattttgaatgaattacaaaaccctagctatattatatgcctggtccagttagacagggattcgttctccggcagggctaagactccttcgttgtcgaaaaaccgcccaggctgatgtgcgcactcacggtggatgaagtagcacatgtccgcctgaatgttctgaatggatgtatcattgagctctctttcagacttggggaattttggaagctgcatcagatcatgacagaattaaggaaattaactattcacaataatacaagttagcgactaatttaacaagtgtgtattacttacctcgtcgtaattcgcacaatatttcccattaacccttaggaactcacaacagtaatatccgcatagtactgttcccaccggttgcttgtgatactttcaacatcaaaataattataaggtataaaaggttattacatggaaacacacaagcatttatgaaaattaagtagtactgtgtggcatccatatatatatgtacttaccggccacttattgcagacggatatgcgttctcttgagtttttgcgttgtccacctcgctggtaataccttttaaatgcactgtttcacggatataattaatttacgttcatcagaggttaaaacacgtcatgctaatatcttacttacagatcgataaatcttagaaattcctgataggtgttgctatctttgtcgagagaatccaagatgatgacttcattgtactttggatagagaagaaagactatccaatggtcgctgcaaacgaaattgttagtcgagccatgattatatgtatatactcttagtgcatatatattacaacttactcaaaggcatatggggcataaacacactccttgtcctgcgtagattcaagcgcaatagctacgtacgtagcgacatcaagcatcttttcaagatgcttttgtgctatgtaagctttcctctcttagggagtcatcgccttgatgtgttccggtagcttcttctcgtctagcgtgtatgtgtggcttacttatcctgcacgggtttaggtaggcgacaggctttttcatcgcttcggcttccgcgtaattcatcctaccaacaatggatgatcaaatgagctacgcatataggtgtagtgatctattaacacgttcaagtgtagcacttacagacaccagaaggcaatcaaattggcgtccagttgcttcccacggtagagggaatgc

SEQ ID NO: 4774 - DNA, 2776 bp, Oryza sativa
gtactgtagtttctattaattgctctgtctgaattgaattatgcagtgggtgaacaaatctttagtcaccaaggtaattaatgttctaggtggcaggatgtatgtacttaccaaggagggttggacacaacatacttttagttgccaattacttggtggcaaattataaatagtcaccaagcaaccttggttattagatatttttagttaccaagtaccacttggttctaaaaaatatatagttaccaacattttcttggtgactgttgcttttacatattgttaccaactatggttggtaagtaatgatattatctttagcaaccgaggagatcacatgttggttacaaaatacatttagcaaccgggttgtagccaccaagatgcgaccaaggttcattggtagcgaaaactcaatagcaaccagcttatagcttattgtcaccaaccaccttggtaactaatggtctgtttccttgtagtgcttggaagatgttggtggtaagtactacacttttttaatcattttaaatcatagagttttctgatttgtcaatgtcgaaagaaccttttttttcaaggcaggagagatgtgccaaatgcaaaacgaaaacaaatagttaatgctttattaacaaaaagcaaaaatggaaaactagagcgccatgtgatgagggaggttgctgagttattcaatgttcacattcgatctgttcagcgcacttggaagcaaggtaaaagttatcttgatcaaggcattacggttgatgtcaatgttgataatagaagacgcaattgcggccgtaagtgagttcaagtagatttatctgtgctagatagcattcctttaaaggaacgaacaacgcttcaagatctttgtgctcggttacatttgagtaaatacaaggtgcaaaatatgataaaagaaggtctcattaggcgtcattcgagtgctataaagtcacacttgacagatgcaaacaagaaagctaggttgcaatggtgtgtatccatgcttgatccaggtagcatgccaaataacccaatgtttaaggacatgtttgatgttgtttttattgatgaaaaatggttctatcttatgaggaaatctgagagctattatttgcgtaaaaatcaagtagagcctacacgtacgtgtagaagcaagaacaacatccctaaaatcatgttcttaactgccgttagtcgtccaagatttgatgccaacggagattgcacttttgatggaaatattgggtgttttcctctagttacttatgaacccgctaaaagaagtagcgttaaccggccagcagggacaatggaaatgaaacctatcgtatctattacgaaggaagttattagagatttcatgatcaacaagatattgcatgccattcgagttaagtggccacaagaagatatgaacaaacctatctatattcagcaagacaatgctcgtcctcatcttggaccaactgatcaattgtttcatgaagcttctcaacaagatggatttgatattcaacttatatgtcaaccgccaaattcaccggatttgaacatcttagatttgggcttttttcgtgctatacaatctattcagtataagaaagttacgaaaacactagcagatcatgttaaagccgttgaagaggtactgccttttctcttttttccatttaaattcacaacaatttggttggagctaatgttgttcacatgaaacaggctttctaggactatctagttcacaagtccaatagaattttcttgacacttcaacttgttatgaaagagacaatgaaagtacaaggaggaaacaactacagaatgccacatatgaagaaagggacccttgaaagacagggttgccttcctttgcagatcaggtgtgagccatcagtggtagaaaccgctatgtctcagatctgaatagtctaccaagatgtctcaggtttgagcaattagaatctttgccatgtatgaatatctaacttgaatcatttcttttctttggaaaataagaaggtagaagaagctttaacatttctgttctaatctcatcaaattcaaaatcagaatgcaccttttggttatgcaagtctcgttcttcttcaatcacctcatcattgttgtcgccagcaccggtagtgacacactcctctttcgcaaaatacctaggtagaagaagcttccacatttctattttaatctcatcaaattcgtgaccagaatgtacctttttgttttgttcaacttcaaccacctcggcagcctcgtcatccatggagtcggcaaccacgaccacttcctcgccagcaatgtcgtccatggagtcggcgaccatgaccacttcctcgccggccgcgtcgtccatggagtcggcgaccacgtgcatttcctcgccggcagcgtcgtccatggagtcggcaaccacaagcagcgcttcctcgccggcctcgtcgtccatggagtcggcaaccacgagcagcacttcctcgctaacctcgtcgtccatggagtcggcgaccacgtgcacttcctcgccagtcgcgtcgtccatggagtcagcaaccaggagcagcacttcctcgccgacctcgtcgtccatggagtcggcgaccacatgcacttccttgccggccatgacgtccatggagtcgacgaccacgtgcatgtccaagactacaagctcttcctcgctcgcctcatccatggagtcgctagccatcgagtcctcatcgtctgcctcatacaagatgtcaggaacagg

SEQ ID NO: 4775 - DNA, 11110 bp, Oryza sativa
gaaacaataacaaacaaacataagagatacaatagctattttcatttgtcaccaaacaaaattgcgcaaactaagcttataggtttcagttgagagaagaatttacccatctgggacttcaatttggggagcagcagtaccatcaggcacgattacctccatgtggtcatcaatgagggccaattccagggagtcaaccgctgggtctgaaccatcggcgcagttgttggctggttgcggcaacaactgcggaggtggttgcagcaaagatggggccggaagcaccaagacgccggcggtggaggcgaggtcaacggcttgtcgcggtgacgctagggaaggtggttgcggcggaggggaaggtagcaccaagatgccggccgtgggtcgcagccagcggccggttgcgcccacgctgctgcatagttggccggccggcggtgcgtggatggggagcctggcgaccggccatgcccgagcgtcgatgaggttcccggcgaccggccgccgctgcgcatcgattgggatgctggcaaccggccgcgcccatgcgtcgatggggatcccggcgaccggccaccgccgcacgtcgatggggagccctgcgctcggccgcgcgtcgatggggagcccgtcgaccggccaccgccgctcatcgatggagagcccggcgaccggccgccgctgcgcgtcgatgggatccctgcgcccagcggcacatcgatggggagccaggcggtgggcggcacgtcggggactcgggcggccggccttccatcgatgggagtcggcgcttcactatgggcagatcgatttgggagtgcagggttagtgttttcagtcaacaggtgctagggtttattagtcaagagtattttagtcattaagaaaaaaatcaatacaccaaacggatgcttgtggacggcgatggcacgcagtagacgttcgggaaatcacggtagcatattattcaacttgataaagtcagtggtatattgtagaagtggaaaaactcagtagcattgagtggattctctctaaataaattggttgacagccaccgggcgtagtcaggctcaggcataggctacttaggccatggtccaacatggaatgtaaggcccaatgcaaactttaaatttggattaagtctatattccctccctcaacttatactcatgttgaattgaatccatcaaccgcaaaaccagatataacccgtcttccaactcacaaaaccattgcaaatcgactcgatcatcgggtgatttgagaggtggtttcgtcagacgtgccatcttcgcctccttgactagctgagtcagtacatgggctccatatatatgtcagtgtcctgtggtactcagtctacctccctagtgttcttcctcctccagccgctctatgcccatgcccatgcacgtattacgtccccagcattctaccttctctagccggtctcctattcgtgcccatgcattgtcgcactgcctctccttccaaattagttgcagaaatggatttctctcgatctcctttccttttcccccaagaaagccccatcgatatcgtgttaaatcccgcgaattttgcccccattcttatcccgacgaacttgggacgaactcgtcgaatccatttgtttctagcctagtctccctctccttcgcctatatatagcttgcccaaggtcctctcttccgattccaaccctagtccgagcgtgtcctgtgccctagctgcctccccacgcgcttgcaaaattcgcgggatttaaccactccagccgagccgcgccaccacatctgtcgttgcctaaggtggctgtcgccaccgtcaggttcggaagacgaaggagaagcttgaccgcacctccgcttcacttgggcatcgccggagcgccaccgtcgacatcaacccgaggccgccaccttttcaagctcggcgccggccactcctatcgccgctcgtcaatttgcaacggttttgagttggaggaaggttgtatccagttttgcagttgagggatgtgattcaactaggggcatgagctgagggaggcatagacttattccttgatttttcaccatgtaaatatttgttgggccaaaagtggaacgggccaggcatccgaggccttggaccatttttgaatccacccctgcagtatagtgatgtgatgcgaagatgtgatttatatgaatgattattaattttgtactatctgtttctgttgttaagagtgccgaaaagcattttggaaaagtacataagggaataaaggaaaagtgcatatgggcgccgcccagtactacgactagcactgctatagctccaacaagccgcgtcacttccccttgtgatgagaagaatgataaatttccctgtcagtcagtgtcaagcggagccatatacatggagtatataatactcgtcccaacatttaaccgtcggtctaacttaaataatttataaataaaataaaaaaagtcacgcataagaaattattcattgttttagcatctaacaataaaaaaaatattaatcttaattatttttaataaaacagacgatcaaacatttaacacgaaaatccataactatacttaaaataaaatggaggaagtactacatagtaatatactatatatatgcaatatgcatgcatcgtcctccacaccaacatggctaactccactcgtacgtacgtgttcgcctctaaatcacgagcactgtactgcatgtcacgtaccgatatctctagctttatatatctatctgttaaacatttctgatttatttagcaaaattaaaattaaaggaaaatgactttcgtgcctttatatgtagggtgcgttttaagcataagacggaaaaggaaaatttaattaaataggaggtacaattgatatcatcgatagacgcagtggcggagctacgtgcactctgcaggatcatatgaccccataggtttttgcaaaataacccaaaaactattgatatttgcgttgcaacaatagaaaacttgaaattttatagctttgaccccacattatttgctgctggctccaccaatagaaaacttggaattttatagctttgaccccacattatttgctgctggctccgccactgaaaatatagaggtatatgaatgtatgcattaaatattaatgcttatacatattgttagatgcaggggcgaaaacaaacctatggtagcttggcttgagctcgaactctacctctataatcatgcttaaaataagtccccttaaatcaccatatatatacgatcttttgagaaaaatcaatatctctcgtgaattagtcgagtcctatttgactccaccgatatatggttgaacggatagagagtatttttgtaaatgctgcgtggcgtggacgcgtgcccgtgctgcgtgcgagcgtggtccatgccgcgggggaggcggcagcaagatgccgatacgaattatgatacgaatacgatggagagatcgatatccccgccgcaacttgctcgcgatcgatcttgtagccgccgccggcgacgacctctctttcggctggatcggacgcacacatcgatcgatccatacgtacggccatcgatcgaatagaatatgctcttctcgtgacgtggactagattcccgatcttccgaaagattctgatagtcaatgatttgaacggagtcgcgacacaaatcgatctggcttcttaaacgaacacgctcttgagccccgcaatcgcagtaccacgtctcctctggttatcacccatatcgaaacgcgtatgacctcgccgagaggctaatccctgtttgcgaatcgaagaacacaaacaagaagaaggaagaatacaaccaaaattgcagatgaatgattaagctcacaagttggggtcttacaaaccgatctagcagcgaaactgttcttggcagaataatctaagcaaaacccaaaccttaaaagttatggtgggtactgatatatagagtttagggtcatgcaaccaacccttgacgcaacactaatgggttccaactaacacgatacgcggtccaaaggcctaaatacggtgacgcagcaccggaacagattcaggacgtcaacttgttcggtcgattttcattgactcggaaataatttggacgtgggaccaaaaccattggaaatgttatcttcttagctttctatcatataaagaacgtcccaatccgagcacgtatgcgacctgggcgtctgttttagtgcagattggtcctggactccaaattgcacttgaagttgacttagtttgggtctccaccttgacttggacgtcctcgatgatcctccatgactctagttacttctccaagtgtctccttgtcctcttcattatttctaatcacaatataatcattaggtagaaatctattttcaaattcgtacaaagaagaacataggaacgagcttacctctaaattcaattgtagcgcgcgagctcttgttatcgatccttaaatgaccggtggaggattgttgtgtgtatccgaagaagtgatgtccgtattatctcgtttgactttttttagtcaaacaagtttggtaaaatttatagcaaaataaagtactaatattttcaatacaaaacaaacattgtatcaaaacatattcaatgttgaatttaataaaactaattttatatcatgaatgtggctaattatttatataaatttaattaaattaaaaaactttaattagaaaaaaaagtaaaacggcttataatatgaaacggagagagtggctttttgcttctcggccggtcagataggagctagccacgggcccagccggccggccgccggcatatctcttcaaagccaccgtcatcgccgtcgacgtcgaatcgatcgatcggaattgccttttgcatcgctataatgcatgcatgggtttgcggcgagcgaggccggtgcgtagctgaagtgccgtcgaccacagtatagtaatccactcttctttttaactgtcggcatagccgccaccggcgcagccatgcttggagccttggagccaggcaaaaatgttttgagaataatctagtcgagacaggcagtttaggtcatgcttgattcactttaggatcattataatctgaattattagtagtaagctgaaacaaacatatagtttattttgacagattattataatctataagccagattattataatttggtaattcactctaaaggtgttttttctatattattgggtggctaacaactaacatacaactaataatccaaagaaacaaatagttaagaggttattcgatatcggtttattataatccagcttatagtaatctggcttaataatctaaattacgaacaagcagggcctaatttgggtggctagcctgcgaatattgttttttcatgcatgcaacgaataattatgataaggacacacaacatatacacgacaaaaatgtatacatgaaacaaataattccgggtgtctctccttcgtactacctctattttttaatagatgctgccgttagacttttttttacatgtttgaccattcgtcttatttaaaaattttatacaaatatataagatataaatcacacttaaagtactatgaatgataaaataactcataacaaaataaataataattacgtaaattttttgaataatacgaatggtcaaacatgtgagaaaaagtcaacggcatcatctattataaaacagagggagtacctgttactaccacactcacaaatcgcaaatgcgtaaacgtctcctaacacacgctgagaaccccgaacacacatcactgtgcacgcacacctatagacgtgtgcttaacacacactcaaaatagacctaagcctgcaacaattctcttataaaattactaccacagttttggccttccgcgataaggcacttttgttgagatcagagaaacttcgtcatggttcgtgtgatggtcttgtaacgaaaggatatcattgtagaagctccgtctgtaattacctacagccgtgataaaaaaggggtcatccatcacaaatgttcatgacgaatcgatgcagttgtagcatttctaggacgaaactacttcgtcaccgtgtgctagctcgactctcttctcatatttacagataggactctctaactattggcccataaagacactgcctaccagattcctatgttttcctccaaatcaaaagagctcctaatatataatttttcacaacattagtgacaactctatttgttgccatcaccactttttatataccacaaagaccttaagtcgtcaccaaaatcagccaaggatgaattttacgatagttttttttaaaaaatttcatgataatcgttctgtcgcagtaattcctatatatggataacacatccatgtacgtatcagcaccaagatttaaatccttagacgtacataaatacacccacgactccactaacacaacactagtgcttcctttgatacaatgttttattttttaaaaataataacgtgattttaagaacactttttaagtgatttttagtcatcttcctagcaataatgaaaagaggacggacaaaagtgacaaaaaaaactttttttagacaaatcaaaatcaaaatcaacaagtttataaaacaaaaattgcgataaacgtatattatattaatgccagaattaaatatcaagaataactaaccctaaatacgagtgcatataccaagttttagagtacataaacttgttgtaagtacgagcacacatgccaaccctagaacttttaatcgggtggacaagttacaccataagtaaccttaccagctgagctagatatatatgttaagttggtggaaaataactttttagatgtgttgcggacatttgagctgtctataataataattatttttatttgattattagagatggtgtgatgaggatgaagattaagttggcgcacgtaaaacgagaaagtcattaacatatgattaattaagttttaattattacaaacttgataaatagatatatttgatatttcaaagcaacttctatatagaaagatttcgcacggaacgtaccgtatagtagttttaaaaagcgtgctaatagaaattaaaccgagataaaatctaaatcttaatcagaaaacaacaggtgtgttcccgtcatacagtgaatcgagtaatccattaaccaactaattcttcaaactaagcatgcattttgatcattggggaccattggatgtacttggtgttcatggtgacgatgatatattggttagtgtcctttcctatgttgccatatactccctccctccgtttcgaaatatttgacaccgttgacttttaccacatgtttgaccgttcgtcttattcaaaaacttttatgaaatatgtaaaattatatgtctacataaaaatatatttaataatgaatcaaatgataggaaaaaaattaataattactgaataagacgaatagtcaaacatatgcttaaaaagtcaatggcgtcaaacacatttcgaaacggagggagtatatatgagaccaggtatatatgttagctccactgcccactttattgtgaacgaattattgttgggccatgctagtctgatctacttttcctttgcggcgcctcgaaccagtgctgtgctgtgctggccatcgatgcagccatcaaataatggaaagaagtatagattccatcatgcgatcaggctgatgatggatatggagatcgatcgcctgaatgaatatatgctggatcactagctagctatctagctgcatgctttaatttgacgatttgtgcatgtccaccctgtatatcatatgcatacaattagtttaatttttttcagatgtgtaaaacatatggactataataagccacgtttgagtgccacttacctactgcacaatcaagtttcagaaatcagattaatttgtactagatgactgaaaagtcactactattctgcaagtgtatgcaataatgtcagaaatctgctggcatattcctgcagggagatcatcagttgttcatcatgttttcttttccactgatgtgcatgaccgtcaattattcatcaagttttcttttccactgatctatatgatgtttcaccaaaaccatactgtttgaagcatcacattttcttctccatatatatgatgtttctccaaagccatactgtttgaagaattatgtgtttactccttattatgagttggctttattatttatgttattcttattgcttaaatgcttgctatttttgagagaatattataataattagatgtagcttcattgaagcaaaggccgaatttaattccattataaaaagaaaactgtttgaagcattgtcgtcacacatatactgttaatttgctcccgtgcatctttaccagttcatagtagcatcgttgccgggttaataagtaaccaacggtagtttttgcaaaatgctaagagacaattcaatatctttttttctatattgctcgttttgcatggcaatgtatttcctttgtttctaatatcctctccccaaaagtccaaaatgctaaaaatatttttggtaattaacttgggttctacctatatctttggaaaaaaaaactggttttacttagtgttagtatactatgttggtcaatttagtgttaccggaatgataaaatatttgattaaaaaaatgtctaacatcatgtacgctatttcttctcgtgttccaattagcttcaatatcagtttatcactactaaaaaattgatttttcatggcgtttggaaaatatttttcatagcagccacgtggaaaaaccgccagcgcagaaaatcgtgggggtgggggtcaagggccgccagcggaaacacatcttcgctagcggtctatttaagaaggccgccagcgaagataggatggaagagatgttgcgtcatgctgaacctgaggatgttgctgggtccgctcgtgggttggataactttgatgcattgaaaaaggcagcgaatgatcttttgtacgatgaggcaaagggctgtgagaaggatttcacattgttgcggacagtgcttgagcttatgagattgaaggccagaaatggttggtccgacagtagttttaacgacttgttggttctgttgaagaaactttttccgcaacccaactccctgccaacaagcacctatgaagcgaagaagcttatatgccctttgtcactgggtgtgcgaaagatacacgcgtgtgttaacaactgtatcctattccgtaaagagtacgaggatttggacagatgtacaacatgcaagaatagtcgatacaaaacaagccgtagccagtccgagggtctggatgttgcccttgacgatgtagaagagtccgatccatgcaaagacagtaacaaaaagaagattccccagcttgtcatatggtaccttccggtgaaagatcgtttgaagtgtttgttctcaaacccgagggatgccgaattgatgcgctggcatcatgaaaagcgaaaaaaggatgggatgattcgacatcctgtagatgcaagccagtggaaggaatttgacataaagtatcataagtttgtagaggacccaagaaacgtaaggtttgcattgagcaccgatggaatgaatccattcggtgacttgagaagctcacacagcacgtgccagtactcctaaccatgtacaacctcccaacgtgggtgtgtcagaaaaggaagtatatcttgttgaccatccttgtatagggaccacaacaccctggcaatgacatggatgtgtttctagagcctttgctggaggatatgcgcgatttgtgggaacacgggatccgagtttgggacgaattcctgcgggagtacttcacgctacatgcaattatctttgtcaccgtcaacgacttgcccgcactgttttccctattgggacagatcaagggaaagacgggttgcattatttgtgtggatggtaccgtgtacaggtatcttaagcgatcgaagaagctagtgtacatgcggcaccgacgtttcttacgaaagaatcactcgtaccgctcccaagcagaatatttcgacggtactattgagaaaggtgtagcaccagaaccatggaagggtgataaagtgttcagaatgaccaaaaacctgaaggttgtttttgggaaggtaaaaaagaaggaaacaaataagcgaaagagaaatgatgccgaagtgccagcaagccctagcgtgccattcaagaagcactccattttctttaagtaccttccgtactggaaagatttagacatacgccattctatcgatgtcatgcacctagagaaaaatgtcttcgatagcaccattgggactatactggaaagatttagaccaaggatgggctaaaatcacgtaaggacctcgtggatatgcaaataaggaaagggcttcatcctgtggatgaaggtaataatggaaaagtgtacctaccgccttcttgctacaccttgacaagagccgagaaaatggcattgtgcaaatccctacatggggtgagaatgcctactggcttctcctcaaacattaagcgactagtgtcgatgaaggatctgtcgctttcaggctacaattcccatgattgtcatgtaatgctcacagtattcctcgcgattgcaattagagcagtcgaaccaattcacgtaaagatggtcatcacaaagctctgttatttcttcaattccatatctcagaaagtaattgatcctgaagagttaggtcctctccggactttcgctatacagacagtgtgcgagcttgagatgtgtttcccaccatcatttttcgatatgatgcaacacctcatagttcatatcatgcctcagataattgcacttgggcccctgtacctgcatcagatgtggctttttgaacgatacatgtccattctaaaaggctacgtacggaaccgcgcccacccagagggatccatgatagagggatacacaaccgaggaggtcgttgagtgttgcattgattacctaaaagatggaaagcaattggtt

SEQ ID NO: 4776 - DNA, 5987 bp, Oryza sativa
  unsure (1)..(5987): unsure at all n locations
nnnnnnnnnnnnnnnnnnnnnnnnnnnnnnnnnnnnnnnnnnnnnnnnnnnnnnnnnnnnnntgcaaatccctacatggggtgagaatgcctactggcttctcctcaaacattaagcgactagtgtcgatgaaggatctgtcgctttcaggctacaattcccatgattgtcatgtaatgctcacagtattcctcgcgattgcaattagagcagtcgaaccaattcacgtaaagatggtcatcacaaagctctgttatttcttcaattccatatctcagaaagtaattgatcctgaagagttaggtcctctccggactttcgctatacagacagtgtgcgagcttgagatgtgtttcccaccatcatttttcgatatgatgcaacacctcatagttcatatcatgcctcagataattgcacttgggcccctgtacctgcatcagatgtggccttttgaacgatacatgtccattctaaaaggctacgtacggaaccgcgcccacccagagggatccatgatagagggatacacaaccgaggaggtcgttgagtgttgcattgattacctaaaagatgggaaagcaattggtttaccggtacctcgacatgaaggtagattatctgggaaaggaacaaaagggaagaaaagaatccacgacaatgactacaaaaaagtgaaagatgctcatttcactgtgctgcagcaactcgcaatagtggagccgtacatagagcaacacctgcatgaattacaagcaacaaatgtgggtcgatctaatagatggatcatgaagaaacacaagcatcactttactgaatggttcaagaacctcgatctaccagatggccataccatggaaaaaagatcaattaaaatgctagctgacgggccatcaagtgtgtatacctcgtggcaagcatacgatctgaatggatacacgttttacacaaaagcgaaagacaaaaggagtgcatgccaaaacagtggcgttcgcgtagaagcaatcgacacaactgagcaaaagagcacatactacggattcatagaagaaatctgcgaactagactacgggccaaatatgcagattccactgtttcggtgccaatgggtgaaacacccagccggcgtgtctgtggacaactttgggctgacaatagttgactttgaaaatgtaggcacaaggatgacccatgggtgcttgccgatcgggtcgctcaagttttctatgtgacagacccatctcatttgaagaaagacatagttatttcgggaaaacaaaggattttgggagttgatgatgtcgaagatgtcgaggcatacaatcaatatgagaacatgacactattcatagattttcgaaacaagatattacgcgtcgaagaatcaattggtgaatcgccgaagccatacatgagagatgaaggtgtggggaaaagtgttagatgctaattcattatatatgtatcatgttggacgtatcgatgaattttaatgtattataatgcgtgacaatgatggatgagatgaatttttgtatatggaatatggtgacatgataattgttggatcaagaaatagtttggtataaatttatttgtatgcatgcatttaaaaaatatcaggcgcaaacattaaaaaatcatattttatttttttttgataaattaagcatatctgtgtaaaaataaataaaattattttttcagttgggaatgacatgtggggccaaagggtttttgctggcggccggctttgcccaccgctagcaaaaactgttttcgctagcggcccgcataagctaccgccagcaaaaaccgttttcacttgcggcccacataagcttgccgccagcgaaaacccttttcgctagcggcccacggaatcctccgccagcgaaaatgttttcgctagcggtcggcgcgttcctccgccagcgaagatttcttcgcctataagtagctagcgcgcgcggctgaaaatttcctaagtcccgaaggcgcgcgaaccctaaaatttgtgccgccaggctgccaaaatttcgagcgccgccgccagcgataaccctagcgcccaccaccgtcgnctgctcctgcttcatttgcgccatgctgcattcggacacagcttcttcattcgcgccttcaccgccgccgncggctacttattctctcggccngacgacgtcgncgttagatccattcgcacctcctctccaccaccgccgatagatccagcttctctccgaccgacggccaccgcatcctctttcttttcgccgcatcttcatggattggcccaccgtctctaccaccgccgccgccagatcgagctccacctctcccccggctcctccttcctccacctcgggagttgtcgccgccaccgggactcgtccgctggctcctcttctccgccgccgccgccgactcctcctcctaccgccgctgccaagaccgccgccgggacctcctcttcctccgccggttcctcgtcgtcgacgccgcctccacctcaggagtcatcactaccgccgggtcctcgttgtcgacgccgccgccgccgggtcctcgtcgtcgacgccgggaccagctccgccgcctcttcctcctccgcgccaccgccgtcgccgccgcaccggaactccacggtgagccgtgacgagaagccgaggtacaccccctcctctgctcctcctccccattctgtaaaattgatgtatgatgaatgtgatgtgagatgaattgatgcatgatgaatgtgataaaattgatggatgatgaatgtgatgtgagatgaattgatggctgaattgggatgaattttttatgaatgttaattggtggtgaaaatttgggtggatgcagtttttttttttgtgttgatagaggcatgtatgagtttgtgcagcctctgaattttttgtgcaccaactaaaatcgatgtgcagccactgaattgtatcgatgatagaggcatgtatgagtactgtcctttgttttcttgttgcaaatgtgatttaatttgtacaatcaaaattgatcttgtgctcaacatattaagaaaaagaattgttctgctgttgcacttttttccaaaatgaaatggacctgtacatattgtacatatgtattgctgcactttttttccaaaatgaaatgcactttcttttgttcaggcctatgctgttatatatatatatatatatatatatatatatatatatatatgctgatctggatatgatgcattgagatgactgttgggtgaatatttagatgcacaaatttgttagtttgactgaaattgagtaattcgttagtttgatactatggcgatcaaaatgtgttgtttgaaatttagttcaaatgaaagaattgataaattggccgcagaattttggtggattggtcagtgtagtccatggacggaaccgatctagacaccaaaattctccatgcattttgtattctgtcattctttgataattaaggaacttaatttggtttagggtttgaaatttagttcaaatggaagaattgatagattggctgtagatttactgtagttcctaggttatcaaaccatcacagaatacaaaatgcatggggaattatagtggatttgtcagtgtcgtccatggacggaaccgacttagacaccataattctccatgcattttgtattctgtcattctttgataattaggtagtttgaaatgatcagggttggtgaattgtaatattgatgtcgttgccgatctcattgattggtaacaatatttatagttgtagtacaaaattagtatctaaattttgccttctttttggatttacaataagaaaatgattccattttgcaactaacattaattcaccttcaagcgatatcaatggacaaacccacccaagagcaacccacgggtgacaagggcaaggaaactcagctagtcatggaggaagatatttgcacgcaagtagtcgcggaggaatcttcgtcgtctagctcaagttaaccaggtagtggatcgtatcactcaccgagtgaccaccatccttctccggcaaggaagagaaagggcggtagcaacaaatgaagttgactccgactacgttccgcccgaactggtggtacgtagcatataatatatgtttagttccaatcatattaactgcgaactatggattttaattaaagtcacgttatttgcaaacaatagttgaatgctccacgtcgctccaaaaggaaagcccaagccgcaactgaacctgaagctgtagctatagccgtcgtgtgcacaacagctttaagcaaacccaagaaaaggaggggcgagcgagggaagaacatattgttgaaggaagtaagcgtgctgacgcggatgagtgagacaggggaacccctgtcaccggaagactcatgttcgaagtatagcaaccaatgtggggcggtggtcagggatatcgtggagatcacatggaaggattggaagaaagttccagagagtcgaaagaacagctgttggacatcgttgcaaagcaagtttgaatatccagaggggacagacaatgataaagccaaggattatgcgttgaagacaatggggaagctgtggcgaaattggaaaacggatctgaataagaaatatgtccaaaagggactcacgccgtttaaggactacggaaggataacacaggcccagtgggatgagttcgttacccttaagacatcggcggaagaaaaggagaagagccagaagatggctgagctagcaagaaggaatggatatccacatcatttgggatcaaccggttactggcaagcggtgaagaaatgggcaaaacaagatgaagagatggggaaggctgggaaacctgttcctatgaaaaatcacaacccatgaagcaggaacaccggccttcacccctgagggggatgtagtattcaaggatcagaagctccaggaggtagctgtcaagatgaagaacatcatcacgcagcaacaggccgggacgttcgtgccagatagagaccgggacgagctaacctatgccttgggcaaaccggagcactctggccatgtacggggagtttcctcaaagactaactggaaggatggattcaaacaggatgcttatacctacaagaagcgtgatcgctacaaggaagagattgactctcaggctagggcagcagcttgtgacgaatgcaacatatactggagtcaaaaaatgatgcacagtgtagctgttttagagcctgagccgagctatcctttcgatgttgtaacggaggatactccgtgcaagctcttgatttcggtcggcagggcaggaaagaaaatactcgttgcaactgggaggttcataccaggccacatgtttcattgccaagacattccggatgactacgccaaggtagaggtccggacggtcattgaggcttaccggatgcacgagctcgactttccaactactgagcagattgtgtaccttggagatgccatcgaccaattcatactatggcacaagaatgatattgaactagggtcaacggatggaactgatcgtccaccaaggataccggtgtcaccgtcgcatccaccagtcgtagcccgtccgagggatagtcctattgcttcaccccctagaccagagccaccagttgcatcacctctaggaccaaagccactagttgcatcatctcgaggaccagagccaccagttgcatcacctccagtaccagagccaccagttgcctcacctccagtaccggagcctcctgttgcatcacctcggacaaaaaaggatgcagaagaaccatcagagtctgtacaagcagagcctacaaagctagcggcgggtgaaattgaagcggtgcctgatcagccaatgcccgatcaaccagagcaatcgcaaccagagccatcgcaaccagaggaacctaagggtgccgatgtgctagtgatggtaaggacgcacaagcacaa

SEQ ID NO: 4777 - DNA, 609 bp, Oryza sativa
gacttttaaagcatgtgcacacaatattccagttctactgaacatcccacagccgcatgtactagtttgctctaaaggatcaccaacaactttgtactccttctcaaaggtacaattttcatctagactgccaattgccacaagatagcaattgttgccttccaatgccgtggtgcatgctaccatggatctttcatattcagcttgaaaagcttcgaatatgattggtgtgtatagcttgctagcttggattagcataggtgtcctcatttttattctgggtattttcttccttgattcaaattcagcatttagctcattttctcttttatcttccaccaccctttcaaaatgttgaagaaatcgaatgatatcaaaatcagatttgaaatgcctcttgagttcactatttacactctcacttaactgtgtacttctcatacctaatgtgaacacatccttcatgtaacattcagcccatttttctttcaccttgtatatactatccaaccaactttgcttgctcgcctttgcccttatggtgctaaatgcttgttcaaatgtttcctcatcttcgtactcaaacatacatgcactaaaatctgtgag

SEQ ID NO: 4778 - DNA, 5681 bp, Oryza sativa
  unsure (1)..(5681): unsure at all n locations
tctatgaaatggcgcattctttgcgccattcaactgcatctttcttttcctctgaatttggcggactgtttcacaaatcaatagattcagttttggcactccattgcttgtcaagtgcaggtcaattccaacttttttcaaagcttctataacgagcctctgagattttggatcatgatcagaacatcgtgatggagtaatgcctgtcagaacaggtttcccacaagtttctaccccattttgcatgccactgcagaagaataaacaatagtaatcagatataaggagaattgctcattaagtaacaagatgaattcttcgaagagtaaattggcatccaaaaagtcattccccattccccttgttccaacaaaagaagtacaactaataagcaacatattattttgcatcctacaaattatgtattatatcaacacagatatttcatacgcatatgatatgcctatttgtgagacctaaaaatccctaggttataaaatacagtagaatgatagcagctgctatacacatgtttatttgaggcaatgttattaaggcggtatggtgaggtgtggtgatccaccaccgccttactgccatagtgagcgataatgaatatggcgtggcgacacctaacgtgcagtgaaaagatagaaagaataagaaatatgggctgtaaatacactaattgggtactctattcatcacagcgcagcccaatagtagtagcccatccaagcactcacctaacctaggcccactactttctctcaacctaccaggtagcaatttaaccctacccaacagcttccttcctagcagccaccacctcaccttcatccagatctctctcccctatcgtgcagcactgcagcaggctcctctcatccacctttctctctctctcctcgatgcagcaagcagaccatcctcctatcctctcttccttcttgcagccagcagcctcctctcctccaccttttctctctcatatggcacaacagcagcagtccctctactccacatcggcacaataaggggagagagcgccaccagggaggaccagcagcaagacagtggacttttcccctctgctcttaacctctctccttcagttcatacctgtaaaggggagaagcctaaggcggaaggacaccttgcccttccgtgaacgccacaacgctatagcgacgccttaataaccatgattggaggattatctccaaatcccacaaattacagtatttgataataatagccttttctaataaagaaataagccaaatcctgcaaatttggataatcgtaataaaaattctgacacccatcaatagttctatagagctaccaagctaacagccgcctttaccaccaatgttatagttaactcgttttgaccacaaacaagtttaggaactttacaagctaatcaggaaactgatgggctattggtggtgtccgttctctctctccctcaacgacgccccaagcatccaccgctgccagcagctgatggccccaggttatccagagaagcgacttgctggatctgatcatcaggccaagagcagctcgcaggatacagggtcggatttgtccttgtcgatcgagctcgctggtgttgggagtaccgtggagcttctggcccatcatgggagagagcagaccccgagaggggaatcgagttggagcaagtgagagaacagaagcctctggcccatttggcatcgtcatgcctcgattgaaacctgtgaatctcacactggtgtgctgctacttggtagctagagcatggaacatttggaaccccaccgctttctttgttggtgaagtgaaggagctgtgaagcaaagggacaaggaagcctggaaggtgatgaaggcttgagagctaggagctggagatcgatgtgttcaactaggagaaagagaggaagaagaggacagccaacttcttgatggaagaaagagtagttgagaataggcatagagtgggcatcagcatttaccacgggcgtgcacagtacatcatttttcaagtatcgtttttcacatatataaaataccaaatatgatctgataattagagtgaaaataattttattttgttcttttagttaccggattcggtgggttatcttcctataaaatcccgttgcaacgcacgggcatttagtaagtctagtaaaaattgatttgaccaaacaaaagactgcataggtatatggactgaagggatgaagtacagacaccaactaagcatgtgagttgaacgctcagtgctaatttcttttcaacactctaacactcctaccgatatttttgtgttggcctccgtcccaaaatatagcaatttttagctatgaacctggacacactgatgtccagattcatagctaaaaatacttatattttgggacggagggagtatgccactagctacagccagcagcggtggacatgcaaatgcatgaagtgaatgaattctccagcctgtacattaccaggttgacaatcgtattcacattaattgattatttttattcaaatatgtatttatcagttctgcatttgttcctgattaacaaagatagggaagggatcctagtttaacaacttaccattgttacgaatgttccttccttaacctttacccccataaaaacagcatataggaattgttgtcctatgcgttaatcctcatactaccggtaataaaagtaggaattgcgggagcttgactgttatccaagtgaggtgtaaactgcaaagagtggtgtattgctaaatagacaggtctacttgtcagcttgtaaaagtccagaagttgtgacaatcacaggaagctttgactagtccaaggtttagccccaaattcaacaaaaggcaaatcaaaatttggagggttgaactaaatgttctcataacatacatgccaggactaaaataataataaaatgattcaattttactaacatcagcaagatcagggtatttgaagctaatcatgaagctcagggacactaagataaatgttgtgcaattagtaagataaaactgtataatttgacccattcatgaaaaatgactacatggaggacggttggacatcattagcttgtaggttaaatggacaatcctacttttgagtcatggcatcgagatactatatctgaatcaataatcctattgagtatttgcctaatttgtattcgcatcggtaatactactaattcaaatccacatatttatcacttctatgtacgttcctgaatatctaataaagggaaactattaaggatagtctaagaaaatccactatccctccctttttttttgtcaccacgcaatataggtatcattgtcctacatattactgtatctcatattatcctaaacagaaaccaggacatggcgagaaaccagctggttcacgccaaaattggttcctgccaaaattgtgttccctgatcgaagcaagtgatacataaaaacctaacacaccatacctgcatcggaagttgttccaccaatgtcttagaaaaaaaaatagtcaatacaaccaccaaagtattcagttttcacatagttttgtgaaaaacatacttattcacgcctcatacacataatgacaaggctgcaagattcttgtaactagatcaatgatacaaactatttttattataaaaaaaacatggcataacatcgcaaattcacatgcagacatgaagtcaaccaaaaaataatcaaaattcacaagcaaccatctcccctaacaatcgcaaccacccatcgcacaatgaacccgaccatacaaccacattccccgcacagaattttacggcgcggcgctgaatcaaaccaaaattagaatatggaagcgtgaaattgcaatgtaccttcggttggtgacgaaggcgcagggcttgtagagcagctgcttggggtcgaagaggatgtgatcgaagcagtaggccgcgaagggcatcgccttggcgccgcaattcgccgcggagcaccccgccctggcagccgcaatctcgacagcagcgccgccgccattcacagccggatgaggaggagggggagcgccgccaccaacggcattcccggcgtcggggctggagccgtgctcccaccagtactcggcgtgcctcgcggagagctcgtcggcgagcgcccaaagctgggcgcggtagagggagtggagctgcaggaggccgcgccggcggcggcggatgacctcctcgcgtgacagcgccgcggcgcggcagagcttggcgtcgcccgaagcgccggcgagcaagaccggccgcggcggcggcggcggcgtgggtttatcggcggcgtggccgtcacccatcggaggcggtggcgggctagggtttcgaggggagggtttaatgagggagaaggtggtgggcctgatgaattcggcccgctcgattgggccggtctgtctgggcttatatggcctaattgtttttgaaaaaagtacaccaaaggtccctcaacttgtcatcgagttagaaaatcgtcctccaaccacacaaccggacacaacgtatcccccaacttacaaaaccaggacagactagatcctcggtagttttgaccccggttttatccgacgtagccactgagtcaccgtgggccccatatgtcaggatgccacgtcaacactctatctctctttcctcctctcccttcctctctctcacacttttctcctctcgaggagcacagccggcaagggagaagtgccggcgcggcgggcgcgccgatggctagcggggtaggagactaggagggctgccacgaccagcagggaggagtgcgacgggcggcagctggcgaaggagatggcacccagcgacagcctggaggcgaacgctatgccgctccactgcgccctgggtcctctccacttgcatcgcggtgacgacgcgagagcaggagggagtcgttggggcgaggaggttcgacggcctgccagcgatgtggtggcagggacgcggcggcggagacacgagagaaggagagggcggcggcggggcgaggcggcgtcggcgggcgagtgcggtggcggaaaggtggcggcggcggcggggcgaggcggcgtcgatgggcgagcgcggctgcggatggggagcagcggcgccgacgactccgcgccgctcggcctcattcttcgctcactgggagggatgactgaggtgagaggacgtcgccagacggttcagcggccagaccgaggtggcgagcatggacgacaacgaggcgtgcgagctggtgagcagcgcagaccttgtcatcagtggcgacatcgacgacgatggcgagggcatccgcgcctacctcctccgcctcccccaccggcgatctagcgccgccctgagcccgtgccgtcaccggccgagcgcgctgccgcctgtgcgagtgtttgactttggatgatcaggtcgccgtcgttacttatgtgccactcatactagttgattgcagtaaaacttgctgaaaaggtggtgtgttttttttaataatagaatataacattcggcctttgctcaaaagagctacagccaattattataaactagcactctaaaaacgagtgtaattcaaataaattgaaaacaccaaaaannnnnnnnnnnnnnnnnnnnnnnnnnnnnnnnnnnn

SEQ ID NO: 4779 - DNA, 667 bp, Oryza sativa
ggcgacatcgacgacgatggcgagggcatccgcgcctacctcctccgcctcccccaccggcgatctagcgccgccctgagcccgtgccgtcaccggccgagcgcgctgccgcctgtgcgagtgtttgactttggatgatcaggtcgccgtcgttacttatgtgccactcatactagttgattgcagtaaaacttgctgaaaaggtggtgtgttttttttaataatagaatataacattcggcctttgctcaaaagagctacagccaattattataaactagcactctaaaaacgagtgtaattcaaataaattgaaaacaccaaaaaaaaaaacttgatatcataggtagtagcagaaagacttgatattttgataattcgtggattaaaacgatcattgaattcatctgcaatataatgtattcaagcaaaagagaagtgtaagaatttgtaaccatgcaaaatgaaatgggattttttcgcaggcacaacgatccttttgctctgctactactgatatgctttgacattaacatccaacaatctagtggagaaacaaagatgaatttgcattgtttggctgacacagaacgggtgccgatggagccacggaggagcggtcgatgcagcatcgccggaggtggcagtggcagtggcggtacgtact

SEQ ID NO: 4780 - DNA, 18513 bp, Oryza sativa
cactatttacactctcacttaactgtgtacttctcatacctaatgtgaacacatccttcatgtaacattcagcccatttttctttcaccttgtatatactatccaaccaactttgcttgctcgcctttgcccttatggtgctaaatgcttgttcaaatgtttcctcatcttcgtactcaaacatacatgcactaaaatctgtgagaatactttgttcttcctcgttgtcttcggcagtctgtttgggagaattactggattcttcatcctcgagttcagctacatgtttaacagcattctgcatgatatggaaagtgcacaaaccatgccatgattctaaaaacactttcttaattgcttttcccattgcagaatcctgatcagtatagattgttttaggttgcttgccattatgtgcttttaggaaggtctcaaataaccacttgaaggactcatatgtctcatcatacagtagaacagcaccaaaaaccattgtttccctaaactgattgaacccaacaaatacaccaaaaggcctactttccttgtttgttccaaaagtagtgtcaaaactgacaacatcaccaaaatatgcatagtcagtgagcattttagcatcaacccagaatatgtttgctatttgctcctcactatccatctgcaatgcatattgaaatgatgggttcttagcaattttatcttgaaaatgcatgagcatgcttcctgcttgaccatataccatctctcgttggcgtttgccctgtaaataattcttggggtcacggagaatgtaattgagattaagtgagccaccaacttggatactagccaactgatgtgctgctttgggcccaatgcccgcatcgtcagctgtctcaatttcaaaaccttgtaactctgaaattttcctttgagacaccatcaagtgcgaggtttctggcaattgaaggatgtgattgtgttccaaaactagatcagccactttataattccctttctcctgatctagcacaacacccatgcgaacttgacaatcggttctcgtttcagctcttggacactttgttagatgatcccttttatcctcctttctatgaccctcatttgcacaaacatatctgcatgacctaacctttccatctgatttccttttgattgagtacctttttctaacctcgaaacctttttgaccaccatagctaacccaaaacatccaagcctcatcaacagtattgaattccatgccaacttcaggtaacaaactaggtagcacacccactctacaggaacaaaaaaaatgatttggtggtcatcgaacaagtaaaatctacccgatcatggtgaaaaaagtaacaaccatagctttacagacctgttttcttccatcttaaatatgcagattttgctggaggcttctttgatgaattattccaacactgtctaatggaggaggtggaagacaatcacataatttgctgaaaaaaaggaagagaagaggccatattacttcacctgtgcttgatcaacggtggaatccgtgctgaaaaaaaaggaagagaagggttcagatgatcgcctggcgctgtggcctcgtttggcgccaaaaaggcgagtgcgccgccaaaacgcatctgttcgcggtaaaaaggaataggagcgagacagacggcgctggagaacgaggcttgttggcccgcccttggcccagactcacaacgcgggcgtgcgctttttggggcggacggttcgatcaaacgtggacggctggatgacctcggctgctctctgccgtcgtgagggctgaagtcagaggagctgattccggaggggaggggggatctttgggggtttggattccgattccttgttgttgtgcagttgtagctcaactgcagcttgggcagttgggtcacagaaccacacgatctgaaacgggcggcccagattaagggcatgtttggcagggagctgcagagcccaacggggccctcgtttggcttatttagggaatatttgcaaacgaaaataatctgtgaataaaattttcatatgtgtgttctcggtggtttaaaagcaaaggctgaaaaataaactacgatgaaaaaaccctaaaatgaactctaaatttaaagttaaaaattaaaattttgtcttataagcataaacgaaatgataaagttgtaaagctttaaagaaaagtttaattggacccatatcattacaaatatgccatattaaaattcatgcaaaattaaaaccatgccatcgccatcacgttttccgtcatcatatataccaaaatacatctagaagtgggaccaacaaagtcagctctatctttttcctccaccaacctatcctctttattccccatctctcttcaccttgtttttaaatgcggtgcccagcgaagagggtgtgcctctatgtcatcgtcagcgaccaaacacttgtcagtccagatccaattgccccaccacccaagccaagccaagtaaaagctgcagaaacacacaaacatggtacatggtacaccggagacaggtgcacgaatggtggtcgcagctgctatccgtccccgcggaagtaggcctgcctgaccatgaacatccccatgggggcacgcatcaccggccagtacgacccgcgcgcacctccacgaccaccgctcgtcaccacacggcgccacccatgccgcgaggaatgctcttgccgcgtcggctctccctccctcccgcgttggctctccctctgtgaccagatgccaccaccgtgagcatgaggacgatgccgacgtcaggcagcaccaccatgatgatggttgtttccctctctgcgtagctcaatcttaggggtttagtaaaatttgctaaaaaaaagagaaagagagtagaatgagatgaaataatctgaaaaaagaaatatggaggagactcaactcatataattatatttagaagttagattcatatcaaataaaccctaagttaacggttgactattaacgcggccatcttgcactggtcataagcaaattcagagatcagtcacgagagaaaataaattacaatgtaaggccctgtttagttcccacacataaattttatactccatcacatcgaacatttgaatacctgcatgaaatagtaattataaggcttaaaaaataactaattgcacagattgcgactaatttgcgagacaaatcttttaatcctaattgctccatgatttgacaatgtggtgctacaataaacatttactaatgatggattaattaggcttaataaattcttctcgcggtttactaacggattctataattagttttttttattagtgcccgaatactcagtacgacaccctatataatacccgatgtgacacacaaaaactttacatccctatatctaaacaccccctaaataccatctgcatttactttgcatcataaccaatgctaaaagatcagccataacaattatgtacagcatattaaaaacagagagatttggagggagacggttttggtagatgaaagagggaattgcgatagtggatatgaagaggaaattatgagagcggacgttccttttagaagagtagagtccaaatatactcttgaacaagtaagcgtaacagtggagtactatggtggtgaacttaatggagtaagttatttttaagaagaattttttttagaagaggagttctatggtggcgaaattggagtgagttattttaagaagaaatttttagaatagtagaatctaaatatagtattgaacaagtagacgtaatagaagttctatgatggcgaagttaatgcagtaagttatttttaagtagaaaatatgtgcgtgttaaggattgaacatggaattttgaggttgaaaacacacattttttgccactgcactatcaagtatataactccagcatatcaactatgtccagcactttaaatcctcttccatgacaaatctgcgttatctaaaaaaatcaagcaagtttttgttgagcctcacacaaggctgcgttatctttaaaaaaaaaaaagcaagtcttttgagcattattaagctctcacgcagggcactaaagctctgttcgtttttgcttttagcgccatatttttcgaactactaaatgaaaaaaatattttatatatgtttttctaacaaataaaataaattatttttaagtttataatagttaatacggatgtccgtgccacccattacctcatctattccgatgttttaatgcgccctaaggctcatagtgctacactattgtattatatttttctcaatatattaattatgtcatccctagtgtatttttaagtcttaaaagggtatccatgatggtgccaaatcatctcataccgtattattcacttatggcgatagactattggatgtttttttttgattgaggtaaatgtaaatagtatggtgcatttgtcagctattaacacttttggatctaaaatgaacaagtgatatgataatgttatagggaatcactttgtttttcaaacgtaaacagaagatataaagtgtccactagtacgagccaaccctaatgtaagtgatcaacacaccccattaggaatgcagagtacccacctttatcactgttcatttcatgctttgaatcactatatctaacttagggtgtgtttagttcacgccaaaattggaggtttggttgaaattggaacgatgtgatggaaaagttggaaatttatgtgtgtagaaagttttgatgtgatggaaaaattaaaagtttaaagaaaaattttacaactaaatacggccttactttactgtccttccggtgtcgtaatgcagaggattcagatccattatgtcttgtgtttagtatttaggaaaagttacggagtctatttacaatcactttttttttctaaaaaaggtgctagattgtaaaaaaattgtacaaccgttttaccgctgctgacatgattgtatggttagcctttgttggtttgttattttttttttatgtaagcctttgttggtttgttgacaaatgacaactatctgcaggtatcgaacttaccgaagctgtaggggtaaacgatagaagtgatttcacactccaagaggcaaatttcgtgctgcagtaatgcttgcaacagggtcgacaggtgcatccatcttgttgcagtacgccagtacccactccatgagtgaagaaaaatcacctctcaaagagctctccactctccagagcgacaacaggaggaacaaagactacacctacaaaatcaagaaagagattttctctccctctctctcttggcttggaactgtggactcattcttcattcttcaatggccaatggaatttgttggataggaagaacctacaccagaaaaaaaaataaaaccttttgaatcaagagtgaagcagcatatttaaggtacgctttatgcttctactcccttcatttcatattctagcattgcccacattcatatagatattaatgaatctaaacacatatatctagattcattaacatctatataaatatgggcaatgctagaaagtcttataatatgaaacggaggaagtacttagttttaatgattaaaagcaacaagcccgagttgaccaaaacaatgaaagagctatcaactaattctaaattaagttctaaaattcaaaattatctaccaaaacgagtagttgagaactttctgttcaaaagaagaaaaaaaaagaacacatgaaaatatcagagcatatggatgccatttggcaactgcaacaatgcttaagaacaaaacggctagtgattcaatatcccaccaaatgtacgccttatattcatccatcttccatatgttcaaaaaaaaaaagatcaaaacattgtgcaggtgggaacaacccacgattcaccaccggcccggccagggtttgccagtcttcgcttccatgaaaccacagagctaaagcctaccaagtttaacaagcccaattttactattttttttttcacatgaagtgttcagatcactagcaagtttctgccatttggcttttctaggatgattacttagccagttagtatcaaaattttgaagcatgaggtacaaactatacatcaactcatctcgcagcagtgctcttcaagatgactgagagaagcagaaaataagcctgttgacttggttatctacttcttagagttccttcggtatcgttgacccttcagcgctgtcatcctgaggtgggaagagtagttccttgatgccgctaacaagatctttggtttcctggttgtgcttgatagagttcctttcataagtctgcagtgtattcacaattccagcacatcaacacaaacttcggcaacaatttcaactatcattaggtacaattcaaacaggcatgcagctattttgataactcgcgagacatatgtagatattgagtatataattactgagtacctctgaagaccacaagttatcgccttttctacggggaatgaggtgaacatgagtctgcaataatacatttctcttagaaaacttgatatgcacagacagacattctacattgagaagcttaattagacaaaacatctagggtgggcaattatagaaagtatgatgttttactcacgtgaaaaataacctgccctgctacctttccattgttgacaagcacattgaatgcatctgtacatgttacaaagattttataagtcaaagcaaagtaatatatgttggcgtaaagtagaaaaatattttggcatatacaagggaatcaaacacagtccaacacaagggaactatgtctcatctggcacatataaatatatcctcaacatcaaggagacaagggtttaacccaaaaaatagaatgaatgggatcagttctagcatttttgtttctaatatatatgatattcagttttagattgcttgaaaggtcaacttgagaaggaagaaacatagaatatgagttatctaatttatttatgtacaaaatgccacaaacaagactacattcatcattgcactgctaatatagtagtaatgtatagtctaacaaatatttaacatgtaggtggacaatgggaaacttggaaaggtcccgcacagacaatacttacaagacaaaatggggcagaaagataaagatagagctcagaagattttctacatagttttattaaactactttacacgagcaaagccacttttggcattctttagtgccatcagaggacagtgcaaaacaccagcataattgtcctaacaattgcaaagttgtaggcttgtagtgcacataccacattgagtagccttcacgattgcactggaaataagtgggagtttacaacatatagctgctattacctgtatttttttttaaaaaaaaaatcaaaccagagaaatttcccagttgtgtcaagtagaggtaaagcaaaacaagcagcatgcaatttctaatgactcctatcgtgcaatgtttactaattactatcaaacacagagtagacaacaaatggaatgaaacatataatgcttttataggggttacaagtaattactgagaagagaatatgccccaatacaagataataatttaacttcataggggtttgctaatattatcaataaaaaaaagtggtcaaagttgtattttgaagactgttccatgtccaaaaagacatgttctcgtggccagaatgggtatatggtaatctgcaaaatctctgtcctataaattttgttaaaatgtaaatgttcatgtacggtctgcataactatcaagatcattgtcatcataaccaaaacttacagatggcggtgttgcctgtagtgatggaaagtgacgttttggaatgatcagtgaatgcctacaattgtaaacagaaaggactgatcatgagttaagcgcaaaagcatcttggcatgtgaaaaggaaccaattcgttaaatctcagatagaaatactatataagggtagattcaatgcagaaattatttaatcagtcagttggcccaagctgcccagagttgccgcattattcaaaaatactttggaactaattcaccacattttatgcaatctatattcaatttgtaatagtttctattaacttttgttctgttctgtcaaaaacaggcattagaacataaatctgcaaccagtatcagaatcacaacaatgcaaacttttcttcataaaactgatatatcagctcttccatttcgtagtttaagtattaaagactaaagagtgttaaagaggtcaagacaagaaaggaccgagagacaactagtagagcagccgaagaggatggcttgaggagggaagcaagaataacatccattaagcaaaggctatgacaacagaggtctgaaactacagctctcagtgaggcacagacatttttatcattctgactctgatattctatctctaagcacaattattaggttaacatgaaaaacatcactggttcttccatgattggcttcccaatccttcaaatttacccctaaatattcagtttggcttcaatttggactagggattgacccagcaatatggccgatcatctcatccccacaatgatcatacagcaagccacatcaacagcaaactggccaaaaaaaagctatgttgtacaccactatcaaataggtaaattgaggtttcagcgagcagaaccattatcttgttcttttaagttttataagcaaagtagctatgattgcaaatacaataaaatatttgaccaatactgatgcaactttaaactttattatttcccatttttaaacggtcttaatactagggaccatgatatgaccaatggaccatcatactagactaactggcaacaaacatttggtggcatcaagcacatgctcaaattcgattgatgaaaaatgacattcacatttccaataattttggggaaaaacatgcaaattcatttctcacaaagggatctttacatcaagattaagatggcatacagactacaaaacattagttccttcacaattttacaaactgcaaaagcagaaaaaaatggttgatgtagtaagtatttaaattttccaacagatcaaataatcatgcccagacatccagcagtcgtattttacattgatcattaatgatgtcaaacaaatgcaacatcttaaatgtctcatacttattgaacacatgaatgtaaagcaccccaatacagcatagagtatgcacatccaagcagaaccaggagttaatcatgttgacctgacgcactatgttaaatttgtactctctccggtttcattttaattgacgttttggacaatgacacggtctacaagatatatctttaactttatttttctactataatatatataataaataaatgcatgtttacttttattatagtgctttaaaagacaaatctatatatgttgttctagttcctttaaactaaatatttttaaagttattgatggacaaagttataaaagtttgacctcaaccttgtccaaaacgttaattaatatggaaccggagggagtaatgaactagtaaaagcatcaatggcatgcaatttactgaactaccaaaaaccaaaaccaccataccggaccagtagcaatattacagcattgggagatgtacaattcaatttcatcaactgaaaatgagtacaagacgtaactatgcaaccatcacacaattgatgcatggtataacgtgttgccacgtgtgccttgcatacttcaacaacatggaaaatatggagtattattattttttgttcaacccaccacattagtgaaatgaaaaaaaaaacaaagtgccatctatattgcgcacatgaagaatacatgcagcacataatccaacacaatggagaagttagcgacgtaccatgcaggcatgcacaaatcacaaatgcacgatcagtttattcatccaaacggaatctagcacttattcattcatgcctactcatcggcgacacaatcaaaggtgttaaaactcaaccaaatttcactagaaatttaacaagagagacaaaacgagtcatggattttaaaagttgcagagacgaaatcgagagcgaggacacgcaactagctagcgccttacccagtgctcagtggtttggtgtccaggatgcacaagcacacatcgtcctcgtagagctgcaaccacacaaaaacaccaaaacgattagtgacgcgaaagaaaaaatgttgatgcgcagagaaggtgagagccttcaccgcacgaaatggcggagaaacgcgaattgaagaagcagagaaacccgagaccagagcagggacggtgactgagcagctgcgctgcgcgtgagtagtaccttgtaggctggcttgttgcccttcacgatctcgcagaacacgcagcgctggcctcccgaggtctccccgctcccgtcggcggcgcagggagacgcggcgaggccgcccgttccctccgcctcccgcacccgcaggtcgtggtggtggtggtggtggttgccccgccgcgcggccggcggcgcgcacgggcggaggtgggagaggagcaccccgaggcgccgctcctgcaccggcgcccccgagctcaccggcggcgacatggggcgcggcggaggcggcggcggcgcgcgcccgtgtgctttggagttcgtgcgcggcgcgaggagagagagagagagagagagagagcgtggttgcttcctcgtgtgtgtggtctctgcgttttatccggaagcgtggggccgtgtgggccacgtgggccccacggatatgtcactgacaggtgggtccaggaagtgtttgatcggcctcctgggccgcctggtgacctggtcgggcccaccggggtttgtctggtgctgcggaggcagagagttcgcgggggtgatacgtgttactgccactgacatgtggggtcagttttgtggaggtggggtccactgccagtgaggttgcgtgcttttttgagtggggaccatgcgctgttgcggaagacgccagtagcggttgcaaagcgtgacgtggaatacgggatactagctcatgctcactgacaggtgagagaggctcccatcggatggtctaataagccaaaaaaaaaaagctaaaatttaaattttcaagcttaattttaatattaattttaagatatttttaatatatttttttcaatattagcttttaagtcactaagaacacatttataaaagttttacctacaaattcatttttattttctaataagccaaacggcttattagaaaataagccaaaggatggtgactagagggatttcgttggctttcccttgcacgtggggcttattaaaaaaatgatactaataatgatattattttctactaatagatatcatagagttgtttttcttctttattttctgatgattttttttgtattttctttgttttcctttgaaaatctattagattctatgtgaatctctataataagatgatacttttctaaagtacagcctccatttcatattatatgtcatttgacttttctcttagctaaagttctttatgtttgactaagtttatcgaaaaaatatagcaacatctataacatgaaattagtttcattaaatttaacattaaatatattttgatacaatgtttgttttgtattgaaaatattgccatattttcctacaaaattagttaaacttaaataactttgactataatatttacttcataagtactccctccatcaaactttttaagccatgaataacaatattatcaaagtttcaaactttttgcttgaaattgaaaacctcaatgtcaaatcagtcttatttttttcaacatgtataaaattattctaaaagatattgagaaataggagataggttataatgcatccataaatcttacttcctccgtttcacaatgtaagtcattttagtattttccacattcatattaacaaaatgacttacattgtaaaatgacttacattgtgaaacggagggaataccaaatagttggatgcattatccaaaaaagaattgatagtaagctgaaccatttcaatagtttggagactaaagtttaaaggtttccggcgaaatatactcctaggtcagggagtaaatggacttctgtttttttccaaaggaaaagcataagttgtaattttccttgggctgggctagcccactactcatcagcccacgttaacacgcgttctccggtggccgagttcctcttcctctgcggcgtctccgcccgccgtctcgtctcgtttctcatctcaaaatttcgcgcctcgtcgccgcgccgcgcggcgggcatgtcttgacggaatcgcgtcgacgcacaggcaccgggggccatggcgccgacgcctcccgttccactccccaacccggcggggtcggcggcggcagcggttctgccccggccggcgtggaacaccaaccggaacctggtggtgacccacccgctgctctccctcctcgagtcgtgcgcctccttccgccgcctccttcagctccacgcgctcctcaccgtcacgggcctcgccgcgcaccgcttcccggcgtctcgcctcctcgccttctgcgcgctctccacgccgccgcgcctcgcccacgccgccgcgatcctcgcccgcgcatccccggggcccaacgcctacatgctcggcaccatgatgcggggcttcctccgcgcccgcctccccgcccgcgcgctgggcctcttccgccgcgtcgtccgggatcgcctccccgccgacgcgcgcacgttcgtcttcgcggtcaaggccgccgccgccgccgccgagtcggagcacggtggaaccccctcaggcggcgaggccatccactgcgcggccctcaagtgcgggttcgttggcgagagcgtgctcgtggggaacgcgctggtacacttctatgcgaaccacaagtcactggatgatgcaggcaaggtgttcgatgaaatgcctgagagggatgttgtctcttggacgacgctggtggatgggtatgcacgggcagggttggctgacgaggcatggaggctgttctgcaggatggttgttgttggaggcatgcggcctaacgcggtgacgctggtggctgctgtctccgcgattggtcagatggggttgctagcttttgggatcatgctgcacaagtatgtcacagagggtggtgttgctcggagtgtcaatttggataatgcgctggtggatatgtttgggaagtgtgggtgcgtgagatatgcaagggaggtttttgatggcatggaggttaaggatgtctactcctggacgagcatggttaatgcatacgctaagtgtggtgatttggaaagtgcagaacagctattcaaggatatgcccaggagaaatgtggtttcttggagttgcatgatcgcagcttactcacagttgaatcaacctgaagaagcagtatggttattcagggagatgattgcagcaagtgtggatccaattgatgctacccttgtgagtgttctgtcagcgtgtgctcagttaggttgcttggatcttggcaggtggatatatgagaactacattgtgagtaataagattgggcttactgttaatttaggtaatgcgctcattgatatgtttgcaaaatgtggggatgtaggtgaagcatcaaaattatttgatgagatggcagagaggaacgtagtgagttggaacactatgatcatggcccatgccgtgcatggtcagtctgaagaagctattcgtctctttgagcagttgaaaggagagaatattgtgcctgatcagatcactttcctgggattgcttgcttcatgcagtcacagtgggttagtttcggaaggacgacgatattttaaagaaatggaaatgttttataggattgaacccagggtagaacattatgcatgcatgattgatcttttgggtaaagttgggcttctggaagaggcatttgaagttgcaaggggtatgccgatggaagctgatgaggctggttggggtgctcttctaaatgcatgcagaatgcatgggaatgtagagattggtgcatgtgttgcagataagcttgtagaactggatccttcagacagtggaatctatgtacttatgagccaaatatatgcaagtaaaaataaatgggatcaggtgaagatgctgagaatgacgatgagagatagaggggtaaagaagaatcctggctgtagctctatcgaggtcgaaggaaaattccacgactttttggtggcagatgtttcacatgcatgttcagaagaaatctattcagcattgaagaatatttacttccatttaaaacaggaaggttatgttcccccaacttgactgtgctgaaaactccttgttcttcgtcattcatgaacctcttaatagccttcactgtagaaggaaaaggaaattctaccagaagacaagattttactaatctaatgctcagcttcctgctgacagacttttattaatgccctaccttacgttcatgaataatggcctggagctgagctggaagtgagataaaatttgtactgtcttcatagaggtatatgtcaaatgggcagaaaaaaggtagtgcaaatctgatgaaggattgcatgtactgtcttcatagagatgtatgtcatgcgatgaggctattcttgatttttgtaagatatgtcatggcaaggaactatagggaacttgattgaacccaggtttctttcttttcctttttcttataaacaaactgtaagttctcattgaggttcttgttatctctgtttttataatgtaaacactctgtttattatgcagacagttttagatggcattgctacggagcttttactgggtgaaccagatcctctgcaatccccttaattcacatccaggaaagccttcttgaggtgatcagttccaggtatattgcatgagatttttctactagaatggttatgaggatggaaaccatataactaatgctaccgtatgctgttcccccatttttgtgtgataataaatgcatctatttggcatggaaaagaaccatacgaaattaagaatcaacaaactctgataccctgtagcattgatatgtttagggttaataattggcttaacgattacaaagcacactgatggaataatatcattctgattctgtgcctgctttactgttctgcttgaaggtgtgcactgatcatttagatactttgtaaatgccacacctgtagagtgtagacttgtactttactgactgtttgatattgacaagaccactcatgaatcgacttctcattttctcttggaccattagtgcagtaacaatcgtctagtacctctgcagtattagttggttatggctgagcaagttcgttccagtcataaatgtgaactaataagctgttcccttctctgcggtgacctagattgtgtacccctgaaggcctatccagattcatggatgtacaactgaaaccacctaactttcttgccaacaagccgcttaatatggtataaacgccaaaaccccaattgaatgctgcctttgcggcgtatttacacccatctccggtacattgtggcaccacagatcacttcacagaaacatgtcaaccattcatgggttgcaactccaggttcactgtgcacaatttaacccggcacatgttcactgctcaccaccaccaccaccatctagctcataaatcatcttctattctgccacatagatgaaacacctagcttaaaatgttctgtgacaaagaaacagaacttttctacctagagccaaaggtgtgagagcagatgatccacgccctgattgctggggaaataggcgatgagaatggtaggccgtgtggtgtactggcctgacgacctgcttggacatgtccacatgaagattggacgccttgccttccctgggggagtgccctggctttagtttctcaggactgatgtatgcatagctttgcgatctgcacttgcacactgcaacaactccctccctccccacctagctaggacccttgaactttttgctagctttatgcagtatcactgtagttcaggctgttatcctctcgagtcagtgcttaaacccccgtgtgttttggggatgggaggcaagggaaaagtgatcggatagaatgtgctacaaagggagtagtaggtgtggcattcatggccctcttcactcggcccaaatctaccctctaacagtttgcattcttgagccatggcagatcgacagtcatggcctgcttgcctcccgctgcggcgccgaagagctcggcaccacccttccttaatggagaagacgagagcaaggacgatacattcactgcccagctgattgcctcagtttcattgaagccagcagagcagcgcagagctgtactgctgcgcggtgcagtgtactcggatcctaagccatggcgatgctgcacccgtcgtcctcttctccaagctgcaacagtaagtatactcgcacatatagtggaaagcattcatctctagtaactagctagcacatctatcaccattactattaactaattgattgattaataataatacatttatattgcctcctcctcaccctcaccattctatgtcaaagtccctggattaacatagtgatcaatagtccttccctcaaacagtactaattgcccacgtgctactagggttttttctttctacagccacctgccctttgagcacgggggcatgcatgcaagcaagcaagcaccaactgctagctagactgccctaatggagaaggctcaaggtctccagcggcttgacggcgtcgagcttgcggtgcggcagggccggcggcggtggcgccaacggctgcacgaacttgcagttgggacaggatggggaggacttgcagagcatgacgaggaggtggcaattgacacaaggcacggccaccatgttgcctccaggtccagagctgacgatggtgccacccttctttgtctcctctgcaacaacagcaacagcaactggagtagcagcagctccggtgcttcctccatcgataatggtggggacgacgacgacggttggctgggtagtcgagatgttgagctccaggttcacgctctgctccttgggcctgatccagcttttcttcaaggtcttcctgttcaggtaatacatccttccagactgacagaatcatatatacacatggcattagaaaagataaacaacggggactattacatcaaatgataagccaatcatggcagcatcatatcatacaacaagttttgcatcttttggacgttgagcaagtagctagatatcacaagtggcatcatgcacgttgaattaagctgcatgcgttgcccaccaatatccatgtgggtgctgctggtctatctagttgctctgctacttctgccagctcaatattacgtcagtttcacgtacgcacgtgccatggcggtggcaggtggacacttctaagaataggagttgcacgccataaattatatatttcttaaaactattgtttcagagccaggagctatagcttgcatcaaggcataaacacacgacaagataagctaattataatactatatatgaagtataatgtgcaatgtatcatgcttatacttaactagctagtagtaggaatattacaatcattaacaagtctctgcactaaattgtttttcataactatatgtttagatgttagtgtgatggagaggaactcacttgcaggtcaaggcactgctcccagtcgaggggcagggggtcattgagctggagctccaggttggcgtgcgacacgggctcctcccaggtgaagtgcttcctcttcttcctggagctgccgtctgactccgacgatgagctcttggtgctcttggtggtggaggagacgaagcctggcgccggccacgtcggccctagtgagagctccggctgcagctccatcctcttcacactcaggtacttctccactctaaggaattcagtggtcatcttggctgatgatgctagctcctgctcttatatacacacacaagtagttctagggtgtgagctcttgagagctagttgtagtactaagagatggaggagaagagaattcagtggagggaggggggactgcttctcttctacaatgggcttttgattgatggggtcatgcaggggagggcgtggacactaaagaagggttcttaaatggccttcatccaaccccattaaggggagggcaggccgggcattgaagatgacaagtagagtgaccttaaatgactcaaatctctccacctcctccccatttaaggcggccttgcgctgctctacatgcccggactgtacacgtcataatgccacacccagcccaggagagccaccacaaaatctacaaggccccttgcttgccttgtaagttgttgtgtagggg

SEQ ID NO: 4781 - DNA, 710 bp, Oryza sativa
aatagtttctccactttgcttatgacaaataagaggacatactgtttactgcttactgaatggcatacatgagatctttgtagggtttctgttgtttgcaatgatgatgtcaagtagatcaagaggggatccttgagaccggcagcaagaaggaagctggggactcgcgggttgatgggagattctactaaatataattcaattgatctggttccataagctgagcgagacgaagcccacatgttagtgacgacaaacatgatagacccacctgtcagtggcagtgtggcaccacgatgggcttcaacagcgacaggtgaagtatatatctaattatctactccctacgtccataaaaaactaatctagtactggatgtgatatatcccactatgaatctggtactaggatatgtcacattcagtcctaattcgtttttttgacagaggaagtactaccagctacatcgaaatcagcttccgatgtcgttatctattttccgaagagtgtttttgcttgcagaccagacgatgatgataaaacatgctcgcatgtgtgcgtaaattaatatggtccatgccggacggcccctgcgtgtgtgatgcggtgcggtgtgttgcacaaattgaaggagctcgcctatgttgttgggtggcgattggcgttggcccccccattccgaggcagtgaatggatggacggacaggcag

SEQ ID NO: 4782 - DNA, 795 bp, Oryza sativa
  unsure (1)..(795): unsure at all n locations
nnnnnnnnnnnnnnnnnnnnnnnnnnnnnnnnnnnnagcagatatgaaactagtacaagtgatttatggaacggatgattgaaagtctcatgcaaatcggtaagaatcatacattatccacaagattattgtgccgattgtgaaaatgctgatcaaggaacttctctgctcggaaggctttcttgcagaaaccacagcgccattcatttatatcaaagtgaatcttatgctgctcctgttcccgaaacatgtcattaccaggatgaagtctacatttgcttgggagttcatatttctctttttccacaaagggcatcaaatactgcatagaaaggaaatgttaatctgtcatattattatagaggcaccaatgcactgggcattttcatgttacacatgctttacctcatcaatagctttccaagctgcacggcttctttcccttgagcaatgcacttgatttgtgtgttcatgtgacataagaagagttctagaatcaagttaaaaggacagagggtcatgagtcaagcaagagcgttttcaatttccattaaggcttccaggaatgaactactttaggaattaaagaggacctaatctcggcaaggatcttgcttgtagtgtcatgccttgaaagggccaggtacaattttgggagggactaggtgagggtcttattttagaaattagactggcatgtataaaataaaacattaaataacatattttccttcatatgagtttgggagcttaagtacctcggatccagcagcttcattgaaattcctatagcac

SEQ ID NO: 4783 - DNA, 5235 bp, Oryza sativa
  unsure (1)..(5235): unsure at all n locations
gcctgcaggtcgactctagaggatccccnnnnnnnnnnnnnnnnnnnnnnnnnnnnnnnnnnnnnnnnnnccacagtccagaacaagagatgaaaaaactgttaacttattccaaatgttatttgctgatttttattggaatcagatcctgcttaaaattcatgttttcatatgtagctcaataatgcaccaaaaagttcagaatcctttttgttttgtgaggagaaacccataactgaatcaatcaaaggtttccaagttaggaattctctcaccctgccacctttggggaaaggtttagagccattcttgcatgtgtgggcatcacagaattggcgcaagagaaattctgtgaaacaagttggataagcaagaaagctacacgagagtgctatgaggacagataattagattcaagtagtgctcagttgctcacttaccatgaagacggctggcagattgcccttgattaataggaaagcaactatctgcaaggctctattagcagaagcaaaactgagttagataatttccatcagtaggccagaaaatgctcaatgtatatcacatctattgtttaaccataagaaccaaggtagcaaactgatttatgaaagataaaggacacagaaaacttcaataccattgcaataatggattaaggtaaatacaaatagtgcttataagtaaagcatgtacagcacccatagtctgctcgttgattaggggatagataagcatgaaaatctctatccaaaggtccctcattttcatctaattaacataacaagtacaccaatatgcctgcatgcataatctggtgcttctcaacaagatcacagcgcagaacaatattagtttcaaaggaaaaaatatgtcacataagatgagaatagctaaagacaaaagttataacatatcaatgatgtgtagtttatctaatgcaatcctcgatatgtagagcaggaaatgggaatagtaatatttacacacaaacagtccaagataaaaacaaaatgcaaattagtaatagcagaacatgaatatgcttcttgatatgctatatgaatataatgaaatcaaacaaataaatggatttagaatgtccccggaaaaaaatggatttagaatggttaaaacaaaaggataagaacctcacaaagatgacgattccttgcagctgcagttgcactgcatttactctttggtttcttaaactccaacatcagatcacagtgaagtgctccacatagatcagccaagcatcttccttgactctaaaggagatagtgtaacaatcagcatttctaagcatggccaatcataatgaagaaacaaaaatagattaaacaagttagatctgcactaggagatgcattgccaagaaaatcccacagaagactgtctcgtgtaaatagttataaatggaacttcgaagagccttgaatttgttattttctcaattaatgaggaagggaaagaatataatcacacttgtggcagaaaccacacaggctacaccaatactatcaaagaaagaaagcagatatgaaactagtacaagtgatttatggaacggatgattgaaagtctcatgcaaatcggtaagaatcatacattatccacaagattattgtgccgattgtgaaaatgctgatcaaggaacttctctgctcggaaggctttcttgcagaaaccacagcgccattcatttatatcaaagtgaatcttatgctgctcctgttcccgaaacatgtcattaccaggatgaagtctacatttgcttgggagttcatatttctctttttccacaaagggcatcaaatactgcatagaaaggaaatgttaatctgtcatattattatagaggcaccaatgcactgggcattttcatgttacacatgctttacctcatcaatagctttccaagctgcacggcttctttcccttgagcaatgcacttgatttgtgtgttcatgtgacataagaagagttctagaatcaagttaaaaggacagagggtcatgagtcaagcaagagcgtttccaatttccattaaggctccaaggaatgaactactttaggaattaagaggacctaatctccgcaaggatcttgcttgtagtgtcatgccttgaaaaggcaaggtacaattttgggagggactaggtgagggtcttattttagaatttagactggcatgtataaaataaaacattaaataacatatttccctccatatgagtttgtgagcttaagtacctggatccagcagcttcatgaaattcctatagcacaaaaggaatattcagattagctagaataagggaattaggtgttcatcttaaaatcaaagagaattttctagtagatatagcagcaaattgtaatttgcactgtaacaaagtaaagatttacttatttcgtgtttatcatgagaagcatgcatattcatatcctgaaatgtcatttgcttatcagctaatacaaataacagtgtgctgctttctaatagaatgtagccattgcaagtatatgcaacaactcaaaggaagtgatgattgaacataggatggtatatcaaataattgatggcagtacgctgcacacctaccataagaacttaacttcacataaaaaacatgcctactcaacatgcacaccattagtatcaacattttactgaaataactagtagcagggacaccagagaaacgtttacatgcaacagctctcctttttgttttgcataaaaatactactataataaattaccacggcgaatttccatctcacaatcaatcgttgcaagaaaccacgacggacatcacaaagcaaattatacaaggaaaacaagtcaggtaagcaaatcatatcaacataggcaagcttgcaatgttccctttaggcatgaagcaagacaaagaacaaatctgcagatagactagctgatgcggacccaacgccaattaattctcttaatggaatgaatgacaccgtctcacgtaatgctcacaagttgagcccaagctcagaatgttgaatcatttcatttatacttatcaaatcaaagtaacctaaagcttaattctacatacaaaagaaaaaacacctcttctgcaccctgaaataacaggaactgaacgtacggatctctaattcagcaagcaagaagactaccgatccaatccagcacaagatagatatatacctggtgtgatgccgccgcaacagctaaaaggcaggaagcgaagaggacgaggtacgcggcggagcgagagcgaccaccctcccgactgggatcctccaagcttctacaaccttgtggagaataatcggaggggacctcaggtacttgttctcactgtgattcgaactgaaaaatcatgcaggagaggactttcttaccagaaaaaaggggaaatcactcactccgagctatcttggatggatctcccgctccaccccaccccaagtccagtgcagcagaggggagtaggggactgtctggagaggaagagagggagggggagctgcgggcttcgattcgaagcggcggaagcagccaggtcaggcgagcgtgctccggcgggaggatcgccggcggccggcggcgcgagcgagagaggcggagacggtggaggggaggaatcagctcctctgacttcagccctcacgacggcagagagcagtcgaggtcatccagccgtccacgttcgatcgaaccgtccgcccaaaaagcgcacggccgcgtcgtgagtctgggccaaggccggcccaacaagccccgtccccgtttggccgccgccatcgcccagccgtgctcgtactcctcgtctggccgccgccatcgccgtcattcttgtcccccgcgccgccctcgctctcgccgtcgtgctcgtcctcctcgccgcccgcgctctcaccgtcaggctgcagtactcagctgaggagatggggaccggaaggtgtgcaagatgcagcgcttggtcacgggcacggcgcaccggtgccacgagctcgatgtgcgtgtgccgagctcgagcaggccatgcgccgcgacaggcagcgcgcggcgaatggaggaggggagcgagtggaggaacatagcggcctcctcggcagtcagggagaggaggaactcctcctcgccgtctctcagcagcgagtgagtggaggaacacagcggcctcctcttcagctccttaatgctgcgtccaggagtgttgctttgttgtatgtcaaaccgaatggcattctggagatactgaatgtgcagttattagaatgatagattgttctttacacaggcagcagaccacttgttctgaaaaatggggttgcatgtgttctgtaatttgtatagaaagcaaaaaaactttgtaaattgtttgtagtgagaatggcttgtccaacaaaatgatgaaatggccatttgtaacttatcactgcaatgaaattatgttccaattctgggcatatggcctgttcaagagaaccaacagtttttgtcccccaaaatgcttgctatctgctgtccagtaccaagtgtatatgacatactaaactgtacacactaaccacaggcgtgtgcattcagttaataaaaaagactgaaggtgctcattgatccggcatagcgtcgtcctttcagaagagccttgccatcagaatcctcttccaagtgctcaacaccaatcatgtcatcccctgcgttcagcacctgttggcagtggtgaatgggggcatctgcacatgttcagtaacaaacaagggaggtacaaccaatggatgcataaatgctcaccttgcccaaaagatcaagctgttcatcaagcgtgccaaaagaacaatctcggcaggtgccgcagcccgcagagaccaaaagcctattcaccaaaaccaaactccattgctagaattcaacatcaagatcatcgacggttgctccctgaaaaattaaagaaaatttaaactctgtcgatgttaatactaatggatcatagcttcgaaatattaccgtcaatagttgagagaaggtgttgatggccatgtatggttcacacatttcttccatgggcaaagaggtactaggatatatattttgccctgctggattgtcatgtactgatgcttcttttccctttttcttgcctcccgtctttgcagccttttgttccttcaaataaaagaaataaaactgagcatgttcccattgaacagtgaaagagaaac

SEQ ID NO: 4784 - DNA, 4191 bp, Oryza sativa
cccagatcgatcaatatctgtttttgctcaaattaagtaccattcaaaactgttcagaatgcagaggttggtctgtctgtctgtctgtctcttgtgaaaagaatatgaatcagcagtggtggaggtgagctcagattggaagtggccaaatactatgcatgaattcggcaactggtaaattttcttgttctttcccctcctttccctattcatctccttcgtttttgacacgcgctctttccaaacttctaaatagtgttttttataaaagaaatttctaaacgaaagttgctttaaaaatcatattaatttatttttcaaaaaatagttaatacataatgaatttatgtgctaatgagtcactttgttttgcgtgcgtgagggattatttcctaacaccaacaaaagaacacagtctaagtgttgttgcttagggcaagttttatagtagagatgattaccacatttaatttcgtgcatgacatacaccattaaattaagatgtgtaataagttacatctactatacaattttcaatatctctaacactcacatcctgtttatttactgtgcaattgcacaactgttgaccaaccattttcaagcttgttaaccagtaagcactgctgcttatactgtgcaatttggacaatcatatccatagcgtttcgtcgggacaatagagcagagctctctccatactgattggacgtttcagacatgatgaactcttcttgttctcacattttaccaggagttccttaattacacccatggacttcaagaccattaatttatataatatgcgccatactattacacatgcatgcccaatcatcgcagtgcatgctactgcttccgatttggttccaagattcgtcatgcttcctgtcggtgaagtacaggaggaacttattatcttccactgctcatgcacatcatttgcgtagaccaacatatcaatagggttacgtgtgcacaaatgcagcctccagtggattataatccaaaaaatggagtaatatttttgatttttaagaataattttagatagattgttttcttgccttagcaatagaagtgatgaagataaacccgtaaacttgggctctgtttggataatgggttaaaaggggtgggattgggatagggatgagtggagggttgagatgaaacgagatacgtagaatgaacagttagaattaaaaattacccttccagaaggtgagataaggtttctccatcccattatccaaacatggccttaattctaaaataactttctaagatttcaaaattaggattatagctgagggctgatgccaaggtcctgtttgactaagatgataactgatggctgaaattgagtttatgataattctttgaggaaagttgaaaacatgttttaaaaaaaatttctaaggaacattaatggggaataacatgctagtttggtttgaaactaaattttgtccttataaaatattgctacctaaataaacaatattgatagtgtcaaacacttggcaaatttttcgtactaccatatttggtagagtagaactctctactacaaaattgaaaccaaaccattatttatataatactattataatgctaaaattttagtagggtaaaagttggcttcaataaaaaaaaaagggcccagcatccataggcggtgagaagaaaaaggaccgaatataataaatagtgcagcagtagcattacagatgaaccattaacatatatgcaaactagcaaaatactcatgcttatttgaatatatgttattcacttgattaaaaaatattattcactaatttgtaaaatacttcatccgtttcatattatatgactttctagcattgcccacatacatatagatgctaatgaatctatatacatagattcattagcatctatataaatgtggacaatgctagaaaatcttataatatgaaatggagggagtatgtaaaagttggtgagagtgaaccagtgacagaaacaacaatatcactattgtttttatagtagtatatcatatgaaaaatgcatactgtaagtatatactccgtccatccaaaagagttatacatattatttcgataagaccaataaaaaattaactcatctaagatgaatatgcatgtaaacaatcagataacttcttaggttctaattaaacatttaatttatctctttatttaagttttaagtacataaaaactacagatataactaactcatttgaaaaaaaactaaaatatcaataaatctaatatttttggaaggaggagtataaccatagtattatttgtagagattaatcggagtgggatgtaggaaggagaaaacgctccacagtggcatcaaatgagagtcataaatgtgggttaaaggtaattaacgtacttatgttggtcggcttcatggtaattaagtcggtaaaataaccttaattatgttttgtcagctctttggtcgctgttaataccagtactagttttgttgtaacagaagatcttgatttgtaaggggagacggatcaaagtttagtaattgctgggcctatgggccccagctgtacttctattttgcacttgacaaagacacatcggttgggaaactctgttgatagccattaatagatctctccctctcatgccacggacaaacaacacaaacaaactactccctccgtcccgtaatataagagattttgacattttatttgtactatttgaccattcgtcttattcaaaaaattttagatttattatttattttatttgtgacttactttattatttaaagtactttaagcacaactttttattttttatatttacacaaattttttgaacaagacgagtgatcaaatagtacaagaaaaatatcaaaatcccttatattagggacggagggagtataaaacatgaggacaatctcaatggtagtttcataggagtttcattctcaataaatgagacaacattgaagtaaattattgataaatgagataacattgaagtaaattatttcatttatcaattcaaaactttttaaataacatggcactcttggtaaccataaaatgaaactccccacgagaaatggcctgataaacacaagtattttttagataatggaatataatatcccggcttttactcaaataagcacaagtaggacagaactctcattaagatgtccagtgtgaaactaaatggtaagaaaatagatccaaatgaataaaaggaaaatgaggtatactagaacttaagaaaagggtgatccaaactaaaatttacaatattatttactacatgcatataaaactataggaaaaaaaacttactaggatactttttctaattttgcttgagttcctctaattcatagaaaatcaaagggaagacaactactatggcagatacattttttcccaatgtggcttatccgtatgacggggcgtacgaatctcaaaacaattaaccaacaacatatataaataattactgcgatagctagtgcagcattagacacttgtttttcctgttgtgtagaaaattactcaataaaatcaagaacaacctgatgttggcatttggtagcaaccatcttcagatatcgatcgtgactttagaaagataagatagcgaaagtacaatgggaattaattaatgtttccaaatgttgatcgtcgatcgcaatcatgaattcattcatatctgccgatcgaactaacgacagatcgacctgcacaacatttgagtgtcttaaaggtgacaggccaagtcagcattcaacagttcgtcacacgctgttcttattcggtcttctaggagcaatttctttcactgattagaatcaactgtacgtagtaattaattgtgaaacattttcattgtgccattcagatcgaaattttcagatatctccctttaattattaggcgctacatgctcatcactaaataatcaacttcaggtaattctacatgcatggtttcgagttatttcatgttcgcaccaaattataattaattcatgtactaacttcaaaggtctagaagtctatagtagtatagtagatatacatgcattttttttaaagttaattaatggatacaacccaatctctatatccacagggcaaaagatacacagagttataagactcgtg

SEQ ID NO: 4785 - DNA, 7828 bp, Oryza sativa
tagtctgccctatcgttaccgcaccatctctgccattgaggatctcatccaccaaacaaccaccatccaaactcactgttgtgccgcctgccaaagtcgaatcccgctgcggatgctgtgagggggagctagctcgcatgtcccttgtgctcatcgacgtcactagcaccaaactcttcacatgctgacatctactagtccattatctccttgatccatgtcaccatcgctagttgtacgcgatggtgctcctagctcatcaccaaatcacattgtggccgtgccttcctcccaccgactttcgcctcatccgccattgatgccctagtccaagtcatcgtggcaatcactggcgctcctagcgcaccattaaagctaaggcacagccgaactggatagccaccaccgacatctcccacctctgttgtcaccaccatcaccgtcatcatcgtccttagtcttgtcgccgtcattgtgcttgtcgtcgctcctagcgtgccgtcaagccaaccaaccaccagcacgaccaccatcaccggccaacaccaccctggcccttgtcgccatctcagcatttgatagtgctcctagcatgccgccaagctgatcaatccaaatgaggccaccatcaccaccatccgctgcctctaccatctccacagcaccgcagttaccgtccctttcctctggcgcctcctcaacgctctctggcgcacctagtgcgtcgtcaagcagtcctgctaccatctcccccattgaccacagccactactaccactgcccctgtcgccccaccagatccacccacactagcctctagatccagtcaagccactattgctggagccaagatccgtgcaagccaccgccgtgtcgcctcctccaaggaacggagcgaaggaggaagccccaaccgccctcctggcggacacacgcactctgacaccccgctccagtggcagcgaggttggaaaatgggtggcgccagctaggttgaagaaggagaggagccaaccctttctctcctctagcatcttcatgcatactacatgcacgtgaagctctgatcaatttggtttgcattaatgcatatatagggggtgtttagatccacgggtgtaaagttttggcgtgtcacataaagtattatatagggtgtcgcatggggtgttcgagcactaataaaaaaactaattacagaatccatcagtaaactgcgagacgaatttattaagcctaattaatccgtcattagcaaatgtttactgtagcacaacattgtcaaattatggagtaattaggcttaaaagatttgtctcgcaaattagtcccaatctgtgcaattagttattttttagcctatatttaatatttaatataggtgttcaaacgttcgatgtgacaggtgaaaaattttaaggtagaatgtaaacagggccataataactcttgaggtggatcaggcatgtatatacgtatatgtcagggctagcattctgtgattctgtctactattatctgtagttctgtacaagtggggcaataccatacgtcactctgcttcctgatccaatacagaacaagctggctagatagacagtgagagcaaacagaagctattcagaacaaagccagtgagcaacatatagtcaacctagccagtgtggcttttatggcactgttcagcaatcccttctatgtatgagtttcagtgttcccaacttgatgagctgagcttagagcaagtttaatagtatagccaactactggctcaaatcatctataatcaattcaattaatatccaattcatacaatagttacctataacatatatgacacaattaatacctagtcccacttgtcatacacacatacatcttgaagcccgtgctacagctgactataaatctgtagcccactgctcttctctctactcttttatcttctcgaaatgtgtttatagcctgctattgtacatgctcttattatgcccaacactgcccaatcaaattgaacaaaacttaaggaaaatgtatttgtagcaactccacaaaattacaccacttttatatcattatcacaaaatcacattacattttaacttaagaggtttaagagagtttacactacttgcataactttcacaaaatcacgctgagccacttgccaacctgacaagcctatatatacatgttactctctctgttttatattaatattataagacagtttaactattttcgtagtcaaactttttatcttttctaaagtttatagaaaacaatagcaatatatagaacatcaaattagtttaattaaatagaactgaatatattttgaatgtattttgatattatgtttgttttgtgttagaagttagtgttgctatatgttttaaattatataaactagattaaatataaagaagtttgacttagaagaaaaaaaatcaaaatattttataatataaaatggagggagcagactcatgggaccaacaagctagtaggcatgaccattggatatgatatgaaaacagtaaaaattgtggtttttcataaagcattaagaaaagaagagtagtgttctgaaattattattcaaaactgtagttttgggatagtttttgtaaaatttactcaactgtttatagaaaactgtttatagaagtgtttgctcggcgcacatatatacaaaccataactagctattgtttaaaatattcctagctagtctatctctctctcttttttttttctttttgcacattaactatagccttgcgcacaccctatgaagacacaccagtagaccaaaagcttcataccgaaattgtgaatcctggctgaatggacaacactctcatcatctacttcttttcttgtcagccgtaacaaaaaaaaattgaaacttaatttcaaagttaattttggcttttctattttagtagagatactactaggagcgcagcacgctcgtattccgagcgccaaacatgtatcagtctaggtccacctcacctcacgtcccgtcatcccgctcccaccgttatcggaataagtgatttacttcgatgaaaacaacttccccctgcttctgatcccatcccatgtctgatcatcccgctcccaccattatcggagtaaatgatttattatgataaaaacaacttccctgcttccggtatatattctatttttcccgtaccaaatcaaccactctcgccccacttaatttttcctctttttttatctgaatcgatccaccatcccagcgcacagattggtgatacaccatggaggaggacaatggcaccatggcggttgacagcggtggctggcggcggttgaggcaaaggcgcggcttcaattctcgttgccggacgccggggaacgtcttaaccaacaaggaggtgttcacctgggccaagagaaacaactgacggctgctccatgtcggcgacattgacaaaacaagcaagtaagaaaatgacacttcaatttgcatatgcatactctccttcaccttcacgcatgaagccccaattttctttttttttttgcaaatcaaattaacgtgcaatctccaatattacctgatcttaattgataggctgcatagatccttcatttgcacatcgtgctccatatggctgtccacagaggatatggtggagttcgctggtgatggaggttgtttgctatttttgttttgctcgtcgtctctatgacatgaacaagaattgttttgcattcttttcgtacttgcttgatgatggatggctgctactgcgcaacgtcgagcttatctctgtaccacgctgctacatccttccatgattccattgtcgactaccgttcgccacccagttgccctctccactaccagtcacaagacacagaccaacctctccatccttatagcaagatccagcaaagtcaccaggataccagctccacgatgaagttttggctggatcattttttttctagtttgattagtaattttatcactcgtgtgtgattgagcatgtaattttttcattcgtacgaccattttgtgatatagattaccaatactcttagtatcagtttttgctcttatactatgcattgaatacaacagtaaacatattctacgagatcatgggctatatcaagagaaatgtggtaattgttttactcgtagaccacacagtctaaataatatttatatcactagtaaaagaattactagtgttataagctagtaataattcttttatggccatataggaatagtgtcgtacgatgtgggggcatttatgcaagtaaatttgttacttttaaagggaacatttatgtgattaaatttgttatttttgaaaaagcatatgtgggaagttaggagtaaatggaaaactttatatagtaaattcattatttatgaaacgtgggagacactagaaaaacagaaaaatcggaaagaaaaactaaacggtaaatattttactaaaacgagaaaacagaaaaaatggatagaaggaacgaaaaccggaaaaaactcgatggttaatattttaccatgccctttcatggagcacgaatgagatggaaaaaagaaaaaagaaacacggaaagtgtggggttgtaaaaaacgaaaagatgggtaaccgagcaaggtgggatgcggaggaaaggcgaggtggtaaaaaaaggaaaaaccgaaaggagggattattgtgcggcgctcgatctaaaattccgcgtatattagtaccaccgtttgattgctatgtttttctagggtttattatttgtagcgcaaccaattaaatcatagtcctctgggaactgcatgccaaagtcaccactcaccagtggactagggttggacgatagatcggtggcaatgcgtgggagtattgtccgctagctttgctcaaaacacaagtaaacgaaaatgtcaaatttcaaattaaacgtcgcgaccattcttttgttgtttttatatagtttgtacgtacactaaactttccatagtgtatttctatactcggaaactttcaagttaccctatttaatttcgccatctcaattaatcacatctcagagctaaggaatttaattaagcagagctgcacacacgtacagacctgatgaattgagagagatggattggatcgatcactgaattgaatgaaacaaggcaggacccatggatggatagaactcatcaaggccacacctgcactgagctgcggcagagcaagaaatttaagatcggcgagcagtcggtgcattcaacggatttccttccttccttcctacttggctctctctgatcgatctgatgcatacgatataatgcagcaaatgcatacatatatttcatcgatcgatctgctgctgcctgcctgcattgaactctcacaatatttcaggcatttatagatccatcctagctacccatccatcgcccgaataaatatacgcagcctggccaaacttaatgttatctgaaccatcatcttattaattatatgatgaatgcctacgccgacgacccccgtgcagtacggtatttggattcagatcgtacgtagtactacactctagatatttcttcagtttctttctttttatttttcatatattattagatccgaagattatttattagagctatatgttataagaaaattcagctgatgagatttcattaatgaattggtttcttgtcctcccctcccagccgttccaaaatataaacatttctggctatatgtacctggaaaatagtgaattggtgaggcatatgcatggtgttattagatctccggtatacatcttctcaggataaaaaaccctagctatgccctggttgcatcgacctaatcatcgtttatacgtttttaaggcattgagatatgaagaactgatatatgatgtttagccaaaaaatgtcaatgcaactttaattcattgatcggatctatagagacgacggtataacattaaagctagagtttcaatacatctttgctacacatgtacaaagcttgtatgaatggtcgatctctagtggtcttgattggggctattcatgattctttgtttttatataagaggatagttttaccattaattgagacgtcacacgctcttttggatttatattgttcacgggcacttagcttatgatgtgtaatatggccgtatgcatttctggttgggagaggccaagagtttatttctttatctgatctaaagaaatagctagaggagtaccgttacttgcctcgagttttcataattttcctcaacaattgtgattaactttgtctttatccagactataccactgagtttgttaattgtttctaggcaatatatatacactacgccggactaggtcatctctgacgggcccaaaccctcacctttgacgggtttggtcttggtcagtgattagtggtcactgatgacaaaatcacatgtgacgggtgaaacacccgtcacagataacccatctctgaccggtatataagtcatctctgacgggttaaaacttgtcacccgtcagagatgagtcatcagtgagtcacgacactgatgactcatctctgacgggttgtaacttacgacccgtcactgatgacaaagcaagaaatacattttttgaattttaaccccaccaaaaaccctcaaaaaaatattttgaattttaatagccgtcctatacatggttacacgttcatcagtgacgtgtcgtaactacctgaccgtcactgatgactcatctctgatgggttgtaacttacgacccgtcactaatgacaaagcaagaaatacaatttttgaattttaaacacaataaaaaaacttcaaaaaaatattttaaatttttatagccatcctatacatgtacacgtcactacctataaattcacaatttttcacgcaatataacttgcatgctacacgtgagattcaaactcaagacctcaacctccatatagagctctcttaccaactcatctactcagcacatattgactactcacctaatgttgttattttttctatgcttgtctgaatcatttaacatatatttaacaccctaaatgacttcaaatgaaaatattatcaactaaatagttatagatctcatcgtgttttataacttttacgtagaaaatatcttcatccgatgttgtttgaagaattcaaaatttcatttttcaaaatatctcactttataacatgtattttgaacatgtaaactttgtgaaatgaaaatattttcaattataatgttgtagatctggttgagttctatgactttgatacggggcatgtatccatccatgtcatttgaaaaaaactcaaaattaatcttcctatgcacataattaatcttcctgggcacactaactagcaaatgtcacgaaaaattctagaagaaaataaacatgtaatcctaatagtattatacatatatgcaaagtctcatattaaaattcatatattttagtcataataaaaaattacgaaatctgaccaatccgtaacaaaaatgaaaaatctaaccaatataatgaatttgattaagagactttgcagatgtgtaatactattagaagtatatgtccattttttaaataattttcatgatatttgttagttggtgtgaacagagtgtgcacgacaaatttgtgtgtgtaggatatgttgcgttgtttctaatatgtccacgatgttggagacagaatgatcactactggaaaactgatctttggagggtcatgtaaaatccacattagtcctggttcgagtaggaaccggg

SEQ ID NO: 4786 - DNA, 758 bp, Oryza sativa
  unsure (1)..(758): unsure at all n locations
nnnnnnnnnnnnnnnnnnnnnnnnnnnnnnnnnnnncgtattacggtgtcatcgacaacatttgggaactagagtatggacccctgaaggtccctctgtttcggtgccaatgggttaggctgactggtggaggcataacgattgatgacagcgggatgacaatggttgacctaaacaaggtaggatactcagatgaaccattcgttctagccaatgatgtaacgcaagttttttacgtgaaggacatggatagcaaaccaaagaaggggaaagggcccgatgagccaagacgccatgttgttctctgtcacacccagaaatttagcccaaattttcagacctttttgtgtattaaatccctgtccaggaccagccagtgtacacaaaacgacaagtaatatacagttccaaacgtaaataaagcgtaaaatacttacagaagaggcacttagtcctcacaccgaaacaaaagcagcagcagcagaaaaagacgatcctagcggggcttcagctccactccacaggcaaaactcaactggggtctgagccttggtcttctaacctcgtcttcagctcagaagcactacacttctgaaaagggggaataatagcaagactgagtacaaccaccgtactcagcaagcctcaccaacaatgcagacgtgcaaggggacacaaggacggtttgtggctatttgcataaaggcagttgtaaaacattttattgagcaaacactaaaactgttgagtaattaagg

SEQ ID NO: 4787 - DNA, 1632 bp, Oryza sativa
  unsure (1)..(1632): unsure at all n locations
gtcttacaaggaaatcattatacccaaaagtcaacttctaaaggagtaatctatttaaagaaaaatatgaatcacttctatctgaacagaactacgaatcactgtaccacaaagtaaacaaaatttctgtagtactatggttgagtttatacaagtctcttggagcatcgcaacctgatgcttgttttgaaacaccatgatgagtattgtcaagataatgtagcctgggagattacgttgcggtgttcctgaaaaaaagctaatctcagggaaattagaaaatgtcatggactggatcacatatataaaatgttcgtattcactactatgctgatctggtcgatcctctaatcctgtcttcttcaaaattgttaatgatgaacttatttcataggaatgaagtttcaatttagttgcaactttaagatgcatggactatgggaaacattgctaaaatttaattgaaaaaaattcagaacagtgctatgactacagtagagttttaatagaaacaggacataaaaagtcgattggaaaatttatagaattccagcgtatacattagagattcaattcaaacatgaatttatagaaacagtactacatgcatgctcaagtttccatatggtttgggcaatcaatttctagtagtaatacctcctaatcaaagatcttcaaaatcatgatctccttgacattccatctgaaaccagtgaacctatcaaataaatttaacaaaagttaattagcatttctatgtattataacactatattctgcttttcttttagaagaaaaaaaatgttgcataccggatccatcaattgaagttgtggttgtgtgggatggtcctaaggcatcattatcatccatagcaggaggtggaataccagcaagtttggacacgacactgcgcaaccaatcaagttgcttttgttgagattcaagctgattttgttgtactgcaagctggttttgttgaactgccacagtttgttttgtataagccaattcttcttccatttgttgataggtgtttgctgaagttgatgaagctcttctattaggtttcggaccatgacatctccctctaatatatccatatgccttcccaagcaccttctcacaaatttgttgctctgtcagctggattgcaccttcttgctcattttcatgctgcatctgtaacattgtttcctttatacaaaaaaaaaatcaaaagtttttgttagcacaagaagacacttaactatagtgaaaatgactcgttagaatgatacttacatagttctgtctagcatctcttgacgcccatcctttgtcactacaatagcattccttgtacaatgagatttgatcacaactctgccaagacataatatttacttaaacagatgcttacgaaaaataaatcataaggaaaatagatgaaatttagcttactaattcatgctgaagtgccacaaatggtttggttccctttttatgaacatttgccagtttcatccgattagctttccctataactgattttttctgcatatggcaagaatagccaaaggaannnnnnnnnnnnnnnnnnnnnnnnnnnnnnnnnnnnnnnnnnnnnnnnnnnnnnnnnnnnnnnnnnnn

SEQ ID NO: 4788 - DNA, 1056 bp, Oryza sativa
acacaccacatagcaaaatatgccataccaaagtgcacatatcatcgcacattacttgcaattagtttttccaaaatatcatgccatagtagaccacaaataaccaatttcactagcaggttgacaaatttcaatccaaaagtttaggtggtgttgcacttttcttcttgcttgcgagcttttttctgggtgtaagcttcttgggtggctccactatagctggagctacttgagagctttggtcaagctccaatgccaacctcctggtgtttgtgatggtgtaaataataaaagaagtttagttcagtgtataataagtaatgaaagctagagaaaaatgaaaagagcataatggtgcttacctcctagtgactggtccagggctgcttgtttgtgatggctgcacttgtgtttctgcagctccttctctagctgtaactgctcttgttcttggtgtagttacttgttcatcactaacaccctttgatttcttccttcccacctttgttgttgttttcttgttcctcttcctgccaaaagaaaaacagttagcatataacagcaagaaaatgaataataattgagatgaaaatacagcacacctctttttggtgccagttagttcacatctagcacttcccttcctgtgtccaaagacaccacattctggacacttaatttgccttgtagccttccccttgcccttctcaagagcagatgggatcctattcttcctttgcctacccacttttcttttcttggacacaggagcaagaagcttgaattctttctcaacttgaggccattgcttcttgtcttgaatgttagggatggttgatgcatatgctgcctgaaatctgagcacagagaaagccttatcaacatatttctccatatttgggtgcctcacggttgtgatgactgccaatgcatgttggcaaggtttcccagtatcttgccattccctgcagggcaagtgctcttgtcagagtacaccacatgccttgttagctcctcatcagtatgtatctctgtaacgtcagcttggtaaggatc

SEQ ID NO: 4789 - DNA, 5642 bp, Oryza sativa
gaatcaaaaagaccaaaagccaatggaaacatccaattatgcccatctattgcattggctgcaggcatgtgtccattccacattccattgagagcagtagaatctatactaatgtatggcctacagccctctaagaatccatctatgcaagctttgaaagcacaaaagaatctgttaaagtgaaccttatctccaactctaactatgtcaatctcaactacactaccaggggatctcatttctatctcagccttgaacctatacaaccaatcaaatgaatcatcaaactttccaaataacttatctttagccctctgcaaaccataccacgttgtctgatagcctatggtggtcttgtatgtctcctgtagcttaccttgaagttcctttgcacccatgtctttcttcttcttcaaaaatggaatagccctttcagccacccaagcttgagatgccatcttcccaagaactctgcttcttgaagcacaatgatgatcctcctcatttatttggatctgcacaagtaaaccatattagcaacttattaggtaaacaaaatcaatgcatacagcataatgtacaatttaacaacaattaaatagttagtataataccctgacacttttatcagcctgtgtctttgctctgattttccatgggcaaccatttgcagaacactttcctcgaaatctatctggatcagatttttcagtctcaagctcaaactcactaacaattgcatgctgtttcactgccattctgaactcattcattgatggatactttgtccctacttccattggtggatcatccctatcccaaacaagttctgggtcagcaggtacctcatcactaactacaatggctgcatctatcatatcttgttgaatctcaattggaataacagggagtgcagcttcttcttgtattgctgttgctgctgctctctcatctgtttttttgaaacccatagcatcaaatagttcatcctcatccaacaatgcatgagcatcaccatctaagccatccaaaatgattgccaacttactccagtccacaagagcagctgagtcttctacatttggtgcatggttacaagtgtcaccagtatcttcttcattggtcatttgaactggagagcaaatatcaattgaatctgaatttatcacaccacatctagcaattgactgaccagttggttttgcacttatcacactaccttcagcaattgatggaaccccaagatctacacttaaaacactagtgacaacttgagttgttgactcaactcgatctacatagctttcagcaggcttgtatccctttttagtaaccacttctaccccaagatataccactttctctttccacccagactgaaaccacttctcaaactgttcattgttggttaccttccattcagtcccactatcaaagtctaatccccacactacaatttcttggctaggcccccatattaccttgctagtcatatcatcacagaatttatctaaactataacctttgcatttatcaacccaccaatcatgctcttgctctgacattgatagcaatccatactctaagtttgctacatatgaagcacatttaacaacaactctaacagcattgccaggatcaatcctgacaaaaaaaatggagccaggatcaattctaacagcatgctgcacacctcacacaaagtcaagagaaggggaatacagagaaggggaatgaatttaccaaggaggacactccgagggcttcatcacgatcagatccacttcacctccgccagctatacgtcccggatgaccggccgatgcgttggcgtcgcgtgcaggcgcggtggaggggaggagctagcggggggactcgccctgccgctgccggctgggtcgtgagagccggccgcgacgcagtggcgtcagggccggcagcggggcggccgcgtgaggctcccgccggccgcgacgggactcgctctgcgtcacgcagtagcggcctcgccggccggccggcgcgtgtgggttccaggcggcggcggcagtagggttcaggcggcggcgccaatagggatccaggcggcggcggaggcggcgggggtttcaggcgcaccggcggcggcggtagagtttcagggcggcgacggtagggtttgagcagctgtggtcgagagaaagagatggatgccgatgcgtttctgtttccccctgttttctcgtttctgcacaagggcacaaaggtgatttcgccaggccagtccacattggcatgatgatgtggcgctccaactcagcgaaagtggcaaaaaattaggatgtaatctctctctagtggcaaatatgttaggccaaatctaatagtggcatatggagagttggcactcataagagtggcaaatagttaaatttcccggtgtggaccgtgtggtgtggatactctcgtcagtcatggcaagttttcccttcggatgcgactggtcaattggtcatgccacgcatgaaattcgcgcaccagtgtcaatcctgttcctgaggtcagcaatcaaaaattattgaccaaagaagatcctacttcctagggtagtttattttcggattggttattcaagtttatctttaacagcatatacaatagcagagtataaaccagctgcaaacatattttaagaagataaatgtggagagagaagtgaatcgggctacagatttgtagccagctgtagcacggactccaaaacgtagtgtgtgtataacaggtaggatcagatattaataagctattagattagctatatatgaattggagctagtacttggctataatattaaacttgctctaagggtcactttcaaaccgcaaatgaaaatggctacaccgtagcttcctataataacgtttcccaaactgtaggtccgtttgatataactctaacatttaaaactaactccaaaagtcaaatcgtacatgaagcagcctaaacttagcttcactcctagttaattttacgaaagcgcttcagtcaactctattcccattttagttggagctgaaatgttttaccgggcttcatctccagaaaagatggagctctagctggaaccgtgcccaacagatcatacttaacagcatattccgtaaaattttttatataatattttttaaaacaaataaataagttagtttttaaatttataatagctaatacttaattaataatcactccgtttctaaatatttgacgttatcgacttttttaaatatgtttaccgttcgtcttattaaaaaattaagtaattattagttttttcctatcatttgatttattgttaaatatacttttatatatacatatagttgtatatatttcacaaaagttttagttattataaaattaaacaatatatttatttgatattttaaaccacgtagaaaattttcacatgaaacataagtttaaaaacgtgctaatcaaaatcgtgatgaaatcggtatgataacaagaaaagaacaatattactactccttccatccctaagggcgttcacagtgtgtcgtcgtggcttctgcctcgactcactacatcggagattccatgccacgcatgcatttggcgtagccaagtgaagaccgcggagccaactttgggcacgcgttctgtaacggcccgcctctctcaggccggacccacttacatctagctgctcttatatgttcaccacatcggagattccatgccacgcatgcatttggcgtagccaagtgaagaccgcggagccaactttgggcacgcgttctgtaacagcccgcctctctcaggccggacccacttacatctagctgctcttatatgtgtcgtcgtggcttctgcctcaactcaccacatcggagattccatgccacgcatgcatttggcgtagccaagtgaagaccgcggagccaactttgggcacgcgttctgtaacggcccgcctctcccaggccggacccacttacatctagctgctcttatatgtcatagactattgaagaccacggagctaactttgggcacgcgttctgtaacggcccgcctctcccaggccggacccacttacatctaactgctcttatatgtcatagaccgcctctcccaggccggacccacttacatctagctgctcttatatgtcatagactgccctcacagatcaacacaagtcttttctgcacactttgtcctcactcgtgtgcactcaggaagaatttcctgattggttacccatcccgaaattgctccaggccaagtatgcttaacctcagagttctttcgagatcggcttctggaaaataagttgcaacttgttgatatgagtattctattaatcctattaagccctggctcgggatatcatacgttcttcctaggcttggcaggcatgcgtcagagcgagaggtgaggaaagacgaggaacgggatgcacgacgtgttgggagagggcatggccccgtgcttcatcgcccccaaagattgcgctagacagatcaagcgaggtcgacggtgcagcgtcgacgtcctggagagaagagaaggcagcggcggtggaagaggaggcggcgaaggaaaaggcggcagtgaatttggcgcctaacctcgtcgtcgtcctcgttccgcgccgtcggtggggtgggtggaggtcgacggccgcagtgggaggagaggagggggcaggcccgcggggaatcgtcgtgcgccgccatccctctccccgtggcggtcctcggctccgcgacgccgccaccagatcgggcgagctcggcaacgacatcgatggcggcttccggccccggagacggtggcttcctgcccgccaccgtcgccgcttggcctcctcgacccttccgccgttcgtcgcccgccttgttgagtagaggggagaaagagaggggggaaaggcacgtctcttgaggagagaggaaggaaaagcttggggagagagaggaaaagttgtttcacatcgaccctactcaaggctacttacactggagtatgaggtttgtaaggttctttgtctatgtggcatacgaggaacattaaaaatcgatgacatacagtaaacgtcctagatgatactagtaatctgcccgtgctaacgctacggaaatatttaataatacaaatcaaacaaccaaaataagatatatgttttgccaagcatataatgagatagaatttatagtaacgtgcatgcgtacaacacattatttacaatatgtataagaaaaataattacattcaagatgtaaaaataagatataggacaaagcgaattcatactttaattacatttctgagttcaattgtaaacaacatacatcaaattttgaaaatgtttcctacttaaggaaaacaaacttcacaaaaagatttaccatgatacatcttgatttgtcatgtaaatcatcactttttgccatatccatgcacatgggccaaattaattaaactaaggttttccttgccatggagcttgtgaagcgcataagcacaattagatcacaaggaactacttcacaatgcggctcaatagacaataacatactccctccgtttcacaatgtaagtcattctagcatttcccacattcatattgatgttg

SEQ ID NO: 4790 - DNA, 1266 bp, Oryza sativa
gctttacagtatacaataaataggatatagattccaaaatactaagcatgagaaccccatcatataaatgacaccaaaatcttagtatatcaaataagtgtcaactgtgccaattcgaacagcttctccatggtctcaccagtcgcacactgcattgagtaatccagagatatgccttaatactttctgtcaaccaacaagtacgttagcaatgaaagtagaaactcacacaagcaacagcaggaatttaaacccttacattgtcatttcctagcagcgctcgacatcatccatcagatcatgcatgttttttttttctctaaatcggaccaatgtaagcctgctcctcccatgtgttgcaaaatgccaaaccatagtgagcctgaagtccatattatccatttactttgatatctgaaatcaccatgccagggttttgaatcaaattaacatattagaatcatgtgaattaagccagggactccatgcaagaggtaatggttaaaccggcaagagttaaaatattttgattaacagatgactttagctaattgtgacaaagaatgacataaaacaaatatcaatttttgatttctttcatgatattgaagtatattaattgaagggatgatatatatttacaggacacttagggcttgatcggcaagcatagatttctcaggggagattccctcccaccacccaattgccctccactgtgggattgtgattgtttggataacagggagaggcggggatattgtctcacatcaaattcagaatttacataggactcatgcattatagaagtctggccaaagtttcattatcctcaaattacagaaataatttgcaacggaaaataaaatgcatggtattaagtaatcatggtggctagacccttccaataatcgttgactgttgttggtcacaattgagctgccgctagccccaagcattatgcccattcgaaccattttcatgttattatggttagactaatgtatatgctgccatagatgccattgcgtgcagctatgaaaaagctctgtaaccaaatatcaactaaataatcaatgcagcaaattaaactgtggaagagattaatcatcacctagaaccaaacctgttagagattaattgatcgggagggaggcgaggagccgttggattgtcgtcatcagaaactctatactctatagaagcactccaaaaatattcaaatcttatcggaaagcactccaaaacttccgtgttcatatccct

SEQ ID NO: 4791 - DNA, 9340 bp, Oryza sativa
aaagtggctagaaggttaaatccacgcacctcaaaagaaattaaccaatacatgagttctaataaaaggattaggttgtggtcacagtagtaatctgactgtgagaaatgagtcatgcaaaaaaggatgaaggattagtgctaaaacatggcaataataaggcagcactaacctgagaaatatcaagagcctttcttccacttcatcagaaaaaggattggtgtaacaattttatggggaatattgtcgataggaaacaacttactaaaattctgcatgaaaaaaatttagttcctttccatcaatttgtttagaagaagcatatatatattagtcaaagtagggcaatacctttcagaaaatacgaaaagttcaaaccttttttttttcgccaatgccaaaaggttcaaacctgtaggaaaggcaaaaacatgagaaggattcacatagtattgtggtaaaaattgtgctcatcctgcatcagggcgtccaccatcgtatagagagtatagtagctggaacaactattaccttaaatacatatgcagcaagccaccacgaacaagtttgattattttgtttgaagtcattccacaaacacttccgaagcacttcttggtactgttgcagatgcagtgatgcaaacaatcatctcggacttatttgggctagggaaagagtccaagctgtgcactgatttttatctcgtgttctaatcaaaacaaatgaaaaactgagccatgctcgggccaagacaatgaagatataccaatcaatcagggagcagcaaatcgaaatgctcacatgtgttacttgcctccatgtgttttggccgccgtaggtggacacctcccattcttggatggctgcaagctcgtccgttccggttgtcacgtcggcgctgggagtcttgccggcgaccgtggtggcaggagactgagcgagtgggcggccatctggctgcgtacaaccaaagggttcagggacagccgtcggtcgaggtgaatctgggatggccgccggtgaaggcgatccgatctggagggaggcgcgatagaaagaggagggagggcgcggtgattttactgggggaggggaggggaggcgaggtcggatcgggagggaggtggggagccgttggatcgacgtcatcagatgattttcgatcgttggatgtgtcacacgattaataagtaaaaccatttatttaattatagggtagattttggttggagtaaaacatagccatccatatcctcccaccgtcgactccgcgagtgctcacagtccaccaaacagcaacccaccgaaaataaatcgcgaatatccgcagctgctttgcatctgtggcgcgccgcgctgcgtcagatttctcctcttcggttcccctcgccaacgtgtcccaccacccaccgtctattttgtcccctctaaaaccctccctttcccccgcatccacggccctccctctcgccgccgccacttccccctccctgacgcttcgccgcagcgaaaggcggagagagcggcgcgcgcgcgggagagagagagagagagagagagagagagagagccgagaggagcaagcgagaatgtcgccgatgctggcgacgctgccggacgtcacggccgtcctccactccccgtcggcctcgccgccgtccggcctccgcgcgccggcggctgtggggatggggatggcgaggacgcgctttctcgctccgcgggcggcggcttcggcggcctccgccgtctccgcgaagccggcggcggtggcgccgctgtacgcggaccgcacggtcgtccgtatcgggctccccagcaagggccgcatgtccgagcaaaccctaagcctccttaaggtctcgcacatcgtctccgttcctgcttccatctatcgaattctgtatttacgtggtgattttgttgactttgtgttgttattatgctgttcatgcctcgtggtgcagagttgccaattgtcagtcaggcacctcaacccgcggcagtacaccgcagatatcccgcaggtgaggtttccatctccattcattgtcttctatcagttcgtcatttctgtactggaaattggcctactatcgaattagtaggccacttaggctctctgattcattgataagtatacgtatgggctagtccattttcaaagcattgcagtttaccatttcctgtatatgcactattgttagtatgaatgcccttttgatggttgaataaatacgcaatagcaattccaaactaaggcccggtttagttccaaagtttgaaccccaaaaacgtcacattgaacttttctacacacacaaatttccaacttttccgtcacatcgttccaatttcaatcaaacctccaattttagcgtggaactatacacaccctaaagttactttatcccttcgacagtatgagtgaaatactgccatcttatacaatattatatttttagtttatttcttcccttcaacaattcgaattttgtctgaacttctggtgcactgatggatgaagcaacagaaaatttgtcccttaaaatgattcaagcatccttgtcaatttaataccccatcgatcacattgtgtgttcacaatacaaggagatgtccttttagaaacagtagtcatttttaatgaaacctagcatagttattgtaccttttccacacttgcatatggttttaaagtttggagagattttagttaatttatttcatttaatatgggtagcattagcagctttaccttcctatgactttgtccctgcatgatctgcagctatttgtggaaatgtggctgcctgtttagaaaattagtattggaatataacggtgtaggagatagctaaggtaaaaagtcgcagtgctatttaaatcacatgttttgatttttttctttcctttatgcaggtcccaaacttggaggtttggtttcagaggcccaaagatattgtccgcaaactacaatctggggatcttgaccttggcattgttggttttgacatagtcagtgaatatgggcaggtatattttgggaattaatgctcaatgttttagctcgggttgtgcatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacattctccccctaagtcttgtgcgctgtcttgtgggagagttgagccatcccgatccgggagcaaagctcaaggaacttgatcctcctaaggggtttggtgagcaaatccgcaagctggtccttggtgttgatgtagctcgccttgatgctcccttcctccaagtagcttcggatgaaatgatacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctgctgcttgattgactgccagctaacgaggcactcgccgaggaagaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcactgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgctgcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcaaagtggaggtgcccgaagcgctcgtgccactgccacgcctcgtcgtcccgacgagcggcgaggcaaactggatgtgcgacttgcgcgctgaggatgtagagtcgattagtgcctctggttaccttggcaagaaggcgacgacggcgatcccaaatcctcatgagtccgtcctcgaccaacacgcgtgagccgttctcatccagctgtcccacactgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggcccccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccttcgctgctgctgcagcggtctgagccgttgctcgcctgcgctcttctgctgcggcgagcttggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaataggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacagtgcataccgcatacctctagtttcatactaagtttcttctatacttatttatagcatacataatgttcttaatttaatatttatttgactttcttagcaaggctttaatagatttatacttgtacttatctgagatttcctgtggcagggtagtgatgatttagtagttgttcatgatgctctcgagtttggacattgtcgtttgtcccttgcggtatggtgttctagaattgcatccatgcgtactagttgttacttggttgaagtttgtatctgtctgaaactgtcaaattgcatgatcaggttcctaaggaaggcattttcgagaatataaatactctggaggatttggcaaatatgcctgaatggacacaagagagaccattgcgtgttgttacaggatttggatatgtatggtcgtgaataaactcaaagttgttcaagtgctccccccctcttggacattaatttgctgttcatttacctagttattttattgtattgcagctaggagaaaagtttatgagagaaaatggtttcaatcatgtttcgtttttag

SEQ ID NO: 4792 - DNA, 10904 bp, Oryza sativa
attcttgatatgtgaacttgtgtgttcttacataatacacaattagcctatcaaggttaacaaatgctaagaattcttttttcctcctgtgaagatgggtatggctgatgttatcgtggatcttgtgagtagtggaacaaccttacgtgagaataatttgaaggaaattgatggtggagtagttttggaaagccaggtaagcctaacctctccctcccttcctctcacgcgtgcacacatgcatgtgggagagcagatgcctggtattttaattgacatttgcttcatcaaaagataaattgtgctcatttacaagatatgtaatatcacgcaggccacgcttgtcgcatgtaggagatcgctacacaaacgtaatggtgtcttggagattacgcatgagatgcttgaaagattagaggctcacctcacagcaactggggagataatggtaaaccaattttgtagcttaaattgggtgattactcaattaattgcttacttattatactttacattgccatataaggtcacagcaaacatgagggggaacagtgcggaagaagtggcggaaagagttctcagccaaacatcgttatgtggattacaggtatcactaaaagtatccaaagtagtattttacctttttatatactgaccatgaatatgtgcacttatgtggcagatgctaaaatatctctttaaaaataatattattttccacattcataaattagcactctataatcttgaactggaaatataattgtattgtagctgctctaatatctagacctgattaatcttcatcataatctgggcaatttaaagcttttaggtcctttgaaataaaactagttttgcatttcaaacttatagcaaaagctttgctcatgattatctgactggaaccactgtagtttgaaatactgatgtggaaaatcactaaagcttatgagttgattcactcattttgatttaaacagggcccaaccataagtccagtctaccgctcacgtgatgggaaggttgctgtggaatattatgcgattaatgtagtagttccacagaagtctctttacaagtccattcaacagctgagatctgtaagatattttacctcaatacttttaaacggaaatgtgtgcctatctccccttattctcccttttccttttctgtttcatgtgggcaattgtctcttatctttagaaattttctaatgttgtagtaaaaggtatatttatgtgcttatatgagtaattatcaaaagatgtttctgtgctattctcactgctgtcagcgcaaaagataaatctgatatgggagctcataatagaacttattgtcagaacatatatggcccttgctatatattttttgaacgtgtatggcttagttccattgataaatccaattgttttaatgtgtactcattaacttgtaactgcagattggtggcagtggagtcttggtgacaaagctgacctacatatttgatgaggaaactcctagatggcgcaaactactttcggagctggggttgtgacttggtgtgaagtctgccatacttctctgtcaatgacccttttagcatcggtttacttatgctcgctgaagtatactacaaccataatcagaaatgagctctcgtttgaagtgtctgcggtgcttatttgagaggaaattttggtctgtgccatcgtacattgtgctcgtctagttatacctttgacaagcatatgggttgaaataccctttatgtacctgttgatataattgtgagaccttattgccttgttggataggtgtgcgtatgaattgtaccttttcttgcgtgacgctgaataaattgggctttctgcaataaagatggatggtgtaattccaccccgtagcaaatctgtccgcctcctatgatgcaaggctcctgctatctttatccttttggggttgacccggggttactatggaagagtttgacaccaaatttgctcttggtgctggatctgggatgataagggaattccaaattaccaattctaatttttcttgtcaagttcctttcctcctttctttttacttgtcttgaatattgccagtatttacagacacatctgtacatttgctttgcacggcaattttcatggtcaaattgatagagcagagacagaacacctaccatatacatgatgatattgctttcagaatttaagttccatgaaaaagtaatccaatatgagatggcgaccctttgcacgtgcaggtatagtgtagacatgacaaacagtttacataatactgcacacatattatctttgatagatttttgcatatttttacacaattggaagccttatactcactcagtcactgatggcgcacacacaataaaaactgtttaaaaactgaaccaaattcagagcagagctggtgcacattttctcccagctgcttatttactatcggcaagcacgagggtcacggctacaaactacacgatcaagtcatggtgcatcacgcctttagctgcagacgtgcagagcctcacacatttcgccgtgcgcttacccggacctcgagcggcactgccatctcgcacgacaggcggagcacctccgacaagtcgacggcgccggacgccggcgtccactcgaactcgtgcagcagcgttgccatccaggcggtcacggtcgtcatggccagtgacttgccggggcagctcctcctgccggacccgaacggcacgaggcggccgtcggcgccgagcacggacacgccgtgcgccttgccgccggggaggaaccgctccggctggaactcgagcggcgcgtcccacacgtcggcgtcgcggctcatcgcccactggttcaccatggcggtggtgccggccgggacgaggtggccgtcgacgtaggtgtcggatatggccctgtggcgccacgagaggagcgggcccggcgggtgcatccggagagcctccttgagcagcgcctgcaggtaaggcagcgacggcacggcggactcggcgaccgtgttgctccgcccgaccaccgcgtcgagctcacggtgcacgttggcttggacgtcggggtggaggacgacgcgagctagtgtccactccatcagcacggccatggcgtcagttcctcgaaagatcatctcctgataatttaatgtaaccacggttttattatttactcatttggttatgtaatacgtacgtcagggagtaactgctaccatccgtttgtatgattctttctacatataaaatctgaaagaaatagggaaaaagttggtggaattttgcatgggggtagctttttctaaaaaaaggttttattttgtttttcagatttgatcacaacaaaagttagttttgcatgatgtgtttacacctcttttatagaactgtttgatgccatattaatccaagcacgccaaaatatcaaagcacacggatcgtacccaaagcacggcggcgatgtcggcgtcggcgagcccctcgctctcctgcagcgagagcaatatgtcgacgaagtcacgtgcctctcctccggcgatcgccttgccacggtgctcctggatgatgcctcgcacgaagcggttcacccgtggcatgagctcggcgcaccgtgctccgacgccctgcgggtcaacggcggcgagccccgggaagtagtcgcaccagttctccttcccgaggaggtcgtacccttcgtgcaccatctcgagcagctcctccacctcctccccggactccggcgcgccgcgcgacacgtcgtactccttgccgaacacgaaccgcatgatgtagtagagcgacgcgcgccggaggacgccgcgcacctgcaccgcggcctccccgcccgcgccgcgcagcgcggcgaccacgccccccgcgacgcgcgcgcggtacggggcgaacgcgtccacctgcctcgggccgaacaggtggcccgcggcgacgcgccggagcgcgcgccagtacgggccgtgctccgcgaagccgatggagcggtggaacatgaggccgtacgcggcgtggttgagcggccggtcggcgaacgccgggttgtcgaggatctccttggccacgtccgggtgcgacgtgacgaccgcgcgtaccgggccgagcgacagcgccatgagcctcttggcacccggccggcgcgccgcctcggcggccagcgagcagtgcgccagcccggacatgaggccgaggcttccgacgaccgggagccctttcggccctgggatcgaacacctcgggctctgccccctcgccctccggtacttgccccatgcagggccacccgggtgagcccagtagagcagagcagtgcctgcccatgcaaggcatgcaaagatcgcgaggtagacgaagctcgtggccatggctgacagtgtggcagcgctctcattttgccctgagatgggcgggaggaaggtcagtggcagcacccaccagttctcagctgctgagctctccatttgcaatattgcactgtgctgctgctgtgaagttctgtgtgctatgagctgcagctcggggagctgtatttataggagttttggagcgaacattccgtcattcctcctccggtgtctcctggcaaagatgattcagttacaatcattggcaataaagaagactttgcagtgcaccgttgagtatagtccagtacagtggtcctggttcctctgtttttccattcaggtgatcactgaccaggtagttcagtttagagaaaataatcaaaccagcctagctagtgtatgtaaactgcatggaaatcgaggagaaattggtctcagtatctgctaagtgaaaggttcaacgagcggtatacggtacaactcctgtgttgtactactacttggtctccaacttttattctgtcgcaatcctaactggccacacgtacgttcttcagattagtctagcttcaattcgcgacacctgtactcctgctaaccatacatttttggcaagtcctaaattatgagaagcctggggtaccaacaaaccatagcccaataagtctgcaattgcagcttacgtgttgctgatatatagatctcactatattgtgggtgtagagtcgttgagagagcgttgcggctgcttgttttctcgacagagtttgttttcacatgctttgtttagggcgtcatgaggacattcacgcaagacgcaacgactgcgcatgcaggtgctaactaaaattttatattgtgcatcagttggtgtggaacacaataggagttagttaggcccctttcatgttacacatgcatgcttgcttggtttttatgctttatgcatgaactgtcctacactaggatcagtcagcggtagcgcatgtacctgtcagagtagttaattatacactaactatagtaccattattggatggaccaaaagattaattacactgacttgcttagcctcgtcattagcagtacgtatgtgggagtaatttcgtcaccccgcaaaatcttctatgataatgtccccatccctgcaggcagggatatgtacaagtacaactggccaaactttatgtatgcacatgtacgtatagtatcacctgtgcaatgtgtgagcagttgcgcaggaacttatcaggaacacgagagcaaaaacaaatgaaattaatgcattctctccttatgaaaatataacaacttctcgcttttaaaatttgtcctaaaatataacaatttcttcaccaacattctctttttaatcaatcacaattccccaccattcaattttcccacctaacttcacttctcctccaaccgcaacactcgatctcctatttaatcctaccaactttcttaatatctgtatctaactctaaaagtacttatattctaagacggatggagttcaaattaagactgttttaaatcattcaacacaatcggaaggtaattcagctataagtttaccaaaacacaattgggcgggcggaatctaaagtggattgagtacgtggttagttccgcaaatcgtctgcgcccattgtttcatcgaaccaaataacttcgtttcgtgccgtttaggtgtttagctgctgcagttctacatgcataaacagcggatccacttaaaaaaaaaaatccaaaacaccgaactgaacctagtacaattaggattgaaatactctgactaaaatgtgaaccctctaccgagcagaaccacatatcaatgactttgtcttaaggaagtactcccttcatttttttaataaataaagccgctgacttttaaacatatctttaactattcgtcttatttaaaaatttatattagatataaatcaataaaagtgataaaacaatttacaacaaaaataacttataattacgtaaaatttttaaataagatgaatgattaaatgtgtgatatatataaaaaatcaacacgtcatctattaaaaacatgtagtaagtcagtacaccacatgtcctactgtcttgcattggatccgccactatatactggaacgcacgcgcacggcgcacaaccacctgagagcaaggatactagtatagctcacttactatctataggctctctccaagagatctatgtcaacatattttcctacttggaagagattaaatgaagagagagataaaagctatctattaacctggagatagtttatagagaaaaacgaggcaatggattagagagctatagatacccatgtatatataccatttaagtggtttcctattaatctagtctattgctgagatgtacatgttttatagatagcaccttattttactattgtgggtgctcttagcttatcttaaagctaacatatatataatagattagatataagtttggctataattttcttctcctctctctatctctcatacatttaatgcatttgtcttgagttttcatacatttaatgcatttgtcttgagattgtgttaagttagtctttgcatgagtgtcaatccccttgatttttttttgttacctctcttctccacataagtttaagtttataggtttatagtagatttatatctcactattatacttctctggaagctgaaagagctgacccgcgaggccgcgactgttgcctaactccttgggaagtacgcggggacaaccgcgcgcctaacataacgcccctggtgccaacaccatcgcgcgcatggacagcgctcccgccgccacaaacacatctatcgggcggcttccgcgcgtgatccgccaccgaaatgcacccgccgcgacgctctcattctgccggagcgccggtaccacgcgcccggcggaatgaaaatgcggccgctactacgtgacaggacgccactttccagcgaactcctcgtcaacatccgcgcgcatccccatttttttatctgagcaaaacaagaaataattttttttatctaagcagggcggtgtgaatttttatttataaacaggacggcgtgatttggtagcgtcccgttagcctaattagagcaagtttaatagtataactcactactagctctaatttatatatagcaaatctaatagtcaatttatataatagttacttcctatactattaatatatggtcccttgtcatatatgcattgtatcttacagtctgtgttgcagctggctatagatctgtagcccgctgtttttctctctcatcttttatctcactaaaatatatttatagctggctaatagtctgctattgtacctgctcttagacggagtcttttacccctatgccattaagaaagttggaggttacgcgtgtgccaaaaaaagttttgagttacatgtattaccatgacacaaactttcgtttacccgtgtgccattccatccaccatctgttagagaatgagctctgacatgtgggacccacgtatgaaaatgactaaattgcccttgaagcattttcatctctactactcctctcctccagtgcgcctcgaaccctagccgctgctgccgttcgtcgccgtcgccggcacggtgccgccgcctcgcctcgtttatccgccgccggttgtcgccggcacgccgccgtcaccacctcgtctatccgctgccgcctctctagcagccgccgccgacggtcgttgccgtcgccagcacgccgcctcgcctcgtctatccggcagcgcgcctcgtctatccaccgccgcctctctagctgccgccgccgccagtcgtcgcagtcgcccgcacgctgctgccggtcgtcgccgtcgcccgcacgctgctgccggtcgtcgccgttgccgccgccttgcctcgccggcacgccgccgccaccgccgcaaaagtggctgaaatagaacaatggcaaaatagatctttcaaacctccgttagtctccattagtgctgattccatccaaagtggcgcacagttaaacgaaagtttgtgtcatggcatacaggtgactcaaattttttttatggcacacacgtaacctccaacttttttaatgacataggggtaaaagattctcttagacgcggtttatctggagcgtccagtcttccagcggacgcgacgttgttatagcgtccaaggtttctaaaaacacattcatctgctcacagtaccccaaatcagaaagggaaaattgaaaccatgccattataattttgcaaaatttaagatatgccatcctgacccacatgtcattgactcatgtgggtcctatatgtcattgagatatcgatggcatatctcaaactttgtaaaattataatggcatggttctaaattacccaattagaaacccaccattgaagcaccgatcatgagcctcggcggccgcggcggtggcggctaccagtggcgctagttcatcacgatcgagccttggagtgtgtgcccgtggccgttctgggtgcgcatccacgagactgagtctctcggcctcacgcgcggcgtccggccatctggttaattagtcatcctcttacacggccatgtactggttgtatgattacctcttttcgatttttgcattcaagagtaaatgagtaaatcccgtgtggtattcttttctttattcatacattgcactgatactgcctcaggcgatagctgtttcgtgcttatgttttagaggacaatgaccgaaatatgagcaacagccatcgtagcaagtgcttgtaagctaatttgtctgtccattctggcctgttttctcaacatagcaagatgattaaggagacaatagacaatagtgtgcacataatctggaaaaatgatttagttttactgtaggaccaatcaccatacaatcctaatttttgagttgcagaaaaaaatataccaattgtaaattgtttgacacgctctattaatttttttaaggtaactagtaagatgagggctactcaagatgggctaagtcggtcagctgcaagaagtgatggagtgcaagaagtgatggagagctaggcttattagatggagatcaaactttagttcagcaaactgaacaaagtgtttcagaacgtttcagtagcactgctgtggatgccccattgccagctcaaaatctcaaaagtttagaaaaatgtaagttatagcttgtttcgtatacttgtttccaaaaaataaaataaaatgattgactaatttttaccctatgtatgcaggctaatgatggtgtgtaagagtgtcaggtttcaccgtacgtgttggtagcattctataccatttatttatgtgagccgctattgaagaggcttggattttatcaagttgcttagatgggtggaatgggtatatatgtgcagtctataagtataagcgatgtatactcaatgcaaaggactactgtgcatattacaaaggagtacatctgcatctagcagcatcggtgatgatgatagttatttgatcgatgcactaaagtttttaatcataatctccatctagcgctgcaaccattgcaggatataaatagaataaatctaaaaatccgctacttgattagtactgatgtctaatcaattcgaaacaaccaaaagaaataccttagagcaaataatctgcgatccccacttgaattctgatcatctaatgtaagatttgggcattattagttctccagtaagagaaaattaggagagaagattagggatatgaactgtaggataatgaagaaagacagcaataggccaggtaccagaactcagcagcgtgcaattccgatccgtttcgttatctttgttgcgtgtgtgcagttgctcgggcaaggccgctattatgtttccgcgtccaggttcccgttcaaggacacggtaaacaccaggcgtccaagttaggcgctggcaaagggtagcatccccatgaaaacaacaggacgctacatgaccacaacgtcctgcttattaatctaatttaatttctatgatgctaaaacaaaaaaaatatatttctcatcctgctcagagtaaaaaaaatcgggcgcgcatccgtgtgtgcgggaaacgcgcgcacacgtaggttacgcagccaagcggcccgaatcgatcgcaggttgggtgaggtggccgtgatggtacgtactacgtactaccgcaactccatcacgatacgaaagtgggatcgtccaagagcatctctaccagcctctccaaatcaaactctccaaacactcatatagccaactctccatctgatttagagcatctccaacagtctccttattcaactctttaagttaaattttagcaattttaaagcaaaatcgtgctccaacagactagctaactggatggccaagccatccggctagccaaactactcctcccgccggccaaatttggccagccaaaatagcctagccaaatcgtgggtcccaccgctttcccccct

SEQ ID NO: 4793 - DNA, 13144 bp, Oryza sativa
tgttgccgacggcggccgacgcatggcgtgcggtggtgcgatgacccgaggaggcgggaggcggtgcggggaggctgccggatctagaggccgccgctggctttgcggtgaccaggcgacggcggcagacgaggtgggaggcggtaagcgatggcgcccgacgacctagacgacgacctcaacgatgacgacggcgcccccaacgacctagacgacgaccccgacgacgacgacgacgccgcccctgacgacctcgacgacgccctcggttgtagatgacggtggcttcggcagtggggcggaggggcagtgccggcagagggagggcgccggcgcggcggaggctagaggggcgccgaatctaggggatgggtagagaagttgcgtgatgaggaggaagtcgtgatctggggagggggagagtgtacgggatggggggggtggggaaaacgcgtggggcctacaattggagaggcgattttggctggccaaagttggccagcgcgagaagaagtttggccagtcggatggcttggctagccagttagctaggctattggagtgtgtttttatccaaaattaccaaaatttaacttgaagagtgggataagaagtctgttggagatgctcttacgccagatttggctttacagcgaccccaattctctgcaagcggacttccgtttgtctgaatccttcttatggttttgtacttcagttcagtgcactgagcctagctaaccccggatccttaataagatgggtagtttggcctctgaatacagatcgtacgcttgcaatttgtgagcgtgatacacatggttcggcacatcgcaatgattcaatggatcatcatcattgcacgcatgcaatcagaaaaaaagatcaagtacgatatattactcctagttgttatcagtagttgttgcagggtatattgactggctatacatagtgctgcacgcagggaaataggggcatcttccctgcagatggtgagacactgtgcctaacctaatttgctgagctaagctccagtgcagactagctcccctgattctagctacttcagaatacatataaacaattctccgctctatacgttttaggggtcaaaattcggatagaattggattcgatcaaagatttaagcgagcaaagtaaatctgatcgaggcaagccagtgcacgcacgggcttcgcaaaagcgacatttatggttaaatttgattcctgctctttggccaatgcgatgatccattgctttgacttgtcaatatcaggaccagatgcgcaactaactgatgattttgtcctcagcaatgcaaggagatatccatttgtcagtggagaaccctaactgccaaaaagtcgaaagtgaaaagacgggcatgcgattctgatatacgcagctttttcgatgataaatcgaaagcaaatcctttcttagggccaatttgtctgtataaatatttttgaattgaatagaattgattcgatctggcactcattttatatttggcagaatcgaactttcctgtttctgcacacttgcggagcaattttctgttgctgctgcatgtatagcccacttcctctctcctgttacgtttgatctactctatgatccatacaataagttaatgaaccactttgtatacaatacaaatggaataatcttcctgaacttttttcacagttattatagctcaacgacccaatccaaattatccatcaatcaggccatgtattcttaggtcttcgtgttgttgcctacaaatccactctagtgaaaacaaaggacgccgacgttttataaaaacaaagaggtgctcttacacatagcaccacttactaatctttagctgttctcctcaaaagttgccttgctacaataatctttcaagctagttaatgatcacacagaatgtggcttttgattgatccaaatacaactagtaccaaagccttataatcagttatatgtgctcaataagatatagcaatgccaacactacacctacttgaaaagtgtttatttcactatgctcctgtcactggcccataggctcttagcatatattatacatagaagcatatgcaagatcagtagatcacactaaagtttgcatggttcagattgagcctcaagatatttcaggatccagtgtgaaagcctccttttctgttgccaatcatctccattgaatgcaatctgtagtaaattaaggtggtgtttggatccagggacttaactttaatccctgtctctagacactaatttagagtattaaatatagactatttacaaaaactaattacataaatgaaagctaattcgcgagacaaattttttaagcctaattaatccataattagagaatgtttactgtagcatcatataggctaatcatgtattaattaggctcaatagattcgtctcgcgaattagtctaagattatggatggattttattaatagtgttactttaacatttataattagtatccaaacatctgatgtgataggtacttaaaagttttagtcccatctaaacagggtctaataaccgatcgaacagtatgattgtttgaactcatggatatgattatgaagcgctatggacacgccaagccacacgcccacacttgatttgattttgcttatcaccgtggcattgattcgaacaatgtatctggagagatcacatttttcaaaacaaaaaaaaaatctggggagttcagttcagacgtagcacacgcatatgcccctaaacggctttaggggctgtttggatggactaatttttaattcttatcacattggatgtttggacactaattattagaagtattaaatgtagattattgataaaacctaatccataaccctggactaattcgcgagacgaatctattgagcataattaattcacaattaacctatgtgatgctacagtaaacatgtgctaattatggattaatgaggcttaaaaaaattgtcacgtgaattagctcttatttatgtaattagttaaaataatgtccaaacatccgatgtgagattagaatttagtccctgaattcaagcatcacctgaattccttttcagctagcagaaggttatccattgtttttggttgcatcctttatggctaaacatacagaaaatttcagaggcaattacctctgttaatctacatctcacacgttgctaaaaaaaaatccgggctagaagaaccagttgtagtgttgtaccagtaataatttacatgtaactcaaatatattctagtgaaaaattcatccatgatcagtatgctgctaaaaaaaaatcattcatgcatatttgtgagttttcaactgtggcagtaaacttcttaagaacttccatactataatctataatatctcacataatctgcagcaaagaatttgttcctccagtgcatgggcaacgaccgaaaaaggcaaatcaccatgaaattcgcgggctaaaaagaaaaaggcaaaacaatctggctggaatggaggggaaatggagcgaattcttgctgttgctgccgtgtagttgtgcacttgtgcgtgggaatcatctcgcgcggccggggagaagaccgcatctgaatcctcacagcgacgtcgtggtcagtcagccgagccgttgtctggcggtggtagtggactcgtgcaaggtccaactgatcgatcatcgcgtgacttgactagacttcacttttgagagggagacttgcctggcaatggtagctattgacttagacttcatatttcgtcaactgagatgcaaaagcgctctgtagaattgaattgcagatggagcagttaagcaggtccatctctgtctctgatttggagccctgctttgtataagtttaagggtttattccacgtaaattgttcaatagatctaatagctagttttaatgttagatttgttgattctttggtcttctcattctctttggtgatcggtggctatcgcatttgtaaggtctttgatgtcgggttgcccattattcaattggcagcatcggctttatcgttcagatcaccggtgtgtttgatgacgttgtttgaggatttataagatggtgatcgatttcgtttgtatacttctatatttttgtttgtacaggagttgatcaaaactgtggctacgctcatcagctcgtatctcttatgttattctagcaagcagactatctttatttcgttttggtagttgttcttatttgactattacgtgtaaaaacactaataatctctatacaaatgtaatgtacattgtttcaatgagaaaaaaaaaagatccaaagtagtaccaaagcgcaatgctaagctggttaggtagcaggttacaagttagctataaacacgtggatgagatcagagaagagagaaaaggaaattgggctacagatttataaccaacttcggcacgaacttcaaaatgttatgtgtgtacgagatgtggcactatgtattaatgatgcagtatatatttatagataactattgcatgaatagattattaaattggctatagataatttgaagctaccagttgactatactattaaacttgctcttagtttgtgttcgttgcttgaagttcctaactcattccttctcgttttacgtgtgtacactccccaaactattaacgatgcgttttttcaaaaaaaaatctataggaaagttgtttgaaaaactcatattaatctttttttaaaaaaactattaattaattatgcattaattagtcgctccgttttacatgcaccgcaaattagttcccaaccaccaggaaaaaaaccccgccttatgattgaatctgagccatccagtttaagttctagacacatgcatttatatttgcggctaattattatttcagtggtagcttggtaggtgacatatgcatcgacagcgacacgcttgtatcaacttcatcaatatgaagatatatcgtacaacgagatgcttatgctaactttgttaatttcaagatatacatattgttaattttaagatatgctagataataaaacgtcggtctacgatgatttcgtcaatattaaaatatgctgaataataagacgtcggtctatgatgatttcgtcaatattaaaatatatttatatgctggcttaatttttagaggtgctaatagagataagggtgtgcgtgtgtacgtttataaatgcaagtatgcgtgtgtataataacatccgcgtctgtaccgtatttcgggggaaaaaagtagtgccaaagctgaaattagttgacctcagcatcaattaccttcagtctgtaccgaagttcagcttcattcgcacccccattcgcatcaggcagagaagatcataacgcgcggtactcataactcagggaatctgttgttattattctccacaaggaagatgggccgaaatcccagaggccggcctattctagaatcagtaatacgggcttcccgtcgaggcccactacatcaccgtcgaggcgaccatcaccgacacgccaacgcggcacaaaccaaatcgatcgaaaacgaagcagtccccagatctaatcccttctatcaataaagttaacctcgtgcttccacgccatcattaaattgtaaccgttggatgaatgtattagatcgcttcttagacgttggatgaaatgtaacatatagcccaacccattagtcaccgggtgagtctcttcgcctcctcagtaccaaatgtagcccacataaacacattggcccatctccacacacatctacatgtatccagcccgttaatccgtataaaagagctttatggctgaacaccccttcagttgacatgtgctatctaaattatctacaaattttgaatagggctgttaaaaagaatttctccaaaaaatctatttgtttcttcttgagattgtacctcctatctaacaaattgttgttaaccaagtcccgcagcaacgtgcggggcatcctctagttatccaatacgccctagtcctcaccgacgcttccaccacgcgtcgacgccccggcggcacttccgctccagatactcctcgcgcgccgcgccacgcccttcactcagcaagcccgccttgcgccggagctcgggtacgtgaccgactgctgggagataagagatcgcccgagcccgggattaaggcagaaaataggggagaggaggaaggagtctctgctactttggcggcgtttttttttctctattgctcatgaaagccggcgtgatctagggttttgggcattggactcggtgagtcgttccaggtgtggttgcaagatgttgtagtcagacccagagttttggccgtggcaccatgtcaaagagtgggggattgtgcgcaagcctgacgccaatcctcttggaaggagcaaggggacatggctgttccgctgatttcgtaccttcgtgagttttccggttcccctccatcatcgttatgtgcttttgttatcttaggtcctgttcagtttaatattattttcaaccattttttcgtaaagttaccaaaattttggctatgtttagtttgttgccaaattttaataaatacatatgaaatcttgctaaaatttttgacaaccttaccaaaatttggcaatgtcaaaacttggtaagattgaaaatgatagcaaagtaaacaagcccttatttcccttggatggatattgtcaaattactctaagctccatgcctcatgtactatctgtcttttaggacaaacaaatggttgcaattatatgcagtgtgcttgcgctaattgccaaacatcagttcaactatattataagttcatctatcacgattatttactcttatttttctgtactagtgatcaaccgcccttcatttcagaaataatgcatcaaagcaaatatgcggataagtagaactagtacaacttatgctgtaccacccatccatggctcacatgttacatcctcccacgttgcttatacaaacaatgaatgaataaactacagtctgttcgatctcacgcgcaaacctcaaataaaacgaccataccgacgggcgacggcccgacgccactacgccagctttagagttagaggcgcgcacatcgcttggatttgctctgcactgactcccatatataccacttcgccggctaggcgacccagccatcctctaactcgcaacacgtaagcctgcaccaagaacgactcttgcttgaccatgccgagagcgcgaggtctttcctgcctcatgtcgccgctcagcggcaagcgccacgccggtgacgcacgccgcagcagcgccgcgtgcatatgctgcatcggcccacaccacaagccgtcgtccgccgtcggcggtggcggcggctgcgtgccctgcctcgctccccacgccgaccacagcgtgagagcgcctctcaccagctgctgcggcagcggcggcggcggcggtgacaacaacctccgcggccgcagcagcaccaccaccagcgcgcgcacgccgcgcacacccaagacgccgtgcacgcccacggccaggcgactctgcggcgtccgctcccgcaccccgcgccgcgggcaggtcggctgcttccagtcgtcggcgcctgccgccgcaaggacgccgcggactcccacgacgcagcgcgcgtgctacgtccgtggcacgggcacggctcagggcaacgcgaagctgggcaggcggcgccgctggctccggtccacgggccagacgccacgccgcacggcgcgcgcgggtggcgacgtcggcaacggcggcgacgtcaaggtttacaacactggcctcgtggaggccgccgccgaggagtcggtaacaaaggaagaggagaccagctcgaacgacgagtacgcgctgctgtgcaggcagggcttcccacgcgaggacgtggccgcggtcaccatccaagcctacttccgaggccacctggtgcgcgcgtagaaaaacaaaaaaacttatatctaaccgagacctgtttgtttcggccattggtaagaggattttgcttgtgttttgcaggcgaggcgagcgttcaaggcgctgaagagcctggtgcggctgcaggcggtggcgcggggggcgtacgtgcggcggcaggcggaggtggcgatccactgcatgcaggcgatggtgcggctgcagatgcgcgtgcgcgccaggcagatgctcaccaagcccaaggaagggcagctcttgccgagctgatcatcaaagccgtacgtgtgcagtgcacgaccacgttaccgtgggaaataaacgtcgcctgaataattctggaaatctatcaagttaagatgtttggcatttgttgctgccgagaacatcgacatgggctgttggcctgttgctgtgatgaacttcccgtggatttgtaattctaaatatctgtaattcatatgttgtccttggttttttttacccgtggaaaatgcttaactgtttcgtttgggaataacccattttattttgttttcttttgattaacttgatcctgtgacccgaagaattatttgacctatatggaagtagtttagttgtacaatctttaagatttgttttcatttatcacccaggctatgtcgtgcccctcatgttgcacaagttaattagagcatcaacaacaagctacctatatgatttccaaaactaattttgagggattttaatccaaaaatcagctccaacagatcctctactctcctacccgagttttggagttcccttcccccggttgctcgctccgtttatatgcgggcgcgaaagtcgctcccaatcacgcaatcctgcctctctccttcgttcccgcgcgtgggagatagcgatctttctgcgcgtgaaagaaaaaaaatagaattttctcttggtagtttaacagaagggcccacttttaagttttagggattgaatttaggctatctattggacggaggtgttttttcacttcctattttcagtttaggaaaccaaaaacgaatttttaaaagaaaattatagataatctgttggtgatgctcttagtcaacttgtatcatgaaatcctctgtttcgtaaccggttttccttattgtcatgcattaattagtgcattaccacatgatctaaaaggaaaccggcttatggataaaacagtcaaactaaactcatggaaaggacacaatcaaaacttcactttcatatgaaaggggctggccaacattttattacaaggacgataggtaaactgcgactgttacaacggtagaaaaaccacgatgccgaacaaaacacgtagtgacgacgtactggaggccgggccagacaatctgcgacaaattaatcgacacggcgcgcaaatggcaaaggcgcaagtaaagtaacagtaggaagcatacgtgacaaccccttggaactcatgcagctcgatcgtcgatatgcccatgtttagttgttgtagttctcgacttgctcgttgcggtagtgctgctggccctggccctggccctgctggtgctggtagttgttgccggcggacggcgattgctgctgctgctgctgctgggcgttgccggcgtgcgcggcggacggcgggcgctgcaggctcttgacgtactcccacgactcgcggctggagatgttgttccaccacctgctcacgttcttgcgcgcctcgaacatgcggcgggagcgcgggtcggaggcgaggcggtcggcgttggggaggtgggacaggtcggcgatggtgaacttgtcgccggccaggtacgccgcctcctccagccgctgctcgtagatgtccagcagcttctccaggtccttcttgctcttctcgaacaccttccgcatctcctcctccttctgctgctgcttgttgccgttggcgccgctcgccgccgtcttcccgtccgtcgcgccggccaccacgcgcttgctcgacgcgttcgccacctggacctccctgccattgctgttgccgtagccgttgccgttcccgttcccgttgtcgttctgcttgggcatgttgggcggcaggaaggcgaggctgtagaccatctcggcgctgggcacgtcgaagctctgcgcctccgtctgcagccactgctcgatggacgcgcgctccagcgcgcccgtgccgatcaggtccgggtttccctgcctcgcgtacttgtgcgctatgtggcgaaggatccccctcgactctgcacgcatgtacgcattccacaccattatttacagtcgttcaagtgtcaatccgtactacaaatctcaatgctaattaccggacagggtgaggttgtcatcttcgaacgtgagcgcctcgccgagcggctgcacaattttccccagacgtgtcagtccgagaattgcacaacgacaatgtggtatgcagagcatgagtatacctgaagcttgagatattggggcatgcgctgcgtgccgcggtacgcgtcgacacggacgagctggaactcgacgtccttctcgaagaggcacatgagcacgcgggcaacctccgccgaggtgggtgacccgaaaaccttcacgctcgccggcgccatttcagttgcagtgggcggctagtgactctactgcaactgttggttgggatttgagaaggaagtattatgcagatggtggtgtgttcctgccgtttggaggatagcttgggtgtgcttatatacatgccaaagtggggagcataacacgctttgcttgccaagaggtaaatctaaagacaaaaatcaaaggggggaaaagagctaaagagcaaagcgctggatgccaaagggaaagacaaggctcatctctgctgccaaggttgtcttgtgcatcatatcatcatcacacccgcaagcaaccaggcgatgatgttcattagaaaacatcataatttgtgtgctttaacaagatctagtcgaaaatagcaaggtctgagaagatttcagggtgaaaaaaaggaaagggaaagattctgtttcgccttgatttgttcaagatctgcttaccaaaggaagtttcagattattctactactatatgtcaagtgcaaatatcttcagaaagaaagtatagtgcaaaataactcctagtaattctactactcatgtgctaaggtaattaagttgttgcaaatatcttgagagagtgaacatactacagcagacgaaatatatcagattaaaagagtctccagatcattttttaaagaaaagaagaatctccagaacaaaaacataacatgacaacgtgacaccctgatacatcaaacaaatctcgtttaataaagaagtaggagggaaaagagttcaacaaaacatggaacattcccctcaatctcaaataattatacactaagctgatatcatcaagctttaataaagggtatccttttcttctttttttttattctctgttcttctgaaaagaaatacagggattcatgaatttaactcttcaactcttgttactgtcatatgctaagggttgcaataccgcctcgcaacaagtttaatagtatagccaactactagctctaaattatctatagttaatctaatagctagttcatacaatagttacctgtaaacacaattaatatatgattccacctattatatacacatatatcttggagttcgtgctgcagctggctacaaatctatagcccgttggtgctctctcacatcctttatctcctcgaaatgtatttatagttgacttatagtctgctattgtacttgttctcagtttttttaacacctaatgtatagtgttaaactcaaataataaactcatctcaaaatataaaaacatgggagcattcgtagtattaggataagtctactaggttactgtattctacgataatggaggtagcaaaaaaagaatctttacatgtttttgaggttggtgacaatctcaataattgtgaggcgatttacaacaacacccttcccaacaggccaacacacgaatatttggccccactacatcgtctaagctttaatcattagcatatctgttgtcttaaattagagaccaccttatatacacatatacacatagacacgttaagaatgtgctgtcttttgcctttaaccgtattacacattaaaaaaggtattgaggcgctaggctcaaaacgtaaatatcagggttgtttggttgacaccctcaatttaccacaaaagttttgacaaaatatggcaaaccacatattatgtggtaattttgtgaaaaaaatatatgataagtgggcctaatttcttaaaaaagtgaagtgtaacatagttgtagcaacaatcaaatactaggctaacttatcaaaagtggataacacaaatgtggtaaagtgtggctatcaactaaacaatccctaatttatcgcatttaatttgaaattttagtgtaaacattttatttgacctaaaaagtaacacccgatttacagcgtagtttgttcatgttaaggagtactactcctttttaacttacgagccgatgcgagggtagagtttcagttcatcatattaacaatgcctttttctagttgacatgcagattaattaattcacatgaaaatgtccatgaactcgggactgagtccagttttcacgccataacgaaaaatcggttatcttttcacccgcctctgtctaactacacacaacaagacacggtgaaactatttggttgtcataagcactttatgaaagtttttacaatgtgaacggttcgcacttaaatgggttttaacattgttgaaacttacttttcaagtccgtcaaaaaccacccatccaaagtgtagttatttattttggaggatcttaatttaaaaacgagtaaaatgaatggaatatcatccaacttattaggtgtgtcggagtcatacagatcactctactttaaaaatacacatttgagtcactaatctaactatccatacaagcatatgtgcatatgttgtaggtatgtcacgtagggttgaaaaaaggcagtgtatcgtatgcacgcacacagcaaggtagatgcactcatgcacacacccatccggagcctttggatcaacatcctgcggccaagaccccgagtgtggtatttttgcaattagccgcccgcct

SEQ ID NO: 4794 - DNA, 8824 bp, Oryza sativa
  unsure (1)..(8824): unsure at all n locations
agccagagatttggagcgacggctcatcttcagaggctgtcgctgctctcatcgtcgtaaagtttgtgaggagagtggaaactgagctcggttggtgcctggtgaagattggagctggatgtttgtcacgccccgaactagccccaaacggaactagcccgtgacgctccaaattaacctgttaatcgataccagtcctaggaaacagtgctagtatcataggaagacagaatatcacagcaacagaggtctctttattacagagtaggagtacagtcatgttgggctgcggacagatctcgagctcacaactgcattacaaagggaaagcggaagccaagacttggaccaatcatcacaggcgcgacttgggaactagaccgaaaccctaaaactcatcgtagccgacttgctcctggaagaactcctcgtcagcgggatccacttcatcttcttcagcaactgggggggattatttatatagagcaagggtgagtacaggagtactcagcaagccatgggaattaagtgtttaatgcaggcttcaaaggaaaggctgttgtttttgcaactggttttatttaaactcctttttgaaacaactaagtgagtgcttctcaaacgacacggatgagacagtgtgtctcgtccggtcggagtatgtgcaacgtatcagtctttgaattgattcaaggttagcacctggccaacagctttcaaacggccacccgggcctggctgatcccatcagccgcagatttttcaaacatcgaacccattccacaacagtaatttcacaagcagtagtcaaacaaaactacgctaggaatcacctcacatccgcccatgaccgtgggcacggctgttcgaacagtttaataacctctgcagagggggtacactttacccacatgacattactagccttggtcacccagcctgtgcagaatagccacgtctggtgactttggggctttcacgtcaaggcatttcgaaagccgacacagggttaccatatgccaacgagaggggtcccagaccaacaacaggttaggtcccagaccatactgtgccaggaagcccgggggttctccccaacaccaccccgttgaatcgacatgtctcttggcatcatggttcccccgattagctagttactcagccaggggtgtcccattccacccatgtggtcgcacttgccttatgttcggatgaaattccaaggaaacggtccttaagtgcaagagcaggaaaccgtactcccggtacgtcccccggtccgcgattttggaaattcattttagttcgcaagcaccgacccaggtgtcgggttttccaagtcttttgtaaaaccccaagttttacccatcattggatattttaaatttgaggggaggtgttccgatgcccgtgcccaaaggcccgtgcatcgaagcacaacagttgacaaaggaggtttaggtgttcaataattcaaggagggtaattgcagcaattaggattgcgaccggcaggctatctcgcaagccgcggccgatttacttgtgttaatcctattcatgcaatatttgcagaaaagaaatacttagttttaaattataggtgcaagatgatcaaaggtgacttgccttgctcgagatcttgagcttgatcctcgaaatcctcgcactgcgggtcttcgggcttcgaaactacacgcgaaacgggacaactcaacaaacggcgaaaataaagccctattgttgacctctaaacgtgccattaaatagatctcgagatttgaggaattttgcaagttgaacggagtcaaacggacatacggttgagaagatattgaatttctaagattattggatttttggtctaaaggaaaaaggatttaattaaacccttttgaaaagaaaagaaagagggaggggaaacagacttccctcgggtggctagggcacgacccgagagaaaggggcggtcggccgagcttaatgggccggccggcctgagaaggcggcccaaggcacgcgcaggaggagaggagagaggtagccggtgggccgggtccatctcgcgtggtcccgagtgggacccgcttgtcggcggctcggctcaccgtgagcgaggagcacgcaacgcggcgctagggtttggagcggggcgcggtgcacgcgcgcggctcgtggtgggtgcggatgcggcggccccacacgcagcctcacggctcgcggtggactgcgcgcgcgagcggggcaaaagggagcggcggaccggggtcggcttgacccgatcttggccgagcaggcgccgacgtggcgcctacgtggctgccacgcgggccggcgggaggttgaagaaggcgacggccggaacggacagctgacggcagctgcgaacggcggggcgaaccacagcgatacaggcganagcgagcacaccgggtggttgcacgagacgaggggagacgagccaacggctcggattcgccggagggagttcgaaggcggcggattgcggcggcggcaaccggcggcgagaaaagagggaaacggcaacgacgcgactagggttcgattcctccggactagagcatctacgcggccaccggaagtccgtttctagcatcggattagacggagacactacgagagaggccgacgacgtgcgggcgctacggagcacgggcggcgacggcggcgagcacacagcgagcggcggcagcggtcgaggcggcaccagctagctacggggaggctatacgagcttctaccgaaagctaaggggaagaggaggaacgaggagggagaacggggaggaggcactacagtgcggggtgaaggggcgcagtgacgatggccgacggcgcggggcgtgatcgctctggcctcgggccggggaagaggaaggagagggtgcgcccggagtccacgtcacgcgtcctcgctcgtgccggctcctccgacacgcgcgacgacgaacggcgacggcgaacagggcagggtgccgcaatggcgagggcgaaaatggggaagattggtttggggaggggctcgggtttatagggcagcaatgtcggtttgggagggaggaactgacattgggcggtcaagccagcgagctggctctccggctagcggccaaaacggcgacagggaggatgacgccggcggagggggggaagggggagaagaaaagacagagggaaaggagacttgcctcttgccactttgggaaaagaaggaaggagggagagggcgacgaggcagtgggaggaggagctctgcctccaacccttggaagcatgcgcggtggtggcggggccgggtagtgacgacggcgatgacggcgggggcggtttggaagggcgcggctacagggcggcaggcgcgggttcaggcgcggcagggcacgcgcgctggctcgtggggtagggcgcggcacaggcggcgcagtgccgcagggcgcgtggccggacggcgcaggcacaggcagcaggcggctgacgacggcggcgaccgcgcgggcgcgcgcgcgaggtaacgacgcgcggagagttttccggggatggagcggggagggagagcgggagaacgagagagagagggagagctcggctcggcatcggctcacgcgcatgcgcacgcgcacgcggcgcgcgggcagagcgaggggagagctgagggagagagagaggaaatcagcccaccgaacctgagggagggaaaatagacttttgcggaggaatttgatttgggaaggatttggattcgggatttgaatttgacgatagatcggggattcgagatcagggattggcatggagacttacaacaagcaaagaaacagatttcgcaattagggtttttttttagaatttaaattttcctgataggcgccacgacggaacgggcgctacaatgtttttttttgtcaagattggatcgtatccttttatggggttctattggtttttttagcttgagatttatcatcttttgggttcggctacctgtgtgcttgtctgaaatgaagtctgaattgccagtccacttttttcgcagagaaatttgttcttttagttgtatttggtagagtttcagaaccagtaagttgtgctgctcatcaatcatcagttcatcctcaactgataggtgagaagatatttagccattagctacatgccaactagttgagaaagtttttttccactaaacttgaacagaatctctgccacagcgatactcaagagtagcagcactgcggcagcctctccggatgcggcgttgctccagattgctgtctccgccggcgaaccgtcgattgaggtcgtcatcgatggccagcatgttattttcgctgcctacgaatacaagccgttgctagagatttctgtctccgccgatggtgggagtgcttgtgcaagatccagaatgaaatgggcgattttttttcttttcttcttcttcttcttcttcttcttctttttttttttttgcaaaatgaactgcatgagtgaagaagagagttgtggaggggtctttcgtaaaagtaagtggaggaggcgggcggctaattgcaaaaataccacactcgaggtcttggccgcaggatgttgatccaaaggctcaggatgggtgtgtgcatgagtgcatctacctagctgtgtgcatacgatacgctgccttgaaaaaaaatgcatatagaaatatgcagaaaacatatatttttcgattcacatagcattactatgagagttatcgtaccggggtagcccatcacagtactcgaagtatagatctctagcgtgatacaagcccaggcccatgtaatctgttactataaatggcggcgaatagggagataaaaacctatcccaccaatcttgacagatggcaggtacccagaatttaagggatatcgcatcctccttgtcgccgatcaccctgctgctatataaagggaatcgacagcaccccttgggggttacgcactatcttcattcaacactcatacataggtaatccaccaaacaactggactagagtattacctcatcccgagagtctaaactagtataaatcactatgtcaccatttctttctagcatctagcgtactctataaattttattaccagtcttagaaatcgacagctaccaattaacaatacacgaaactagtgtaatcaaatcatttcacttgtacctattttgacgagttctagttcccagtcctctctcacttggcatcaaactctagcagctttcattgttaggtctacgcattttcagaagtattttttttaattttaggtggaatgccaaatgtatgatatactcacgtggataattagatgagcacatggctcacttaacttatattagtgactcaatgtgtattttgaaagtaaagtgatatatacatgatacacctaaacaagttaaataacccttcatgcattttactctttagaaaaaaaaagttttttttaagaacatgatgacaaaaataaactcaatgtagtatgatgggttggattttgatgctatcatttccaagactatccacatgcgcgtggttcttattgcatacttctttcgtcccatataaaacaaaaactaatatgaaatatgacatatttagtactatgaatctgaatagattattgtccagatttgtattactggaaataccatatcatgtactatgtttatttttatgggatggaggaagtagacagcagtacaatggatcccccaaagtattattgtgtattgacctaggcgttagctaggtcaaactacgtactcaattgttggcccatgctagctagacttgcagtaaaattagttttttcggagggctacatatactgcctgcacatgagcaaaaaaggctgggacacatttatatttattgaatcgaaagacatggcgttgcaaaaggaatacactgagaggagacctcaagaaggcttcatattattcttagccgaaacgacaattaacgtagacgacaaccacatcactgcatgaagcccgacgaattaaagccgtggacgagacaaagcagagctcgccgcagaatgcaagagagtttttgagctgcgcgtgcgcatatcactcgaacgcgccagggtgctcgctctgcatcttgaccacctgcttccaggaggcgcggttggagatctcctcgtaccacctcgcgacgtgcttcttggaggtgaagagcttcttgcccctcggcgaccgcgcgttgacgatgtagtgggagttcgggaggtgggacaggtcggccagggtgaactcgtcgccggcgaggtacttgttcttcgccaggatctcgtcgtacacgttcagcatctgctgcagcttccgctcgttctccgcgatgcgggcctcgtcggccggtatgttgagctgcggcgcgaacgccaggtggaacaccagctccgagctcggcgcgtcgaagctctgcgcctccgcctgcagccactgctcgatcgacgcccgctccagcgaccccgtcccgtagatcgtcctgttcccgtcgtctgggaactgagtgctcaggtatcggcatatcgctcttgaatctatgccacaaaacaacaagaagattaagaaacaagaatccatttgttaataattcaggtgattaagaaaatttagaaagcagtaattaccaacaagagtcttgtcgccatgcttgaaagtcacctgcccggtcggatcctgcaaaagaacatgggaggggacagaatgaagccaatgtacgtgcgtgattgtttcatttccaagagcctaaaattaaccgaatggattgaaatggcatgatgattttatttatacccgtagcttgatgaactcggggagcttgtgctccttcttgaaggtgtctatgcggatgagctcgaactcgaggttcttctcgaagagacaggtcaggaccctcgcgacgtcggtggacgccggctggccgaacacctgcaatcctgccgccattgctcaactcttcccggtgattaagctagctagttttcttcctcggtgatcgagcaatgtgcttgtggatttgcaggtgaaagtgacttaacctgtgtggctcgctgtgaggaggcagagacgccgatgggtatttatagggatggattaggtgcttgccttgctgcagaggattacaggacggcgaggaaaagagaaagctcaaagataaagaagagctagcccctgattcttgcttggagcaactatcatctccggcaaggaaaagagacgatcccccatgtgtctcggcgtgatcttttatcaatagggtaaccgatacaaaagaggctgcgtgcatttgtcggaatgaatattgcaaagaaacgaacaaggtacacaaggcatactggcaggggatgatgaacggagcaggggttacgtacgctacggatttaaggttggattcagtaggtacacttagcacgttctttagagctgtttcattccgattgtttttgagagagaaaaaaggtaatgtccaatcgagtgtgatgttaaacaggacattctagaacaatggaatttgatccgtccgagaaaacaagtatatcttgaagtacgagagtgccttttggtgctactgctacccgtgtatgacgacgtggctagatgcaacggcaatcacagatttagcttagcattctaaccgataaagttgcaaggacagtgttggggtagaaccgtagaagagggaacgagttcaatgacttcaatcggctcgtccaccacttgcaaagttgtggctcacatacatcagatcatatgagcgattttgctatgcattttttgatcaaatttctcatcaaaatttgtcagatataaaaccacgacacgaaatcagggtcattgtttggcttattcacagaaaaaagacaaacggtatatttacaaacaaaaaaaaatttatgaataaaatttttatatacgtgttctcagcgatctaaaagcaaaaactgaaaaataaactatgatgaaaaaactttcaaaatcaatactaaatttaatgttaaaaattcaaattttgactaacaagtataagcataagtaaagatgaggccggtcctaaaacgggttggcctggataacctggacccctacaaatcgggcgcccgatcgtgggtgggaaaaaatcgggacgtcagcgcccgatttacgtgcaaaactattttaaactgatttttctcttaaattactaatccaaatcatgatccaattgcaccattaaattcgttataattaaatcttcaaaacaagaccacacatggatatattccgacaaaaaaaattagcttattattgaattatttttaaatgttgcgatgttccaccaggtatattggaattgtttcactaagttgatcgaaaatgtttcacttgtttaaatctggtgctgtttcaccttatataaaaataatatttaagtaaatagcaaaaaattgtttcagttcattgtaacatttaatccatacatagtgaaacattataagtacactaggtgaaacatttttcggtggaaaaaaaataaaacgaattcccttaataggaggtttccaaaatatgtgggttttttgttgcactggaatatttcgtttactgcaacattagatctatacatagtaaaacattatgagtatactatgtgaaacatttttttatggaacaaaaaataaaccaaattctcttaatagagagtttccaaaatatgtgggatttttgttgcaaatgagtattttaattcactgcaacattagatctataaatagtgaaacattatagataaattaggtg

SEQ ID NO: 4795 - DNA, 10359 bp, Oryza sativa
  unsure (1)..(10359): unsure at all n locations
acatcaaaccctatagatgatcggttgatctggtggagaatggtcggcaaatcgccagcaagaccctgtctagttgccagcggtttcaagactttaaacgattctactctgtctgcctttctccccttaattgtgcataccatttaattttttttccgttgcaggatatacaagaccatactaatactatacacacatccgcaagtggtctcttaacacactaaaaaacggacgaccaacacaaatctctaactttactagattcctataaaaacatgcatctgtgtaatatttatgaacaatttaaattctaatagatatagagtcatatgctcacaactcaactcatagcagtacttcactatctaaattcaaatctactcgttcaccaatgaattccttacaaatttgtgttgtggcattcttacatccaagatccttaggatccttaggcatggaatgatggttcgcttctagagctcctaaacgatgtgattttttttttttgtgtgtgtgtgtgtgtgtgtaaatctatttatctataatggtaattcatttcatcgtttgtttgtagcctcaaataattatcatcaatcattcacctattcagcattccatttcattaaggttgttttcagttccgcttaagggtttaactgctttcccatattcagtgaacacgcttcctatttttagtgaacacgcttcactactaaacgatgtgtgttttaaaaatctgtctacgcataagtttctttttaaaaaatacattattttagtttataatagtattcaattagtctaatgactcttctcgttttatgtgccactcaaaagctcaatccaagcacaaaagaatactattattcaggcgaagaaaacaacagatttagaactgccaggtcgattaacaattttatttaatcactaaacaagggagaaaacaaatgacctgtaaagcaacgaggtacatggtatgaaactacgtcacaacaagaagaggcttcatattatttggtcacacgacaatataagcagggaacaggcaaactagcgacgatgacaacacaggacagcagaagccagatcgatcgacaacggacacgatgaacttgggcaatatatcaggccattactcgaatgcacccggatgctccctctgcatcttgaccacctgcttccatgtctcgcgctttgagatttggtcgtaccaccttgccacattcttcctgccagtgaagagcttccttcctctctcagaactcacaatgtaatgtgagtttggaaggtgagaaaggtcagccagggtgaactcatcaccagccaggtactcattctttgagagtatctcatcataaacattgaggacttgctgaagtttcttctcattttctgcaataacagcatggtcctggggaatgttcagatggggagcaaatgcgagatggaagacgagggccgagctgggagggctgaaattttgagcttctgcttgaagccactgttctattgatgcccgttctagagatcccgttccataaagggtcttatttccctttggaaactgagtacaaacgtaccggcatatagcccttgaatctgcacatagggttcacgttgtcctcaaatcctcaaaaaaagaaagtaaaactaataacgtaaagtagccattgtaatgtggatccatggtggcctaaccgaccatggttttgtcaccaagtttaaatgtcacttgcccattaggatcctgaaaaggtcaaaaagagcccagcttaacttagtattcgagagaatgattctaaataaaaatacataaatagtatcgtacccgcagnttaatgaactcaggaagtttgtgctctctcttgaatgtatcaatgcagacaagttcaaattccagatctttttcaaagaggcatgtcaggaccctggcaacatcagtagatgctggctggccaaacacttgcaagcctgcagccatcgtttctattgatttgattgatcacctgatcaagttgtttaaaacgacaacgagggatgatgacagcaggattcttaatcaggtatttatagaaacaaaaggagaagttctatgcttgccttgctaccaggcaccacaaaaatggaaaaggaaaagtgtaaagaaaaagaggaagatctggattcttgcttgcaacaatcatattgtctagaacaaaaacaaatcctacaaaacagccttctttattagtatctatgaagtccttcagcactagagtgaaaaatatagcatagaaggagcttgctacacagtactacaagattcttttatattgtttatgagaatttatataggacagtaagaagaagattggaatcaagtactagacatacaaagaagatgttgtgacttccgccagggtataagaataagcttttcaacaaaagcaacgtccctagtacagagttggatataatccagctgtttaacctatagaagattaaccaacgatacatctgcatgtgcttaatctttaatgttgagcaaaagacatacctgtatgttcttcaactttaaacaaggactactagttgttaacttagaataacattagcgggctgtcaggagttacgcctgcaatactacaagatgaacttaaaatgactctgcatattacttgtaataattgcaccatgatgtagcaaaaaaaaatgaattggaaatctacaatattattgacattctgagcaagggaatcatgattcatgacaattcgttttccacctcatcttggattgctagcagcacaaaatatcggggaatgcttagggccttttcactgtacaattcctgaggcaatgcccaataatcacaataaactcagaatagttctcaatggttgtatctcagcagtgctgttttgctgacagcctactaacgttgaaatctctaaagcatttaccctcaatctcaacactagtaattagagaacgtatggataaacaaaggagccaaaacatttccagttttccaatctcataccaaaaaaccaactccaagatcagctgtagcctgaaagttatatgagtcgttaaaaaaagaagctatatgcaacttaaatttcaatagtgaactagaacaatctactaaaaggaacaggacaatgcagttctttttgctagcagacatatcaagaatatgtaaatctaatagttgcatattatgaatgtgtggtaggataccatgtctgtcaagaattcagtgccgacagtatggcatttgcaactatttgtctataccattgttaccttgttaagggaactgttaggtaagtaaacttgagaacctgaaaatagattcaaccttatccaaactaaaaggtacagatggtagcacaatattagggacccataggaagagcttgcacattttgtcaaatgatacaaacaactgaacaagaccgaatctttaacgcaactaacacaagacgctcagaggggaaaaaacaagaagcctcatgagggccgtggtacattctgcaactcaacaaccttcttccatgaaggacgagctgatacctcatcccaccacctcgccagattctttctctccgtgaacaaccctgccttgttggtcttgcgcacaagaagatctgtgttgggcatgtgcaccaggtccgccagcgagaactcatcacctgcaaaatactggttctcccccagccactgctcgtaaacatcgagcaccttcacaagtttcgcttcattttgttcaaccacggccatgtcagtggccctacccatgaacggcgcaaatgcgagctggaatgccattgccaagctcggtgggttgaagctctggccttcagcttctatccatttctcaatggcagcgcggccaaccgccccatcttctttcctgcccatgagggtcttgttaccgctgtcggcgtactggtcacagatgtaacggcaaatagccctcgactctgccaaacatgatatgatacaatcagttaaaccatatgtagatctcctcatcttttgcattcaaggaccattttagaacatggaaactatatcatttttttcacaaagggcactagtgattggggaaatttctaggtaattactaattagacgcggctacatgttatttgcatctcctttttccaatatattgatgtgatgaatcagtacgtatttcgaacaaaagagaaagggagaataaaaggaaactggaggagcaacgaaattagcggaggaaacggggggggattagggttttaccgaagacggtggtgaggctgtctttgaatgcggggacctggccgaagggctggagcttgaggaaggaaggggacttgtgctcgcccttggacatgtcgaccggctcgacctggaacggcacgtccttctccaggaggcaggccgccacgcgcgccaccgccggcgagatcatcggaccgtacaccgtcacaggcgccgccatcgccgccgctccttcttcggggacctgccggaagaccagagattggataggaactggaagcaaaccactagtgaatgtactccactccactagctggccggagacggagggacgcgagtgagcggcacactgacagtctgacacactgacagatgggctcgagtggccttatccacggtaaaaactcacagaaaagcttttaattagacattctacctaggatatcaagttgtgctaagcgtttggatcccgtgactaaagttttcttgtcacgttggatattggatgtttggacactaaatatataagtattaaatactctatagactactactaataaaactagataaattttttaagtctaattaacctataattagcacatgttactttagcatcacatatgctaatcataaattaattaggctcaatagattcgtctcgcaaattagtctaaaattatggaattagttttatcattagtctacatttaatactttctaatttgtatcgaaatttcggatgacagggcctaacaccggtaaaaaaattcctgctcagtagtagtacatttttactacaaaccatactgtatagagacaccattaactgaaaaaaaaaatctattgtatgttcgtctttcagtactggatcaaaacatactacgcacttttttttttttggttttgctccggagagtggtgcggctcaacctggtttcggtggctctacagccacaaacgaggatagtgagaaacaaacaagcggatgtatagcttacaagcttgtttatgctaactacggcaaggaaactgaaactaactagaggtagtggacctggcgctttaccaaagtgatcttttgatactaacatatgatgaagcacatgtcgcataacaaacaattagagcgtatccacaataaaggtgcccacttaagatatcgtataagagccagcaatcgtaaacatcttatatggcataaggtcgataaataacttaactatgagaaaagctgaaacctggaaaaagataccagtacaacatcaggtcaggaaagcaaacaatgtacatacataagcccagggaatctgaatgcaacatgcatatcgtgtatgcgtgttgcgtgatacaagtatacagcaacggataggtttgcatatgcatacaccgcaagaaaatacctcaactggttaagacagataacacagtagctttataagaaagaaaaatgaaatggtggaggtacaacaggagatgaacactagcaggctagaacagggagattattgtgggtcaagaaaccttaaagagtgatgccttattcttcagtgatggtttcagtgtcagatacaggttcaccattcaaaatccactgttcaagctcatcaagatcatcatcatcatgtcgataccaatcggaggatctatcccaattgaaagtccccaattcttcaccacggcaagccatatgtaagaatggacggcttcgaacaagggcatccaccataaccctgttcaagctgcccgttactcctagccatcgcaatcttgggaaatatggtttcttgaaccaccggattgcaagtggtgtaatcgcaccacaatcataaagatccagcagctgcaagctactgccatgggttccaccatcaactagcatagacgcaagagccatcacagcagcatctcctattttcgggttctctctcattcggagttcaataataggagttcgactccttgctaataacatgataccatcatcagtaatacctggtattctagagagatccaacacctgtaagctctgtttaacagaaccagcaaacaagagtggtatgcaatcatttgttaactttcggcaacccctcagagataaggaagctagtggacatgttccaaggcccagatacttcaatgcctgatcactgatatcacttccatccaagaataatatctgcaatttgggaaggcagcttagagatctaacagcttcatcacccagactcctgcagtccctgagatccaatacgttgagatccttgttgaatgacaacctctcaattccaacgtcagtaaggagattacaccacctcaggctcacatgtgtcaggcaaagggaagtggcaattatgtcatggaaaacaagatctgtgaactggcttccatgggacaccctaagcttatgaaggccagaacaagagtggatgatagccctaaaacctgtgtctgtcacgcgggagaaaccaccaagacagacactctcaagacttgagcacttttcagccattagcaggattccaagatcatttactcggcggaaagaggtgaataagaactcctgacttctcatgagagaaatatgcttcaacttaccatttggattaatctgctgaagaccagcattggtgagatctgatgatgttgtaggttctattataggtgcatcctgcaggtccagatgtgtcaatgatggaagcgcagttgatagtgaaccaatcaaatggtcagtgatgaagtccacggtgaggcataacttttggaggctaggaaagaaaacaggttcctttacatgatgcatgcatcgttgcgattccatagccacagtaagaagttcaagcaacattgtcattggaatatatccgatttctagggaggtcagggcttctgaagcagatgcccacannnnnnnnnnnnnnnnnnnnnnnaacattgagaaatcaagggccaacctgagagactgaaaataagagggacataagttgccagtccagaacagtaaaaggtaattggatttcaaagcaaaagataatcatacttcaaagtagtagaaatttcacaaagatttatgttcatagtgacttatgatccaatagggaagagtaatagaaaactaaacaatcacaatataaacacctttggtttcacataactgattcggtaataaaaactagaattatatatatctacggtgttttcaactaatggaaaacatgattgcacaaattagttgttgcaatagtaattgagagcgaaacaatacctccaattgagaacagccattaagcaattgctgcagatcagagaagcttatcggtagtcccctacgctcagcaagggcattcagggaaagcactctacatccaagcgggaaagaaatgtacttctcaataccatatttgacaactgaatcaaactttagttcagaacagaagcgactctaagcaaacagtaacgctggttcactgcattttgttttattgggatcataaactgcagtattttctgttagcgatgtcaccctgcagagttaacagagcagtagaagagtacctgagttcttggcaggtggctccaagctcgcagagcaggcggccgctaatgttatcgcagttgaggagcatcagctcatggaggtcggggcgggcaaggcagtcgatggcggcgtcctcgagcctagcgcagtcgaggcggatgctccgcaggctcgggttcagcggcatcagcgggcggagcagctcgtgcgtcagcgccacctccttcaatcacagacaaagacacaagaggaaacgaaaccccgtcaaatccgtagccggtggcgatggcgatggcgatgcgagagagcagaggcagggggggtgggtggttactgacggagaggtggaaggaggggaggaaggagagggcgttggaggcgcacgagcggaggcagcggcaggcggcggaggcggcgacgagggagcggacgtctaggcgggagaggatggtggcgaggacggcggacggcagcgcggagtccatcgccggcggcggcggcgacgagatcggatctggaggaggcgggcacatggcggatcgagttcggtggtggtggtggtggtggtgggagtgagagagatggcggtttttgaggaggacacgcataaccgttgctgcttcgcggaagcttcgtttcggatcacgggccccacttggttgcggcgcggggatccccctctctctctctctctctctctctctctctctctctctcctctttctctttcttccttgccagtgccacggcgggtggtttgttttgcgggccgggccgcacgttgggctttgactcgcgcacgcaaagttttctcccggcttgcaggagtttgtttgttttaaattcggattgattttgtttagttttgaaatggactcgtcacttctcggacatttttgtgtgtaaaagctcggtgacagcttctacggaaataaagatgatgtcgtagaggacaggacacggcctacactacaggtcagatgaagagtcaaggcagtattggtagaaggtagaaacacaataataaataatacattctcatgctgtatcgtgtacgctctgttcgctatagttgttttatagaactacatagaactatatgaccattgctgcgtaaacctttcaacgagcagccaatgcctttatcctagtacattcctactgctactcccgatcactagcagctgggcctgggcctcctgctccaaccagcaagatcgttggcgcacgttatccctcacgggctgttgggccgcgcgacgattagcagagccagtgtaagcttcattaggaaaaagtacaccgaaggtccctcaacttttatcgagttacaaaattttcccccaatcgcaaaactagatatcggccgtcccttaactaatcaaaaccggccacataggtccttcggtggttttgaccccgattttgtcctacgtgacggctgagtcaacgtgggacccacgtaggcccccatgtcagcctcttcttccctcctctccaacttgcttcctctctcctctcctctctcaccccctctcttctctgtatcgagtgaagccggtaaggcgggagacgacgacgcgcgaagaggcgagctcccatgagctgatgtagatgacgcggacagcgcgggacgacggccgtccttccccgtccccgcagtcgctgccggcgtcggcgtcggcttgccggtggcggcagcatcgcaagaggaagagagcgtcggcgtcggtgattcgatccaatccggtgattcgatccgcgccagtgattcgatccaatccggcgagagagggggagaggatgctgctggggtgggcggcgcagtcactgggagcgccatctcgtcctcctccagctctgccagcgccttcccacggtcgccgctaatgtcagtgtcggcttggcggtggtggcggcatcatgagaggaagagagcgtcggcgtcggcttggcggtggcgacagcatcggcggcggcggcgaggcgggaggaacgcggcgacaacagtgacgccatgagggtgcttgaggaccgatgccgcgacgccctcggcgactgccgcccgcacctagctcctcccccagctattgaggaccagtgccgcgacgccctcggatgctggcgccaccgtgctccccccgtcctctttgctctgtccccgcggtgccgacgcagacgatgggcacgccggcacggtgctccgtggtggttggcgcggaggcgagcgtcgcggcattggaggaggggtgagggcgagctcactggcctccccgaccccctcgcaagacctgcctcctccctctctgtcgctcgccgccggtctccccgccccctcgctggccccacctcctcactcgacggcggctgtggcctctgctaccgctgttttcccttctcccgcgtcaccgccgccgcgtcgccggccgccgtctcctccccacgaccccgctcgccggccggcctcccagagaacagagagagagaaagagagagggaaagagagagggtgatgacatggccacgtgggtcccatgctgactcagccgccacgtaggataaaagtgggg

SEQ ID NO: 4796 - DNA, 11797 bp, Oryza sativa
tcggcccccaaccacaaaaccagatatataacatcccttgacttataaaaccgttcactttaggtccctcggtggttttgaccccgattttgtcccacatgatggctgaatcagcgtgggccccacatgttaggatgtcatgtcatcccctcctatcccttctctcctcccgggcaagctagccgatgggtggggaggaggtcgtcgacaacgagagcgaggacgagggggtcgatggcggtggtagtgacgttgcagaattaggcaagtaaatgaatgaatgagaagagtcctacccctatctctgtgtctccaattcttgcagaattatgcaatccctcttggactacctcggtagtaggagggttgtataatactcatatctcaatcctcttcgtgctcacctgaattcacatgtaacaacacagcggatgagaccagcaaggaggccaccttggatgcgctgcgcgcgcacagagttgcggatgagttcttgcgaacagctaagataggggccatttttgtaaatattttagatggtataatattttggatgcgcataccttgccgccctctacttgggcggtagggggcattttttaaatattttggatggaataatatttttgtaaatactaaaaaataaaaatgaaaaaaattcgcatcccaggtggcaaaagaaggaaagagcaaagcggggcaaccagctgcctgcgccggcccacccgtccggcgacgaattttttttattttaatttttttttattaaaagttttacaaaaataatttttcattttgaaaattgacagaagtggtcgcctaccgccctctgggatggcgatttttaaaaatcgccctcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaaatttttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgctatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttgtaagccaaaagaaacggtcacataaggactgaagaggtagaacactactgacgaggcctcttacccatgtccctcctaccctgcgccctaatgtgcccctgggagtacgtgagtcggtccgggggtacggcacggccaacccgtcctgcctgtacaggtgtgacctctggctgctcctgagtgtgcgtctctggagctcctccaagctgagaggagcctagtacgtcatggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacatgtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaaaaaaaatgaactaatctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctacgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatatgcaccactgcaatgtgcactctctctaggaaccagtaccagctttcagtgttctcactctctacaaatgcaaaaccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttcccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccttgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattttgtagacttcttggtctattctaaatcctctcaacaaccaactataaattgactgaaatgttttctccgcaggcctatcgatacccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctgtatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctctcctctctctctttcgttttttttggatttttagtgaatataatgaaatttcagagaggggggactgggctttatagggggaaggcaaaaatcgccctcccccagggcggcaagggggccgcctgcaaaattccatgccccctcgccgcccatttgcaggcggccccccgcacagtacaaaatcgccctagcggagggcggcaaggaggccgcctgcaaatttcgttgacggccgtcgcccgagagcgaacggccgtctgccacgtcattttcgccgccctctgggatggcgatttttaaaaatcgccctcccagagggcggtaggcgactacttccgtcaattttcaaaatggaaaattatttttgtaaaacttttaataaaaaaaaataaaaataaaaaaaattctccggcgacgaggcatttacgtgcacgggcccgatgccccgatggaggcggtggcagggcgagattccccggcgtctcgctcgcatttacctcccctgcctgcaaccgcaaccgcacgggcatctctcatcaatgcacgggcatggcatgcacgaaccatattccagtcccggcctgggcctgccccaaccaacaccccgccttgtctcttttgtctcgccgtttgggcctcattcaacgccaacaccacgccaccaacacacaacactctcctctcgcccattcaatgcaactcggactcgccctctcctctcgtcctgtatgtactcctcattcatatacgtgctagtactactactagtactacactacagtcatgccgtatacaggcacctgcagtctctccacatacaatgcagtaaatcgatcccagagatctctgtagaaattatggtagaagaatcaaaatagaccggtgagtttaatggcctggtgatacacgcgcatgcagcacatattctgtcagtattatttgctgcaggaacatgtgctgtcagtatttatttttgcggtgctcatttctgccatgcaacctctctctcagtatacgtacctactgcaacgacagtactactacgaccagtaaaacttggcatggtacaagtacaactacaaacaagggagtagtagtcgtagtagtgatcgtcaagtcgtcaaggagttaggcatgcatgcgtgattcttcatcgtctcctgagtcccgatcagccagatctgcagctagcgtcatggagtacagtagtagtacattcaaattgccatggtcccggaggttaaccccgttccagtacctgtcccaggttggccacctaatcgagtgctcttgtagaggtgtggctgtgcatgacagttttgatcgatcatctccctgggcaggggcaggggcagggcatgctcagcctgactgcatctcaatcgctgctcgtctcaatagtcaatcgtaatcgcaatattgccaagatgtttctgaaaccgagcctgtttatcctgacctgtgtgatgcagcatggggcggctagctgatggcacatgtaagtttgtgtctccgtgaatgaatgctgtaagctatagctagctgtaatcgtccggatctcgccaagcagatcaatcaaggcccgaaatcatcctcacccgtccctctccggccggtcttccagctcaaaaacccacggaattaaacgcgaggaatcctcacaccagcacgtctaggacgctagcgcgtttatagggtgtgtttcacgttaaattggaagtttggttgaaattggaatgatgtgatggaaaagttgaaagtttgtgtgtaggaaaatttttgttgagttgtgatccaaattcatttgcacttaataaatgccagcttcttccgtagtggagcggaggcccgtcgccggtaggcttgggccggagcgtagcggatcgtcatccctattagggttccaccatatatatacctcttgcaagccgccgtgcagcgttgtaacctcacctcagatatagtgaagatattttgctagctggcacccgtggttttttctctcctgttttgggaggattttccacgttaaatcccgtgtcttctgtgattgatctattgttctttatcgtttgtttgtctatcgcttcctaacagttttgatgtgatagaaaagtagaaagtttaaagaaaaagtttagaactaaactcggcccgctacttgcattgcgcttttgatcgattaggctacggtgaagaatatgaacgaagcaaacagaaaaatacgtgctgttatcagtctaaaagcttgttgttatcagtctaaaagctaaggcagaaaaatatcctacaataaaaaacctaaatcaactttaaaattaagttttgaaatttaaattttagttgtggctcgtgagacaataaatggacgacgataactacgaaactttcatttatcagtgttccaccatgacgctatcctcctagctggccgctgcttgttcaatgcctctagggagggatgagaccatgggcgagagagacataacgacgataactacgataattcatgcatgttgctggcccccgttgcacacaaaaaagcatgcaacgatcgatcgctggctcaagcagagatggggggaaggaatctctacacatttatgccattgcacctacatatgcatcatttttttgaggtagagagagggccgggtttccattaatgctgcagcctgtcttacacatttggtagccgggggacttgaatgctcacccacacaaagaggtccataagttggaggcctctgctttgctacccctctccatccctaagtccattccttcaccacacctctgctcgcctccttctccatctctctctaagctgcatgccttccattggagacaagggagagaaccattgcatgtccatcgtccatgcatctgcatatgcatggtgttgttcttctcgtctacctcctgcttctacatgtgacggagaagaagggaatgaaatggtagctatgatgttggctcggctcactcagacggcattggcgtgatgcaaagcatgcatgcgtgcttgctagctcacttgtgtttctgattgagccgtgccaatatcttagtgctctttcatgtgtacgtacgcgcacgcacggttgcaccatgcatcgacgacgaccactgccatggccgccggtatgcgtgtcttcacctgcatcaattcttcttgcaggtatatatgggctatggagttcttgcattacaatgagctgcttagctgattaaccattatcgcctagttttgtagttttcgagttttcagtaatatcgcacgaactaatgatgttcttgttatttagaccccgttatatatagttgtataacttgtacacgtagtatttctagcgtgggtccaattaatggtccatatgttaggtctcgactttgattttcaagcaccaatgcccacggagtgcacagtatatatcaattatatgcatgcagaaacttacaggattgcatggacggggtgcagcattcagcattctcatgcctgctaattgctgttccagcaatccttttttagggcagtgccattgctgctccagtaatcggacatcaccattcatacatgtttgtaacacgtcgtgcagaaagtacgaaattacctgcataattataatgtacaagctgatgatgaagcccaataaaatcgtgtaataaataacttcgatggaaattaaaggttggataatgcacgtaggaatgtgtatccaccaatctgttaattatggaggaatggtttatgacaggtagatcctagatactagcagtagcagcttactacactgtattgactgaaagtatctgctaatgtttttgtgcactcgaatgctatgcttagttgtttacctgcagtttgattatttttaactcgccaatccgggattatatgatctcatcagaagaaaagcttactcacgcgagtttctgtcagaagaaaatcctggaatatatgatctcttcagaagaaaagttcgaacttctaattctgccgtgtccactgaaatgatacaaactgtacttactgcgtgccgtcagcacgtcctgaagtctgaatatagtacaactaagctgccaatagtatttactagtttttttttactgaaatatctctttttatatttattctctcatgcaattctattcttcaaaggacctcccatcctgcctcctgccctcctgcttctccagttgtttacaaaattaaattatcttatgtacccaaaaatagttctaattcaacttttgtctacatttaaatatttcgaaaatatcagaatgagcgctgtcattacaaaaagaagaatgcggggtatccaggccaacaccccgacttgtgcttacacaaatgtaaatgcagatggtcgggtaatctctctgtttattaattgctgcaacactgtgttgcagcttccaacttccacaaaatgtaaatgctccagctcctctcgctctgcctcttactcaatgatgtgtctgtgtgctgtattcttgaatacttgtatttcattcaattcgaaatcaattaaattgaaggggggaagggggcagagtaatacagcggatcaccatgatgccagcttgtattggttgccaaattgcttgcatatgaaaatatcaagatgcagttgatgacagagacggcatttacccgtcactaataaagatccaaaattcagagcaattgtaacagagatgaatgaaatcagcaatgatggctacccagaaaattttgtgctatcacccccgtggtgttgcgacagagcaattgtaacagatataatgaaatcaataatgatggcaccatttgccattttgccacacttgctactgagagcaacagtggaccttatggcgccactttaggtatatgtacttcgaatatcagaatggattaatatgaagattacaacaacaaagtgctaggagtagagatcaggcatgtggttctaatggaaaccataactatatacttagttttcaaccaacttgtagccaactttatgtcttggccccttttcagaatgcaagaatgataaaaacacaaaagagagggttgcagaacatataaaaaaaatatatgaaagaatggatgtttggttagaccacatggatttagggagagacagactccaagaaacattcccatgaggttggacatcattttaaatttccttcgaaattacatcattgagggcctattcgttttggaggaattttaacatatagaaataggaaaagtgaaagaataggaatgaatatggaagaattttaacatatagaaataggaaaagcaaaagaataggaatgaatgcacacttcaatccataggaattttcaagaggtttgagtgatgaaatttttcctatgttttctctttacaacttgtaggaaagaaaatttttcattgatttttttatacctacattcatatgaatgtaccgaatgaaactcataaacgaatagtccatgaatattccaaagaaattaggtaggattctaaaagctttaacattttgttccaaagaaccaaataggaaagaaattaccatatatatgattcaaattctacaaaacttctctacaattgttccaaagaaggccttacatcataacgtattgcacattaggactagagtgcactaacaacttcgggtaatagaatggttttctgaaggatagttagcaggacattttgacattgtgaatgataccaggaattggaacttgggttggaatatgataacatcagagtagtaaaggaggaattgcaattactgtagctggtactccagcacagtagtcaggagcaccatacatcaaatcaaagggatgaggttcccatgggtagttgggacttgccaaggagtaactatggaagtaatgatatgagcgtaaatgagatggcagggaaagcatcaaaagagacagcaggtagagaatatggggcatggttactttggtcagggtcagggcatttacacgcatagcatagatagatcagatgcatggtgcccggaccggacctgacctagcctggcctctatatcgtcagacaaagattccctcattcactccaacccccgcccagccctatacccatgttgcctagcatcgcagcatcaccactccttgctaactgtcatctcggcaccaccactgtgatagcatcaccatcgcttgcctattgtgttcttctacagttcacagctattcaaactg

SEQ ID NO: 4797 - DNA, 4816 bp, Oryza sativa
tatgtgtgtatgacaggttgatatgatggaaaaatactgaagtttagatccatactttggatctaaacacagcccaagttaaaattgctgtgctcgtaacaaggccaggtgtagatccaagagctctgctgccagttgcttttccagtctggttacctttcatggaactgatttaggccctgtttacatcccacccaaaaattttcaccatgtcacatcgaacgtttaaacacatgcataaagtattaaatataggctaaaaaaatgactaattgcacagattacgactaatttgcgagacgaatcttttaagcctaattgctccatgacttgacaatgttgtgctacagtaaacatttgctaatagaagattaattaggcttaataaattcatctcgcggtttactgacggattctataattagtttttttattagtgcccgaacacctcatgcgacaccctatataataccttatgtgacacgccaaaactttacacctttgaatctaaacacccccttaactgcgaggctagctctctggctgtgcgcttgtgccgaaatcacttcaagttcgtccatgctgctaacaacgttgaagagctctggttgacttgacatagaacatggacacaactacacatggcctctccaagctggccccaaggtacttgacaccgcttcctcccataggattaaaaagagcaatttgatgtagcttatgggttttcagcaagccagcaatatatttttgcctcgttctaaacggcaaatcgccactggtaacgttcagagcagcataaggcaaccaacagcaagacatcaataggagcaggttttgcagctcaaccagtgtagtaaatccatgggtctccatactcccatggcactgtccccctcagcgtccccaaggatgacgctggcatgcccagactctagagttgtttagtcataattagattctcatcgtacagtgtttgttgcatagagaagtttcttgatagttttaagatcctacaattgttaaatatttatatatatcccaaagaaaaatgttgcaaccaccatgtctgatttctgtgtatattattgtttattaaatccaaaattgaagcgttggctgtgtcacatgtgaaaatatgcagagaaagtgcattaacgactgccttggagtgatacagactttgagggacctagggatgcagccataccttcattaagctgcattattttgaggcagacctgggtattgaagtccccaattaaattgtacacttgtactaaggccctgtttagatggggaaaagaaaatttttgggtgtcacatcagatgtttgaccggatgtcggaaggggttttcggacacgaatgagaaaactaatttcataactcgcctagaaaccgtgagacgaatcttttgagcctgattaagccgtcattagcacatatgggttactgtagcacttatggctaatcatggactaattaggctcaaaagattcgtctcgcgatatccatgcaaactgtgcaattagtttttgtttttatctatatttaatgctccatgcatgtatccaaagatttgatgtgacgtttttgggggaaaaaaattttgagaactaaaccaagcctgaatagattcatacggttttgttgaaaaagttcgtgtaattggaatgggaaaatagcagttcagtccaaattgcttccttgaaactaaatttatgaattatctatatttatttagtagttttaactacatggattccacacaagcagtgcaggtagtagtactaaactagtaacatgttttgatctgttaaactgctataaagactagctctaattctgtaccacgagatgtttgatatatatttgaggtcattcagggagaagcaaattgcgattgggagggaacaaggatgtaggatcttggacatggatctcttgaaagattgagataggcaccactggggatcaaagaatgagccatgcacaaactataaaagtaacaagcacgaactgtgcttgtgtgatctgaaacctctgattacaagagactagagagcatcaggctcataaaatctcacttttgatttttaaactggggttgcatcatgcattcatttctgaaggtatttgagggcaagtgacaattaatgagttgcaacagtacaaacccttaattccatcctttcttagcaaggataggtggtttaagatgagaaaataactaactttgctaagctaacttgtgggtcatggcatgtacaagggaacacagtagcacactagtgccaatggtgatgctcaattggttagagtccggaaattttgacacaaatcggcatgtgacgtcctgtgcattttcaacaaattttatatcaaaatatactgatacatacactttttaccacttcacatgtggtgagaaaaattatatctgttctgccgatgcagtgagaatttacactaacaatcgggacgtgaaggagaaacaaaataattcttgattaatatttgtatccaagatgctaggaatatctaagattaatggggtagaaagagaaaataatactactggaaatgtaaaagtatgcaggtcacgctaaacttatatttggcattaataatttgggtatcttgagttttttatggctaacctcttaagattatacagcattgatatcatggaactttggccttccaattatcatgggcataccacaacctgttgattcccttcaaggagcaacctctatctgaaaccaaatgcttccattcagttcaagaaaccagcagagatgtataaaagcatagaggctaactgtacctaccttgaaccagaagtgattagatcatgcactggagaaaacagagttgcctcccaacagctcagtatctttcaataaactttaataaatttgacagtgtcatataccatccaagtgctgaactgggtcatgttgctttggtagacgaaagctcttgagtaatttgataagttcatacgtccttgcatgatgacccaaccggaggcataactccaaaggggtaaatccatcctgaagtaagcatataaaccaaatcatactctcatttgacagaagcctttatttaagagaaatgcaggaataagtagtgctcatgcatgtctcttaaataccatctgaaattatggcactggaaatgcatcacaaacagtgataaaactgatgtgagaatatgataatagtatcacaagagaattggcgattaacacaaaacaacttatagacaactggtggcacataaataagttcctcctgggtcatttgagaactaccagcacataatttgctttacttacttgagttttcaaagttctatcagcaccctttattaagagtagcttaacgatatcagttctctgtgtttgcacagctagatgcaaaggtgtccatccatactgcaaaatgaatgagttagacaactaatccatcagaactgaaaataaagcaagatactcccaaaaatgaacatacatcatctggccgattaatgtcaacattgtacagcaagagagtctttatggtctgactgcatgctgtttggactgcataatgcattagggttgcaccatcctgtatcaccaaaattgcactgttgtcattgaccaaaactatacaaaatactgcatagaacaggaaagggatcaagaagtacgagtctgcaacccaccataacaatgcctaccagaggtagaatatcttagcataactaaaagatacccaagccatccaaacatagagcatactcactttatcgtggatgaatggatttgctgaattccttatgagatagttgataatggcatgcttcttggaaagaattgctttatgaatagctggtaaaccatcctgagaataccaccggaaaaggcccaacaaattataatgatatcacaaagatgtaaagcttctaaccataaccttttttaagatgagtcaactttcaaaatagagcttaccttatcaagggcattcacattaatattatgttttagaagattgtccaacagatagaaatctcctgatgctgcaattgtgtgaagtggaagccacttgctctacaagacaaatagattaaggtatgtcaaccatcagtcagtagataatattgcacagtaaactaaaagagagagtagcaaacaccacctacatagcctagagatgaaacccaactggagctacacaaatcaaaatagataaactggaaataacaaacatgatcaagcatacgcctggagataacacaagctttatgatgtgacatatcaagatgttagtaatgcaagtcagaaaaaatatatggtgcacaatgcactcttccatgagacaaaaaaaaatgttagtgtgacgaattacagacaataatagttaagtcactctgggcagagagtgcttacagaagtagcagcttcaagatcaggtactctcttgttcagaagaaccttctcctcatctgtgaacagcttccgtcggcctaaaatataatacaaattattcaaatccacgagaacagcaatgaaagaaaaatgtcacatagtgaagttgcaccattacttggtcatggataattggatataccaaacaaatgtttcatccgataaactaaactagaaatggtataatcactcagaaagttgtgtttcgttgaccatgttaatggcaaaaactacatatatttgtcacgtgaggagtaaagagcatcaaatatactgtggtaatgtacaactactgcattaatcttttttttttttttggaatcacctacta

SEQ ID NO: 4798 - DNA, 1813 bp, Oryza sativa
tccctccacctctccggcaccaggctactcccccctccgccgccggcctccgcggccggcttccgcctggggcgcgaggtggtcgatggcgccggagaggggaggtcgacatcgggctcctcgaaggcgtcgtcctcgaacacgacgcagtcgccgatggcgaaatcctcgtcgaattcatcgacggcggcgacggcgaaggaggagggagaggtaacgagcgggcggcgcctggggaggagagatttgctatgtgggtggaggcgaggagaggcggagagcgggtttagggtttggacatgggaagggaaggggaagaggaggaggtggtggtggagggagagggaaggaggcatcgcgtcgtcctcgtcccgccgtgccggaagacgagaggattagccggcgtttaaccggctcgtcagagtgggcctcgccgaaagggctacgtgtagtaacttatttgggccggaaggagcccagtttctctatggatgtgcaagaagcttctaaggcctttccaatccttctcaaattgaagcccataaatgaatgtcgggatacaacgagagaaggctgagacttgagagtactttgtgtgccatcgtgttgctccatatattcattctcaaatagatggcattttaggatgcattcatgcatgcattcgaaataaataatcactaaaatatgataagtatttgatatttcctagtcatattagtaggtttgttattcttaaaacttaatattttatgtggttatatttctaacatttttcataaattaatgcaaggtaaaaaaaataatgatcaaatatgtgtattggtattacctagaaaaaattaagtatatatataacttgttttaatagggtgagtctatccagcgaacgttcactagcacattagccgagcgagcaccttatctctttagatattctccaccagatctgttcgttccctaaagcttccccaaagtaacgtgaagaaagaggcggggaaagatgcaatgtgggagctcattggttcttcgccccttccctctaccccctttgttttctctcctcggcgtgccacacatctcaccagggtaaggtcctctttcacagcacttgttgggggtgtatccttcttcctcctcaccaaccagcaacgcaaaaaagaggttttaattcctttccggcaaggctgacatccccttcctcctcctcgccaaccaagcctatgcctcatcctacacaacatcgacaagatcctttatggatatacctcaccttttttccctcatatctaatttcttgtaagaccagtttcttgcattttttagctaagagttattgatttttggtagaaatatttacatatttaattgatagttggtgattttgagttttggagtttatgtttgaatttgtttgaaatttcatatgcagaatgtttctctgtataaagattatatgtacagagtttgtatgtgtaaagcttgtatacacagaagtttctatgtgcaaagtttcaacatgcgaagtttatatctgtaaagtttattcatgcaaagtttttacgtgcatttttttttagaaaaaaaggacactgaaaggtaggaaacccttcgtgttcatgcatgcttattaaaaatgcaagcttcacatgtcggacagattcaagcatactaccaacaaagggaaacatccacgcttccaccagattcacatgcacaaggggtggatgcaagtcgagccgttaatcacgcgcataagcgctagacagtgctaaatgacagtgcgaattgtggttcgaagtagggctgtcaa

SEQ ID NO: 4799 - DNA, 7544 bp, Oryza sativa
ttttttttaatgagcggtacatatatattacgcatagttcaaattactccctcaactattgtgttcattcgatttaccatcatccttcactagctaggatatgtggtatctaaattgatttcacaagttgcgaagaggttaaaggttcaacattgcattttctcgagcgtgagttttcttcggtctatatatgatatatgtacatttatttattgttaattagttaacaagtactacataatacatcctctggtttgacactacgtggcaaaaaactaaaaacattgaccttttgcttttcgatcttaatcaatttaattagttggtctagtcttttctcggttgcttttcgatctcccgaggacgagcacgcaagaaactttaatttcattgatattatttttttcgcaaattatttttctccgtactatttgctccttgtaacaacagtgaatggatgtacgggttttttttttctttttttatttcagcaggcgcgtaagccaaggcaacgtcaggtaccggcccctagctagagcactgtgttcgctttggcacatactgatccatctgcgtatttaccgacagggtatagtattactgagttagctagctgctactccctccgtttcataatgtaagtcattttaccatttcccacattcatattgatgctaatgaatctagatagtgtaagtcattctagcatttcccacattcacattgtgaaacggaggaagtagcaagtacagtacgaacaaaactgatatgtttaaaaaaacctgaacttttttttaaaaaaaaactatgctcaagcttaatatcgatctgtattttttttaaccgccagcggtcgacttacaaaaactgattgatattttagctgatttttttacaaagttgatgaaaaatcatcagtttatactagtttgttttggtcggttttcgacgaggagtggttttcaaatctaaaattaaaaagtaaacatatcctggatacacgtttatactagtgcatgtctgattgttcatatgtgcgcgtgtgttagataagtctgtaaaaatacagaggatgcattcctagtatgagaataaatatagttggttatatacacgtcattgtaattcgaaaatcactataacaggtcgtggatactctcctatgacttaaaaaactttgtttcatgaaaccggcgattaatgattatcaatattaacctagcttattccttttgtggtgcgcatcggcaaaaaaatgagtggaatctgtgagaattcaaaaaattcaaagaaatttttttatcttaaactatttttaaaacataatcgtcatcattcttcctcccataaatccccccccccctcccttaaaaaaaattagctccgaaaagccacaaaacaacccattatgaaaaaccggtgtagaaaggaactgaatcatatttctatcttctgatcccgttgcaatgcacgggcatgtaacaaagtagtacactccgattgtaaacatgtacacaatctgcatttcttggttatgtgcgttgttttctacccaaataagtggccatgaaataacgaagcattccatgtagatgtgaaattgcatttatagcttctgcctttctatgaacagtaacacaaatgccttcttcaattcaaatctttgcatgcttgtgtacgtccaattaatactctctacgtataaactgcctttaagcacgttacagtgcttcatttagtctcccacagttgttgacaataacaaaccaagcgaaaggaataaaacaatgtcacgatactgttctctcatatgcgcgcgcatatgatatatagctcgggacaaaaccagatgaaccatttctgtcagcataagaacaaaacgcacagctaaactttcagaagaaacaaagaagcaatagcagtacttatgcaagtgtacaaacaattggtaccttggcgtttaattcaaatccaatgttcgacaaatcacacggccggttcccataccgattcacaaatgcaaagcttacaatacttgagcaaatctttaatttgctctctggtgtgttcagaaacgaggtactaccactgctgatgaatatgaactcataaatggtactcgatctactataattcctggagcgaagtgcatatgcatgtatagctattactcctatatcatggatgatgaagatcatatatatgcaacctgtacctgctcacagtgctcagcgttcaatggattgtatagctagctagctacagacaccttccgccatagcctgcgctcctgaacaatgtctgcttgatctcgtcggtgctgacaacttgcctcttcccgtcctcctatcatgcattgtcgacgaacccattcaatattgaaacaagagattaatcaaaacatatatatgcctatatatagctataggttaatttgttcgagcaagaaatcaaggtatagctatatatcgaccgatatagatgttcagaaatccgcactagctaagttgctatagctatcaagaattcaagatagatatatagaacttacttgtaagcaggaggcctgcatgccaaagtcactgaagcagctcacgacgcactgctcgatctctagccccagcacctccagcgcgctcaccgtcgacagcagcacgccggggttcgccgggcagcatatctcgatcctcgtgttcccgctgccccggttctcgacatcgaactggaggaaaatcaaaccgcagtttaattagttagtttcgccccatgcatcacaaagttcgatcgcaacaaccagattaatttagctgcgcggacgcacaagaaatatacaagcacatacatacatgccaaactaaaactccatcgatgcgatgcttgcctgcgtagctaagctaggtacgtaccttggtggaattcctcacgagcatctcgttgttgttgccgctggaggaatccttcatcgtgttcaacaggtcgagctcctccggcgtgacgccgatctcctcctcgagggttttgatcctctccgtcagctccttcacgtagtcgatggtgtcaccaaggatcgaggtcctgtccatctgcagcgcgagcgagcgattgattgattgtttaattacagatatatgagcacacgggacacggagacaagaagctagctacagctagctaggtcaattaattaggtcacaagacaacaatacaaatcaatgtgtgtgtcaccttgctaatcttgggcacgatggaccggagcatggacagccggtcgttgagccgcttgcgacgccgcctctcggccatgaggttcttcgacggcgtgccgtggagcttgctccgcgggtggacgccgccgccgacgcctctgatgccggccatcatctccgagctctctccggcgccacctccaaacatgaacgtcggcgacgacgagccgccgccgccatggagcagcgccttgtcgccgctcgtctcctcctccgccaccattgcgtcgcggagaggagtgagctgcgtctgcgtctggctagccgcctccgaggggacgagctgggcgccgcagctgcggtacgggttgcagacctcgctcaagcagtcgaagttgaactcctcgtgcggatgctgaggcggcggcgccgccatggacgccagctcctggaacggcgacgcgtccatcccgcccctcgcctccgcgctgccgccgtcgccgccgtagaagaggaggtcactcatcatcatgccgccaccgccgccgccgccgccgccacccgggtacggcggcgcctgccacggcgccgatccatcacgccgcagcgacatgagctcatccaagaaggactcctcgtcaagctccatgcctcagctagctagcacctgcagcaagctaagctatagtagtatatatgctccctttcctcgctagcagtcacctctcctgcctagattgcccaaaccctcacgcttatactatcatccgagaccgggacggcgagtagctaagccacatgtccaagttgcaggggggagcagtggcagtggcagtgcagggatggaatgaaaacggccgtgaccagagagaggggaatatgaaatgaaatggagctaggctagctgggggcacggaagcaacctgggaaatgaaacgcggtgggccgcgcgaggttggggttgccaacccaacccaagcaagcaatcgagcgacaattattcctcgcagctagttttggtttggtgcgtgcgcccatgcagctaggcgccgctaactagggtatatcggtcggtaagggctcgcgcgcgcgcgccaactggctggaccgccgggtcgcgcggtcggtcggtcactagctcgcgcgcagtctgagaatggaatggaatctctccacttgtttaatcgcctggcctggctacattcggtttcaattatcgaccatgtcgttttcgcctgaaatctgcaatctcgcggaagaggccttttaaaattcatcctgtatgtacgtcgctggctggcggcgatcgaggttaatttgacggccggccccgcccagtgcaaaaagaatttggtcgcgcataatttatatcttaccccctccatagctagctaattaatcggcgtacgtcgtcgtcgtgtacatacatagggatagggccggggtgcagtagttgtcacggccacctacagctagagggagcgggagagcgcgcgagtcaccgcggagtcaaaaagaacgggctagtgtagctaaacaaaaacgaacgcgcgtaatacgtaaccctcagctctgtgttgtttagcgcccagattcccctgccaatttggcgagcgatcggtggtcgggtcgggtcggggtcggccccgcgcgctagctgcacggtgagatgccatgggagtacgcgcgcgccagttgataatttgctggtgctgtggagacgtcgcgtgcgcggccggttcatgcctcatgcctagcgctactagcttgatcgcctcgttctcgagctgatcatcgagaggtagccgtcggggaggggagcaggggcgcagccgcgtcgctgtcgccgatcgagtcagatcagatcgcccatccgcgtacgcgtacgcgtgtacttggtggtgtgctggctatcaacgacgtacgtgccgagcaatcgatcgtctcctgggctattggctatacgatccaatatacgaatgcggcgcgcgagactagctagatcgatcgatccggccgatcacatcattgccgtttagttgcgtgttcgctgggagctcagcttattagctatagcgaacgagcagttagtagtacgtgcgtgtgatgatcgatcgatatatatgaaccgatcgatcgatccgagatggaatatgctggagtggtgggtctcattatctgggagatttgagggggattaatcttgattcggatgagctatcagatctgatggggggcatggataagattaaaacaatgcgcatggaacaaaaaccccagtcgattgtttatccgtcaagattactaattagacttgctgtactacataactttgtccttggtcgcgggctaccaatttaaatactcattttgtttccttgcaatgatcgtacgtataactagttgtagtatatatacttcttctattaaaagaaaaactagtcgtagtatgcatgagtacgtatttcttgtttagaataatgccagcactatcaactggatagaaacgatgctaactttttttgtatgcacgcaatatatttccagtaccaggccacgccaactcatcacccccaatgaccctcccaaaaataagtccgacaaaactgttagcatcttcgtcgacccatgctctataatccttcttatatatgtgcaccaaaattggtcttcactaactaaactaaataatggcacgcttttttaagcccatcacttctctgttattttcatccatcggtgatgaacctacagggctacactaatatcaaatgagagtaacccaacgaatctaagcccactacatcatacaatatccaatcctttacctaatatgcatttatcagctatcttggcatattaattaatgttccatgataatatatatatatatatatatatatatatatatataaagacattgcacttacatctattagatacatatacaatataaacatttgagaatactaattcatatgtttgtgttttgctacggataaaataatatgttctaatatatgttttttaaggttggtggagcaataatactggtagaataatttatgttgctaattgttttcattttaaaatatatagattgcatacaagaaatgagtgcgcaaaatctaaccccaaaagcaaatcagaaacaacatagaattcactcctatactggccacgtccctactccagctagcactatcttgaaatatcttactaggttgagaacggcggccaggagtgaagcgccaacctaggttcaattcctattggacccaggttatctcataattttcttctctatcaattatagatgctaaattcctccttggtactataaacaaaattcgctcttcaagaaaaaaaatgttactacgttgatgtatgtcacgtcactgaaaaacttagggggtgtttagatccaggggtgtaaagttttggcgtgtcacatcggatattatatagggtgtcgcataaagtgttcgggcactaataaaaaactaattacataatccatcaataaaccacgagacaaatttattaagcctaattaatctatcattagcaaatgtttactgtaacaccacattgtcaaatcatggagcaattagtcttaaaagatccgtctcgcaaattagtcgcaatatgtacaattagttatttttttagcatatatttaatactttatgcaaatattcaaacgttcgatgtgaaatggtgtaaaattttagggtgagatctaaacaaggccttagttttcagaccactagcctgtcttaactgtagaggagaggataaatgttgtggtgatggatctctagtagtttgccatggactgcggttgatagagatggaaaatggtatgtgtagttgcatacgagatgtcggcttacgattttaatacgagcaaacaccacgctgtcggtatggaagtggaaccaatttttctatgggaccaaaacttagtactgtcaataacgttagaagagaaacatttgatcggacaagtatagcaaacagaagatggtacgtataacggagctcgatagagaccgtggcagcgtggtcctgggggcaaagtagctattgcctgtacgaagcagttcatcacatgcatggattacccctctgaagaggtactgcagctgcagctgtcctacaaaagcttttgcttacgcaagcgaacaggatccagaatcatgttccccaagagcaacgatccaaaccaaaaggcgcacatgcatatgttcgtacacggtacacaccgctactagcctactacaccccatgcgttgcatggcattcaccaccatgtacagaccggcccgcgccccc

SEQ ID NO: 4800 - DNA, 2135 bp, Oryza sativa
gggggcgcgcatccctacgcacgaccgcgcccggccacaccgtgctactactgccctggtacgctcgctcgctcgctcgatcagatcagcggctaaacgcctaaacgcgcgcgtacgtcctcgactcctctccgccacacggccggtgccgccccgcaaacagcggcggtgttcgcggctggacgcacgcaactacccgctgccgctacgatgcgtgatggcaaaatagagcacaatagcgcccgatctgcttgttggaggagagacctggatcggcgtgccccatggccgtttgtgcgcgtctcttctctccggcctttccgtcaatcgtttctatagtacactacacttgtataggctttttagtagaaacgatagtatcatagtagtagtatttacctacgtgggtgacaggtgagaggggcactgcggccgtgttgcctacggagtacgaaccgaccggcgtgaatggtgaatcgtgatggtgattcacgccaagtcaagtggatagatcatagatagcgctctgtgctgcgccctttcgcttgcggtgggcggtggaagggggcgtggttgtgctagataggccgtggtgttctgtggttaggcgggccatttggggtcatgggctgtctcctgcctgggtcccttcccccttccctcagcacggcttgggtttcaagcgtccgatcgatacaacacgtacgttgttcagggcgtctcgcgaaattgaccgctgcggaggtggccgcgagcctgcgacaacgacgcaggacaaattcgaaactttgcacgtgggaactgactaatgcagcgtcttattaagggcgagagtaccacggcttatctggtgttacgttgggaactccacacatctggacatctggtacgcagcaatgacgcggataaattccaaggatttcaaagggaaacagttcggacacaattcgacaggattctctcgttttccaagtatagggctcatgatcgtgtgtggatctatcaacgcagattatttcatctgacatttgtttaccggagctttcgaaaccctccactaaaacatggccaaaaactcgagatggaacacatagtttcagtacttcacgttgcacaggagatgccatgttgccaatatatccatcagcggctgctccgtgacccacgtcactttttcaccaatctcctacagtatggatggatggattccacgaccacgagtcgatagtcacacaaggtgctgaaagctgctctgctatgctccgaggtagctacgacgcctacctggatatcgacatcagaaccactccaaaaggccgaagctcttcagtctgaaagaaaagatgtggattctctgaagtgagaagtctgaacccttctgcaagcgactcattgcctgcagaaaaattcaacctcagcctgtcctgcaagaatctcctcgagcatgcaggttattccctttttgcattcatttctcagggtctcaacgctgcaaaaggaatctgatttcttacgaacacagcagtgttcccagcagcaacaattggatcctcgacagcctacaggttcagaacaaaatgtaaacacattattgagtgctcgaattgccacccccaatttttttttaagaaaactatcagaaccagcctatgcatgtcactggctaaggtaccccaattttttttaagaaaactatcagaacacagctaatgtctggctaagaaacagacgtgtggaccatataagaaacacataaatggttttccaaaaagatgggttacattagcccattatggccgttttggattgataccaaaactttccctaccaatgttttaggaggttgaatagtaaatatgatggtttggtttgaagccaattagttagcaatgcccatactcattttggcacaaataagtttctctaccataatatgaaatttggtatcatattgatagcaaaccaaacacgagttaatatatctctgccctaccaacaaatcggtagggtagagaacctctgtagcaatagaataatttatagagaaaagcacagtgctggtaaaagaagcaaaacatattaagctatcatcagggcattcatatgcattatagaagacatgtagaagtagaaat

SEQ ID NO: 4801 - DNA, 465 bp, Oryza sativa
  unsure (1)..(465): unsure at all n locations
tttgtttgtgataattcacacactttatctgaaaatgcagtttaaaatcggtagtggaatcccaagacgtgagctcaaattgttttggcactcctactagaagaccccgtcccatgtcttgtgctgcttgtgtctcacgcacactagcaaagataaaattattattatcacgcgacactggtccctatatacgcacgttgggctttttactttgttgtaatttttaaccttaccaatatttagtattacaaatggcggtaccatttgctatattttggtgggattaaattttgatagtgtcagacttcagtttaaagtcttatgtagagttttaacagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4802 - DNA, 1145 bp, Oryza sativa
taatgatgtatggccttgcgtaatggcatgtaacttgttatgtatggccttcacagtaactctgaacttgatagtggttatgaacttggtagtactatttctaacgatgaagaagttattatgggataaaaattgatttttgttgcgcatgtgtgttaatgatgcagtatgttatgtgttgagttgttctcaagttattatgttttatcatttattcatgtgtgcgtagttgatttaattgtattatgttggctattaaccacttgagaatggaggggtaaaattgtcatttcactaggccggtccatgctggcatgctgatgtggtgctccaacccaacgaaagtggcaaaaaattagggcgtaatctctctctagtggtaaatatgttaggccaaatctaatagtggcatatggagagttgacactcgtaagagtggcaaatagttaaatttcccgtccacaccaccctagtagatgaaggctgtgttagttgagcgcaaaatttagattttggttgaaattagaaatgatgtgactgaaagttattatgtgtatgacatattgatgtgatagaaaatgacggaagtttgaatccatctaaacacagccgaaaagaggaagttgacaacatgtcacgcgtcagcgacacgatgacagtaatgcccatcacatcctccgttctactccagtacactgtaacactgttgttggcgattatccggcggcgtcacctgctttatacagaaaaacaccaaagcttcgtgagttcgtgtcgaccaggccacgcttcctgcacagacccgcccacccgtcgcccggcgcggcacgatggcgcacgcgcacatgcgaccgcacgcacggcaccacacacacccaaggctttcgtgtcaaccggcgcggcacagggggcgcatcccgctgcccaccatcgcgcggcgcacacgatggcggcacacgcgacctacgcgacctgggcgcgcgcgcgcacgcacgcacgggaccacacacacacacgttccgggccccgtccacccatccacccacccggccgcgcgggcgccgcgagccgtacgatttgtctggatcccctttcccccccgcgccgcggggcggggtcgcggggatagtggtagccatcgagcc

SEQ ID NO: 4803 - DNA, 23852 bp, Oryza sativa
cgctcctcttccgcggcgcgcgcgccggcgactcgccgcgtcgggccggccgacaaccgccgggagggagaagccccctccccttggggggcacccatgacgtcgtgcgggtgcctggtgctcgagaaggtggaggaccacggcggcgaggcggcggggagggggagagggaggctcgcgcagggtggcggcggcggcggcggtggctgcggatcgtgcgcgggggagtggaggagccggtcggagaccatgttccccatctacgtgatggggagctcgcgggccagctccgccgcggcggcgcggggcatagtcgacgccgccggggaccccatatgggaggccgtcaagtcggaggccaagtctgaggtgagtactctcacgagatcgctctcgcggattgatcggacctcttcttttatccttctgatttgatcgcggcttttctgctactgtgccagacagactctgaattttgggttggaacgaggaaaaaatacgattttttttggtggtcgtgtttggattaattgaagttctgcatgttcttaggtccagagagttctttcggctcgatttgggtttgaggggttagaaatgctagttcacttgttcttctgagttagcacttcgctatattgtcttctgctttcacttgtgttgagtgagttaagcgcagttgggaaatagcatgaattgagtaatgtttttttaaaattaaaatttagttgccttgacccttgtgagaaaaaaaaatgttattagtatattttgttctcctgaatcagttactattgtgtaggagtagttgccagttcagtgtagccaagtaattcaggaggcaaaaatggtactccagttaaaaactaggagtgaagaggcaagtagtttattatagctaatttatctgattagtggagaactgaaggccaatatcgcaggttcggaagcatatcagtgactgtgtgaaagtttagtttctttttaataaaagaccaagcaataaaaccaagctccagttgcatgcgaatgagttttaaacatgagctacatcatacgtggttaaatatgactttatggttttttatttatgatagagctttagttttatattgttgcctcttatactgttcacaggcagagaaggaacctattttaagtagcttcttgtacgccagcgtactatctcatgactgtctcgagagggcgttgagtttcgtccttgcaaacaggctcgaagatccaacattgcttgcaactcagttaatagacattttcaatgatgttatgatgaacaacaaagatatacgccgttctattcgccttgatgctcaggtgagcattgttatagtattattctgtggatgtaccatgtttgtgtaattgtgtttgcatgaagctcattctgtattatcccattgatctcttgacaactataaaatcgctctgctgattcaggcctttaaagacagagatcctgcctgtgcacaatacagttgggcattgttgtacctcaaggtatgtatttgctagatacttcgattcagccttatgtgtaataagagccctctgcgctacaaagaaaacacaatatcaacatatatgaagaactctaatgttgcttgtgaaccacttcagggttaccattccgtgcaatcctataggatagctcatgtattatggaatcaaggtcgtaaagttctggcattggcactgcagagccgtatcagtgaggtgaacactgatttctttatgaagcatatttttacattgctttagcaaatagttctgtttcagtaacatttggtatcatattcctttcaggtttttgcagtggatatacacccaggtatatgattgttctgtaatgatgtatatttgcattttcctggtctgctagtgtgtttaacattcaagtgttgtatggtgatatgcgatatttagcctgttttatcatctttggcaggacaattttatgtcactcttctagttgataattgttggttctttttatattgcttttaaaatttgatttttgaacagtgaagttatgaacatttgtggtttatcttttatgccttatcatgttcccttttttcccactttatcttccttacattctttattactaaatctgcagcggccagaattggagagggaatattgttggatcatggaacgggtctagttattggtgaaactgccattgttggaaactgggtttcattaatgcaggtgcccagcataactcagtttttgctagctgcaaaattcaaaataaagcagtacttctagatgcaattttagttttgagcactacaacaggtgtgctgattatacatctaatgagttggtaaaacatatatacactacaatgtgccgagataggtttataacaacaatgacttcgatatggatgatattgtttggataccgaaactcagacttttcctacagggtgttacacttggtggtactggcaaggaaaatggagatagacaccccaagattggtcagggggctcttcttggagctggtgctactatcctcggcaacataaacgtaggcgaaggtgccatgattgctgctggttcccttgttttaaaggatgtacctccccacaggttaggagctagcctattaatattttttaaatagtgtttgctgcaatgtcaaatttgtagaaacaatcatttacagatatgacctttctggttcttgcaatgtggtttccttgtaaagagagcaaaatcaggggaggcgggcaggccggggtgggcggggggataacatgatcatgataaagtaattttggactaggaacttcattatatcggatataaaaaaaaggtgcctgatttttgtagtgtaaattttaagtatttggattttaatggagatattattttttttctcatgggctcatggcatcatgtttcccattaaggtgcttgatttagtgacacctggttatgttcatcccagactaatctaagaatatatcaaccaaaataccagtgcctggtgaagaatctttctcttgtgctcagcagattatatattccctttcacttttggcataccccctaggaaaggctcttcgatatttcctgggttaaggagtccttcagttgtgtcttattgtcttgcactgaaaaataatgcaaattatgccagcaggcctttacatagtcaaatccccaagtgatcgctgtaatatgtattttgtaatgaaatgcttatttattttacacgtgtgccttttttttgctgcatgtttttacatcatttttattttgatgagtacaatagtatttcagtcaaattgatctgacctttttttttatatataatgtttaaagtatggcagtaggaaaccctgcaaaggtagttgggtataaagataaggaagacccttctttaactatgaaacatggtaagtatgtgggtgaaatttttgtgatccaatgttttcaagttaacttttagctacatgttaaccatatgctaacatttttttctgattaaacgccagatgccagaagagattattttgagcatgttgccgttagtttttcagatgacaaagctaatggttagttttctattgtcagtaatacacattgccttttgtccattttataacatgtgattttacaaagacttcctgcatttctagaacaactcacccgtacataaataagcaattttgaacccatcaatcatatacctaagggtgtaagtggctaacccgtgaacccacttataggtcaaactaagcgggtaagtggcttattttggcctaaaagtgggttttgcggattagtcgttgacacccttattagtatctacaccttcctgtgaaaagaaatgtggttgtgtttgatgcacagtaattctaggaccctgtctgaatccatgttctctttccaggaagtgttgtgaagtaaaaaaaggttcgatgatgtttggctggcagttcaaaggaatagcatatgtttcgacatttcttcccagaggacagcactgggtatctgattatgcaagggtgcttctcttttttgcccaggtacccatggtcctgaagctccccagttatattttctcgtggcctttggaccgctgtaataatgtgatgtttatttttctggttactttgtaaggactatgtactggtagtggagaccagtacatagttgctactggtagtagagaccagcagcaactatgtacttcagaatacaagctttcttttttgaatcccagtagcatcagcgtagtgcttaagacttagtgcaagctttcttttctgaatcagtagcgtgaagtatattctacagtactagcctattaggtaaagatgtttttcttttgatgtactaacccatcagaaaaaaaatgttacatctggatgggataataaaaaaggaggcaattgttaaattcaactggttttgtgtgatgactggcgttctaacgccgtatgtagcaaaggaggaatctaaaatcatcgatttgacaattccactcgggacaccgaatccatctgatgctgaagtgctcgtgaccagaaagcaacaagtcgccgttgtacacactccggcttgccaagtaggccgcgccaatgaaaggctcaaagcccaccacagcaattaggcccaatacaatgcagacccaaccaggcagctgcaatgctgcacgaccaggtctcgtttagtaccacctcgacaactcgaggcgatggggatgggagcgcctgctatataagaggctagtggtgcgtcgttgcaacatacttacctggacggggtcgacggccgatcaagaagggccgtggcctagatcaatggctcacattgcacttggtgagcgcgttggtttaccatctccccgagtgggagagtggacgtcataatttgtggtagagggggtacgcgttcgcgcggcccctgccaattacctaaatttaaaatttggtccctcttgtttacttacaggccctttgataagtaagttgacgggtgctatgtgctactaccatgaggtgaagctaagcggataagcgagagattaagctaaaatattcccatcgaggtggtcacttgcctactacggagtttcgtatttaaaaaaattttgaaaaaaaataaaaacaatattttgttcaattttaaatctgtcttattttattttttttaaaaaaataaaaatataaatcacgtatagagtattattcatgttttatcatcttataacaataaaaagttaattattataaaataatagagtattattcatgttttatcatcttataacaataaaaagttaattattataaaataattttatattagatggacgataaaagttagacacgaaaactaatagttacacttaaaatgtaatttttattaattataaaataatttaatattagatgaacgatcaaagttggaaaataaaactcatagttacacttaaaaatagaacagataaaactcatagttacacttaaaaatagaacggatgtcgtattcgcttgcaaatggtaagccgcagctcatcggcagaaaaagctctatcattcattccattagaagaaaggtctagatgagaggctgatgcagaatagtccaattcgaagaaaagcccttttccggggtcttttggctttttttcagacctgtacataattctgtatatacttttactctctctattagaccttatttggatgggatgtcccagtcacatcggatgtttgacacagattaaaaatattaaatgtagactattgacaaaacatattctataactctggactaattcgtgagacgaatctactgagcctaattaatctatgattatcctatgtaatgctacagtaaacatgtgctaattatagattaattaggcttaaaaaaatatcacgtaaattagctcttatttatgtaattagttttgtaagttgtctatgttttatactcaaaattagtatcttgtgatccaaacaccaccttaatatactgggcaaagcttctgtactccttacaaaaaaaaatcgaagaaaagagacgatatgccgatgcagaaaaatccagctcatatggatgcatacgctgcgtccctgccggagtgaacagtagcctcacacagtgacacagacacggctatacaagatgacagcgtcactggcacagtcacacaccatgagagccgcatcccgtgcgttgcgtaggctagctcgccgcatcagcaccggatcaccaccatgtcatcaccaatctccccaagattattcaattcctcacttggattatactactaatctcgcctccccccgcgcgattaatttatcgccatggcgccatcagcgagcgtttacttctgccagatccagcgcagcatctctgctattctccagcctcgcgggaagggagggggaggccgaaggggaggtgctcgacatggaggccggcacggtgcggtgcgcggcgaactacgcgccgctgacgccgctcagcttcatccagcgcgccgcggcggtctacggcgaccgcgccgcggtggtgtgcggggagaggcggcacacgtggagggaggcgcggcggcggtgcgtccgcgtggccgccgcgctcgccgcccgcttcggcgtcgcccgcggcgatgtggtgagtggaaatagtacttaccaacacgagcttcccgtgatttgatctgttcctgctttcttttcgtcttggcttatcgtggcgtggcgtgtcgtgtctgcgagctttgatgcggcgattaggcagtttagctggtgtttggatcagagacttaactttagttcctatattcaggtactaatttagagtattaaatatagactacttataaaacaaattatataaatgaaagctaatttgcgagacaaattttttaagcctagttaatctataattagagaatgtttactgtagcatcacataggctaatcatggattaattagattcaatagattcgtttcgcgaattagtccaagattatggatgtgctttattaatagtctatatttaatatttataattagtgtctaaatatttaatgtgatagggtattaaaagttttagtcccatttaacagggccttagtttagcctacgtaccatgcgcacgctcgtgttgaagtcacatgattggtactgacaccgtgacacggtgacaccgagtaatcgtggcaaaatcatgaaactcggcgacgcgtaatgttgcttgcaatcattggtttcacggggacctccattgggagtttctggagatgcgtagatggataagcttaaggtctcggtcacaaactcacaatcacagcccacttcattcccatccttgtcggtccatttgatgatccaaataatctcggcctgatttaacgattagcatttacatctaacgggccaatctagtgaaattctgtaatgtgcaaggcccaatcacatatattttctcgtggcctagcacctccgtaaatagtggagtaatgtccttgttatgtcaaagccatagcggcatagcgcgcgccctgtacttttgaagcagggcgagaatacttaagctaggagtctcttttccttctgcccctctccccgaaacgacttgcatatgttaagcaagctagcgttccttctgagccaggatcataacttgttaggactggttcattctgtagagaccatcagcaattatgtacttcagcgcagtgcctaaggcctagtacaagctttcttttatgaatcttagtagcatcaagtattggtttgggcttgtttaaaattttcattatgtggttctggactcactgtgtgagtttgctattttgtgaactatgtaataattggttgtagctcgtttgagtaaaggccgggatatttgattctattatctaaaaaaaatcaaaaaaagaaattctaccgtagttagcctattgggtgtgtttggataatggaaaataggaggtgggattgagattgagaaatgaatatagggttaggattaaatggaagaggaataatgaatggttaagatttaaagatatcttttggttggtgggaattcattttctaatcccattagccaaacaccgcaattaggtgatgtttctcatttaggtataatccgtcagaaaaaaatagcacaccgtggatgggtaataaaaaggaggcaagtgttcaagttcaactagttttgcatcttcctaacgccgtacgaagcaaaaagggaattcatccacaccaaatccacatttgattaagtgtggtgatctgaaaaggaaaaaaaaattcacactgactcccttacaccaaatctaagggagtccgtattagattcggcctacttaagggagtcaaagtggactttttccatctgaaaacaagtcgccgctgttcgttcacactgcagcttgccaggtcgccccaatcaaagcccaccagggcaagtaaagccccaaagacaatgcaggcccaaccctgcggccgcaatagcaatcctgctcgagcacggccagctctcgtttagtaccacctcgataactcgaggcgatggaggcgggatggtggatctaagtggagtgtgactgtgtgagggagaggtgctggacatggatgccggcacggtgcggtgcgcggcgaaccacgcgccgctgacgccgatcagcttcatccagcgcgccgcggccgtctacggcgaccgcgccgcggtggtgtgcggggagaggcggtacacgtggagggaggcgcgggggcggtgcgtccgcttggccgccgcgctcgccgcccgcggcgatgtggtgagtggaacaccaatgctgctagctcttttagcttatcgtgtgcgcgagcatttgctacttagatgtttcttcttttgaaccaacaaggtaggaagtggcggatgcagcttagatcgatggcccgaaagtttttggtagaaaacttgttaagtatgctaaacatatagtttacgagtaatatttccgctaatctttgccatgagcccatgaatagttgaagctagataacctcacgtcctcgcggatcttctcctatcagtactcttgatattaatgttctctctatgcatcagcatgtaaacagcttgattttttgttttgagaataaacagcttgattcagttagcgataaagcttctgcattgccgcgtatacttcttcagttagtgggataattttaccttgctgctaatatcctcgtgcattgccgctatttatatttttgcaacgccagttataaatctgagtctacagtctactgacaccgagtaatagtagcgaagtcatgaaaactctcgatcatgcgaatggccttctctgcagtttagatctttcacttttatactttcagtatgaactgcgaagtaatgtggcttccatgcaaattattggttattcggagatccataggaattctggagaaaatggtaaggattttaggtcccactcacagtccactccacctcttcatgttccttggtcaggccactcaacgatcgaaataatttcgacctgatttaatcatgggtcagtctgaaaactaggcccaggcgtatgacccacattgtcgtgtgtcccatgttcaggttgctgtcctgagcccaaacgtgccggctatgtacgagctgcacttcgccgtgccgatggccggcgcggtcctgtgcacgttcaacgcgcggcacgacgcggccatgatctccaccctcctcagccactccggcgccaaggtgttcttcgtcgagtcgcacctcctcgacgttgggagagccgctctgaggcgcctcgccggctcaaccagcgccgcgagccttccggttctcctaaccatctccgacgacggcgccggcgcccgcgactcgggctgcgtggactacgaggatctcgtcagggacgcgccgtcggagtttgacatccggtggccggtggacgagatggacccgatcacgctcaactacacctccggcacgacgtcgcggcccaagggcgtggtgtacaaccaccgcggcgcctacctcaacaccatcgcgacggtcctcgcgtacgacatcaccgccatgccgacgtacctgtggactgtgcccatgttccactgcaacggctggaacctgccgtggggcgtcgccatgcagggcggcaccaacatctgcctccgccacttcacggcgaaggtcatcttcgacagcatcgcgcggcacggggtgacgcacatgggcggcgcgccgacggtgctcaacatgatcgccaacgcgccggccgcggacaggagggctctgccggggcccgtgcgcgtcatgacgggcggcgcggcgccgccgccccgcgtcttgctcgccgtggaggagctcggcttcgtgctgtaccacatctacggcctcaccgagacgtacggccccgccaccgtctgcacgtggatgccggagtgggacgcgttgccggcggaggagcgcgcgcggctgaaggcgcggcaggggttccatcacatcgcggtgcaggacgtcgccgtcaagaactcggccacgatggagaacgtgccgtacgacgggcagacggtgggcgaggtgatgttccgggggaacacggtgatgagcgggtactacaaggacatcggcgcgacgaaggaatccatggccggcgggtggctgcacagcggggacctcgccgtgcgccaccctgacgggtacatccagctcaaggaccgggccaaggacatcatcatatcgggcggcgagaacatcagctcgatcgaggtggagtcggtgatcttcagccacccggcggtgctggaggcggcggtggtggcgaggccggacgattactggggggaaacgccgtgcgcgttcgtcaagctcaaggatggcgccaacgccacggaaggcgagatcataagcttttgccgggagaggctgccgcattacatggcgccgaagacggtggtgttcgatgatttgcccaagacgtcgacggggaagacgcagaagttcgtgctccgggagaaggcccgggccatgggcagtctcaccaagtctgccaatagtaaactgtaatatcatttctgttgttggacattggatgggatgccgtagtatgcagagttccaaagattattagctgattcgaggggttttgccgatttttgtcattaccactcgaaaacctgtgaattttgaacaaaatttaccgaacgtctgagtttaagtttggattttttttaaaaaaaatgattaatttatcgagtggtttttcaatttatactatgtcagctggcaggttgccaccaatccctgtggcaaaatttgatgttggccaaatgacttatttatcttagtggcttcaccaaaattgtgcccatcatgtggctcctattaattttactttcagtaaattgcatattggagctggtatttttacctaagattcaccatgaaccaccctatccttgatcttttcactttaaacgagatatatttaccaatactatgtattttgaactagtggcgccaggggcggagctagaacgaaatgaagaggggtgccactcacttgttttactctactttatacttatataagtgtctaagtttgaattgagaggggtgcacatatagtgaaaataaatgaactatagctaaaaagttttcttgaccgggttcctgggcacccccccctctcctacctagctccgcccctgagtggcgcactactccctccgtcccaaaataagtgcagtttttatcctgttcatatccaacgtttaaacgttcgtcttatttgaaaattttttatgacggacggccaaacgttggacacggatccacggctgcacttattttgggatggagttagtaccaattagtgagaatagaggcaataatgaaagcaaactccatggagagggtgtcggcaatctcttcctcttccacacctcgcaagcttttacttcgacgcctctcttagagcatcaccaatagttcccttacttcacccacaatcctatttttttagattttggtgaaaaaaaaagtctccaatagatgtcctatccggatccttttttttttggaaaccccctccccgcatctttcactctcttcattcgagggagagagatggcgcgtctgccgtccccaatctctcattcgcgccagatttttctcagtgaggagcgcgggcgcacgtgagtgggaggaaaacggaatctgatgttagtttaacaaaaggatcctttttaatttttggaataaaatttagatttctcttggagatatcagttttttcgctacctattttcagtttagaaaacccaaaaataattttttgggaaagattatacgtatctcttggtgatgctcttatcgccccaaacccacaaaggccttggattgagctttggggcaagaagagtaggagataagataaggatagaaggtaaccttggagccacgaattgaagaaggagctttaggaaaagagcatgtgaaaaatgaaggcgttggattgagctttggggcaaaaagagtaggagataagataagggtagaaagtaaccttggagccatgaattgaagatggagcttaggaaaagagcatgtgaaaaatgaagaagtagaagatagaagtgagaaacgagcgcagcttcgtatcagtgcacaccgaattcaaatcgctcgatgatatctaggaggggatccaaaaggtatgtaaagggagcgagacgaagacaatagtgacggacaattcaacgaccattccattatcctgtagtaatagcattcatcagttgaaaaggccgacattaacgtacataacgctgacacaattctgcatttctagcttgctctgaatagttgaatattgtccctctgtctcgatcaaatgctcttggcatttttccattgcgccaactggaagtgctttcgaaaaataattccactagcatgatactcattgagtgacccgtgatgtactacgtattctcagcgtctcacacctcctgcgtttcgtctttaatctaaccggagtgcacacatcaagtatgcaattaattaatgcacgcgaaagaagactgactcagatggagaacaacgttttggtttagtgttggtcatccgtttaattatcctccaactcactttggacaaatcggattgcattagttgcaattggttcttcttcagagaggctaattagtgtgacaaatcgatcccgattgctggtacacgagctgccatggaaggctgtatgccgagcgatgcaaactacgcgccgctcaccccggtgagcttcttggagcgcgccgccgtcgtgtacggtgaccgcacggccgtcgtctctggcggcagggagtactcgtggcgcgagacgcgggaacggtgcctcgctggggcgtccgcgctcgcgcgcctcggcgtcggccgccgggacgtggtaagtgatcgaccagagcttgatgcctcgatgagctttgtacttggtgccaattcagctctcaacaagacatgggttaattgctggtcaggtcgccgtcatcgcagcgaacattccggcgatgtacgagctgcacttcagcgtgccgatggccggcggcgtgctctgcacgctgaacacccggcacgacgcggccatggtgtccgtccttctcagacattcggaggccaaggttttcctcgtcgaatcgcagttcctcgccgtcgcccacgacgccctgaggctgctcgccgatgctaaagccaaatttccccttgtcatcgcgatctccgacaccggcgacagcagcagcagcgacggtggcgggctagagtacgaggcgcttctgagggacgcgccgcggggcttcgagatcaggtggccggccgacgagcgcgacccgatatcgctcaactacacgtcggggacgacgtcgaggccgaagggcgtcatctacagccaccgcggcgcgtacctgaactcgctggccgcgctgctctgcaacgacatgacgtccatgccggtgtacctctggaccgtgcccatgttccactgcaacgggtggtgcatggcgtgggccacggcggcgcagggcgggacgaacatctgcgtcaggaacgtcgtgcccaaggtcatcttcgagcagatcgtgcgccacggcgtgaccaacatgggcggcgcgcccacggtgctcaacatgatcgtgaacgcgccggcgtcggagcggaggccgctgccgaggagggtgctcatctcgacgggcggcgcgccgccgcctccgcaggtgctggccaagatggaggagctcggtttcaacgtccagcacgggtacggcctcaccgagacgtacgggccggcgacgcggtgcgtgtggagacccgagtgggacgcgctgccgctcgccgagcgcgcgcggatcaaggcgctccagggggtgcagcaccagatgttgcaggacgtcgacatcaaggacccggtgaccatggcgagcgtgccgtccgacgggcgcgccgtcggcgaggtcatgctccgcggcaacacggtcatgagcgggtactacaaggacgcggcggccacggaggaggccatgcgcggcgggtggctgcgcacgggcgacctcggcgtgcgccaccctgacgggtatatccagctcaaggatcgcgccaaggacatcatcatatcgggcggcgagaacatcagctcgatcgaggtggagtcggtgctgttcggccaccacgcggtgctcgacgcggcggtggtggcgaggccggacgaccactggggcgagacggcgtgcgcgttcgtcacgctgaaggacggggcaagcgcgacggcgcacgagatcatcgcgttctgccgtgcgcggctgccgcgttacatggcgccgaggacggtggtgttcggcgacctgcccaagacgtcgacggggaagacgcagaagttcttgctccgggagaaggccagggccatgggaagcctgcctatgcaaagcaaatccaagttgtagtcttgtactattgtactagctgcgattggttttgctgccaagatgacagcgccctgcacgactactccgatattttctgatgatacagtatttgggaagaccaacacggatgttgcataaattccgtgttaaaactgagtcaagtgcagcatcatgtaggatgcacttaaaagtaatcataaaaaagaatataccctcttattcggggaaaatgaggaatataccctcaccgtttttaaacacaccctcctccacttatatatgagttggttaattcattttagtgaactatccaacgtcatatataaatgaaaggagtgaatgcatgacatggacttttgaaaatgatattgaaccattcaacttatttagaaacttaatgcaaatatgtaaaatatgtcatgcttaaagtatcttcaatactaaaaacaagtcgcaacaaaaataatgatatcagaaagaaactagtactagtttcgagcatttgcctgagacttgctaagatcaattttgctttatgcaaggcttgaagtgtagatggaagattggaaggtgggaagtccattcatacttccgcatggtacattatatatccatccagaacatgtaacgcctataacaaaaacatgtgggatctttttatttcgaataatcctatctaatgaatattccttttcagatgcagatcgaatacaatacatcgacgttttattcaagcagccgtacaagtgccactcatcctctaaagaacagagtcaaaactcaaatttcaaagctggataaaccagtcatcaaaatctaagttacgacaacaatcatatatcgtatacaacaatcatagatcgtagagaactctttgaaatgtaccatctagagttgcagtagtctccaacatcaaaggaaacagataatgatcaacaccatgtggaaggagataacagacatgctccacatggacctagcgaactgcgacctcccagatcctcctcctgcaaaatcaactattagaaacctgccgtttctttaactcaaacaaactcagagactctgagtttgtacaggtttgcgggctcaacttactctggcaggctgttgtctgattagttgcaaggctggtttgtatgatgagcgatgaactgttggagtaaccactgtaggcgcacgttgttgatccgcaaccggtgccgttcgtctcaccaagcttcagcgttccattgcacagtggcactgacgggcatcccttgttctgtactgcagtgcagtttagcctggttgacacagtgaaaagaaatgtaaattctttggttactgcttgatcagaaacaacttagaaggagatggaaataataggggagcatactggtaggtagttgaactgcagctgcagcggatgcagtttcctgcggtgaatccataggtgccatccgggaggagcatcagattgtgatcagctgaggtatcgctgattgatgaacggcacactgaggacaccagttttccagaagttagtactaggtctaggaactcgtttcatatgacattcttaccgaagaaagtgaatagtagtaaacatcaagatccatctaagatagtactataatagtatattttgaaaccttgtgagtagcgagggtcaactttgtggattggtattggtagtttattccgtaattttaaaccacaaagtcagatagtttgtccggtgatagcaacggctaactaattatacaagtccaaagagtgcaggaattcaagctctaaagcttaaattcctcaacattgcgatggaattttgtggctttctactcatgtgctagtggagctatgtgtcatgttgtctcaatctctcaacgatcgaagcatgtgcagctagctatcttttcttgagagcaactttccgagtcacaaccagatattttgattctgataaactccatcatgcaaggggaccatagcctaagttcattgcaaataccactgaatccgagcaatatattatcagcatattgcaaataatttaccatacctaacctaagtttaatatgcaaactaacagaacaacacagctaatcttcagtctccccagtcaaccatgtagaggtagtaatacgagtaaggccgtgtttagttcgtgtgctaaaattttcttgaagtatacggacacacatttgaagtattaaacgtagactaataacaaaacaaagtatagattccgtatataaactgcgagacgaatttattaaacctaattaatccgtcattagcaaatgtttattatagcatcagattgtcaaatcatggcgtaattagactcaaaagattcgtctcgcaatttacatgcaaactgtgcaattggttttttttttgtccatatttaatgctccatgcatatatccaaacatttgatgtgatggaattttagaaagtttgaagtgaactaaacacctgcctaactaattcaagtttcttctcttatagtactagtaagactagtctactgagaaaattcactgttaaacaaaaaacttctgagctcgatcacaagattgcaagaaccatactaaacagtaacagcaaggcacgtaccagggagcgggacatctagaatctgtcccatctgcaatttcgtggggtcgtcgatcttatttctggtgagaagcgtggactccgtcaccccgtacttggcagcgatcgccgacgtgttctcccctttgccgacgctgtaggcgaggtgcatcacgttagagccttcctccttgtcgcagctgcagggcagcggaatccacagcgtctggctgacatttatcttgttggggtcggggatgttgttcgcggcggcgatctcctggtaggtgacgaaggcgttgaacacgttgcgcgcgatggcgtcgagcccgtcctgcggctgcacgacgtagatggggaggcggtccgactggccgacgtcgccgttgcagcggcagcggaaggggattttgacggtggaattggcggcgacgggggcggaggaaagcgtgccgtcggggaggccgttggcgccgaggaggtcggggagggtggtggtgttgaagcgggcgacgaggttgccgtaggtggtggcgttgggggaggtgtagaggatggcggacttgcaggtggtgcctgaagccaccgcgcaggtgaagttggcggcggaggcgggggcggctaggaggactaggaggaggagggcagcggccgccggcgtggccagggcggcggtgagcgacgccatggtggggaaagctctcctcgagaggtgggaatgagaggcttggtgtttgtttgactgtcgtgttgacactggagcaggaggagtatgcctcgatgctagtgcttgtggcgacttaaatggttgcagcgtgggcctttccctatcctttggttcgattgcatcaaagtagaaaatggtgaacttgtgtggaattgattggtttgagtcagacttggagaacaaaaaatcactgaaatttcaaaattaccgatggaaatttgactacaaacgttagccatgcatgcagcttagcgtcttcaaggggagcttgactacgctaagactttggcaacccaagtcaggctaattaaattgcacaagaggccaatttggacttcaaagtcacaaatgtgaacgagtagcctcgtccacggcagcacacttggatacaagcaggacagacaggccggagctggatgcgaggaaaatggaaacagcagggcgaagttgacgtctcttcgccacacaaaccaacagccaaacagaggtgtccacatcgcaaggcaatgctaaaaaacgcgtggatatcattgagagctttctcctccgttatttatacggagcttttatgcaaaaatgcacatggataagcatagagacaatatgatcgcgagccactgattatttcgcctaattgatcaaacagcagtccggaacgataaaacgctaagccgcggaaggaaaacatgctacgaaagaatgaatgaaccaatgaacgcaatactgcggttgatcccctttctacaaagaatgttccccttacaggcaaaattggaaacctatgcagaaaagcttctcttttgtactggcacaggtatgactcattccagaggcgaaggaggcatgcctggtggatcatccgaaggtggagctggagatgaagcgctgaagtcaatagttgggtacactcctggtggcctttcgacaggttgtatcgacagaagttgtgttgagtctccaacgacatcagcccatccgtaatgaggctccgccctaattgacaatgcacagatcaacgccaaattgtaaatctgaaaatactccgaagatgtctggaagaaccaaacaagacataatcttactcgtagtacgtctcctcatcaactaccaaatcccagctctcgccagttgtgctcttgccgtatttatgaacttttctgaaatacaagagaacaacagtatctaagaaagctactactgtaatgccaggtagtatcgttgcaagaagaaccattgcagaatgacatatagtgtattagaaaaggacaagcccatgtggtttcaattcatttattaatgtcaagtgtcagtcaaaccaaatgcgagaccagcgtcatgatggaacatacccattaccaaaatgctcttctccccaagttcttgaccatcctgaaagtatcaaatcagataagtggatggcaattggaaatcagataagtcataagtcacactacgagcggtgcacacatttaacaatgcaataaacaggatctaacttctaaacctgagtatgcagacagtagatacagctcatatataaaagcaacatgttaaaatatccagcatagcttccaatagattgcaccagtgtgaatttcggccaatgcagcaggcaaactttttctatgcatcaaaggtccaaaggtgcttagcatttatgcctaataccagcatccaaagagaacaaagcccatcatcaaggtggatactgtgcatatatataaatgacgatgaaacttacgatctccaccaggggatacatgccatgtctccccttgtcgagaaccaattccagcaaagaatttctcttcccatttgtccccccatttggtgcctaagtctgtctctgcccacttatctgtcctgtaatacaaatgaattgcagtggttaccaattaacatacatcggatgttccaatcatgattgaacaggcaaataaattaaaagtataaagaacttgtgcctcaaatatgatgcacaatgtaaatgcacaacctagactacaaatttaggccacaatgcgcgcagcataagaaacatgtaatacaatgtaaagtgtatggtatagtgcttgaagataaactaaagtacagtataacaatagtctgcaaaatagcactatatatataggctcaccatttcaatacaaaaccccggccatcataatgttcaccccacctctcccaccaggattgttcatttaatcttccgtacttatgagcacctttttctgtccagcctttggcatcatatttctcccacctaggaaagaaacatgaacacttcaacagttcaagcaaatattttgcagaacaattgcaaccaaacctaaacgaaagcctgagataactctcaccatttttcataccacccagcattttctgctcctgatttcgcttgcttttcagcgctcctctctattcttgcaagattgctgtttgcacaatgtaaatcatgttatgatctacagtttacaatgttgtgctagatggtcatttattaactaatctatactttctatatagttggtacccactaaagctaaagctaaacatgcaagcatgccacatcatcatccactagccattactattctaacccatttaaaatcccatgcaagcatgccacattttcactcactagcaattactattctagcctattttaaatcccatgcaagcatgacatatcatctataatattatattatagagatcaacaagtatgtatcaaatcatcttcctcatattatttttttaacatttcaactttcatcatttcgacaatatttaacatatactcattcgtgaatcccgcagcaaagcgcggggtatcacctagtttgctttaatttccctatcttaaagagaattcaggacctttactcaaaagtacagatcattatgatcataacactaagccagaaatatattatgtgcccagtatgtttagaaattagaactactctctgaacaggataatttatgaatcagcactgtgattttcactggatattcgtgtcaaatatcccaatccacaggagagcttatgctgttttggttctagacagttattgttcaaactaaattgaacaatcctaaagcagttgagcccacagaacaagtttccttcaaacaaggtactagaaggccataagaggaataagaaaataatgcatgctaatcgataattggtgcacatatgatgtgtccaaaagtccaagttgaagtgtatagccatgtctggtaataacagtcaataatgtgctaaatttcaaatataagtaaatagagcatggatatatggtcaaacaaaattgttccaaacagacaacaagaaattgcaagcgccaagcgcttaacacaatcaaagttctttgttcacagaagtataaccaaggggtcaacaattgtcctcccccccccccctccccaaacaattgttttcttcagcaggcagaaacaaagaacagtaaacttatttttggtgacaaaattagttaaaattcagtggagattatgtatttttgtattatttaagcaaggagctagtatcattaaaaaaatgaatttgcatgctaataatttacctccattcatcttggtaaagaacttctttccatttctcccaccaagaatcaccttcaccattctttccagacttctccgcacctaatgtgagagatttgtaatgaaaagtcaacgacggctgatcagatatgcaaaaggaaaagggcacacataaataagaaaattaactgaattcttaggaaatttaacaacaaattacaaagaccatttgctaccagagccttcattataaagatatgttcatacctaactccttatatccggtccaatcacttttctcccaccactgccacataataaattattgagatctgttagaaaaaatctttttaacaactcaagaattctgtccagcattgattaatgtgccaaaagagttagctacggcctatgaaatcctgggagattataattccaaatccctattctcagtcaagtaagaaagtgcaagttggatctattgcagagtgcgctatagctattggaacaagcacgaagcaacttgcaggatggcagacatatcttcgattctaactagtgccacaagcatcaacaacagctcattagcatcagaagttacataaagaagtcattggaatataatggctacatcccagaaatcttttctagatccttctcatacgaaaatgtggtgtttgcacaaaactgagatggtaactcttaactcaggtgcatcatacaaaggtatacaacttgataaatttgtactagaatattatcagttaagggtaaaacaacaagaacataccgtctctttccattcagtggtaccatcatgactctgtcctcccatcctagcccagcgacacctgtacccattatcaccacgatcgtctccactctccctgtaccaggtgcttccatcttcatttgtcccagactccttgactgcttcatccagaaggttaattccccattcattctcactagcaataccagtgtctataaggcaggtgcgcaaagaaacaaaatgcatttcgttagcaaagttgaaaaaaacatttggaaatgcgggtcgggtgtttccttttggagtacactatgtctatcacaaaatttggaagtatcagcaaggaacccacctctcttcggcggagtatcacgggattgaggagctggccctcttggcgtgccccgtggatagaaattctgttgtttccactccctcctagaactatactagtgaaaacaaagtctaccatcaagattcattctctgaacaaagagcattcgtgcagcagcagaaaggtacggtttattccactacataaagcgtgtgtcaaaagcattggcacattaacttgtcactacgacaattcagcataaagcaaaaaacaatccatatgttggaatgattagacaacatgttactgtaagtggcaaatgcgaggcctgactggataaggcagaaaaatgggccatgttcagtgacgagccgccgtgcacgtaccgaggagaagggaaggggagtgacggcattgcggtgaggctggcgcgacgcctgccccgggcggcagcggcgggcttgttcccgtcgatgcgccactcctcggtgcgctccggcgcggccgccgcggccttggagaggcgcctccgcggctcctgctgcgcgcggcagcagcatcggatcgcgcggtgtcgcggggcggggcacggccagtgcgccgcccccctcgcggtcagatcgaacggccgcgccacgagccccctggagcacgcggccatcttctcatgccacggcgagggcttcaggagcggcggcggcggcggcggactggctcagtggcggcggtggtgggagcccggaggcgagggggagggttttaaaggggcggtggcgaagagggaaaccgcgggcatcatccgaaccagcgagagagcgattgattgcgaatcagctcgcggaaatgaggagacataaatga

SEQ ID NO: 4804 - DNA, 596 bp, Oryza sativa
  unsure (1)..(596): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattcgagttcgnnnnnnnnnnnnnnnnnngcttctcacacccagccccaacctcggattcctaggtgccacacgagcaccaggctcaggaggcggcggagcctccactctatccggtacgggtgacctctcgatcggctcggcgtagtcgcgcgcgacgcgtccgagctccgcgtccagcctcccctcgcggtacgcgcggtactcatcgggcgcggccacggcggggggcgcccgccgctcgaggcggctcccgaagcgcaagccgtgcgcgatgcggcgcttctccttcttcgtcaggtttatctcctccgccgcgtccctccacctctccggcaccaggctactcccccctccgccgccggcctccgcggccggcttccgcctggggcgcgaggtggtcgatggcgccggagaggggaggtcgacatcgggctcctcgaaggcgtcgtcctcgaa

SEQ ID NO: 4805 - DNA, 3406 bp, Oryza sativa
  unsure (1)..(3406): unsure at all n locations
nnnnnnnnnnnnnnnnnnnnnnnnnnnnnnnacctggatcagcagtaatggcgtgccgagcaccgcggcggagccgtccacgtcgaagagcagctgatccatgcacgggaacggcgccctgagcccggcggcctcgagctcgacgacgcggacgtcggcgtccgcctcgacgaacatcacgccctcgcggtgcagtcgacgacgagcttccggccttcaacctccctgagccgcccggcgaacgggtagtacggcaccagcgcggcggagagcgcccggcggatggtgtccacgggatcagcggccgcggctgatgggcggtagacgaagacgacggggacctgccaccgcagcgactccggatcgtctacgtcggagaggcgcttcgtctcgcggggcgtcggcgcggcgggggcgacgagctccgtcgcgcggcggcgcacggcgaaggacagcgccatggcttttggttgtttggctttgcacctagttatatcaaagctattgaacgtaagttcaaatgttggccttcaagctagcctagacaattaatgggcgttttatatgatgaaacatgtacatgcttatattttctaggccctgtttagttctaaagtttttttctaaacttccaactttttgtcacatcaaacctttcatacacacacaatttttctatcacatcgtaccaatttcaaccaaatttccaaactagcgtgaactaaacacagccctattttaattccaaatgacttttcaaagtaattctcgacaacgcactgccggagggggtagctgaggggcaagcacgtggaaggaatggaggagctggtctacaccgtgtgaatggatggtggcggtgcgcgacatggaggcccgacagtggtgcaaatatcagagtggtgagagaggttgtggaccgcagtggcctgacagtcgcttctctctcgccccctcctccttccagcatttggcgttgacggcgacaacggcggcagcgggagacgccctcccctccaccagatccggtggtatgagaagcggtgggcggctgcattatcctcccctccaccacatccggtgggatgggaggcggcggcaacatgcagcctcccaagtgacttcttcctctccctctccatcggccatccactggtggcgcgcagatccggtcggggtgggttggtggcggtggccaaggcaggcagcggtgggtgcccaaggatttttggcggcgacatcactgatgagttcgtgcatggattgttcttgctcgtgcagttcttgcttgtgtagttattgatggatttgttattgttgacatgtgattgatctgcgttgatctgtgattgttattgaccggggaatgggttggctcgtaagcataagctcggctcggcttagagccggcttctccttttttttttttgaatttaggagagcacaaagatgccggttctacgaccggcaccaatgacactaggtcattggtgttggctggaaaactgacacctatgggcatttttgtagtggtgctgttttttcatgggtataggtcttaggcaaatgataaggggaaaatttaattatttgcctcaaagaatgtgctattctttaaatgccacttctatcattgttcatattcttttaccacaatagccctatgaaatgtctattgtgcccctcatctctctcggccaagtaagagtgaaggcaatggcgcagtagtggaactctggcctaatgacaaaccgacgatatagcttgagctccacccttgatcaccaaagtgccagacgagcaggagaacttatgaatcgagatgggagagcgtgggcgcatggggtggagatggtggaggcaggtacctttcgagcacacagaggttgtcaaagtgatgcatagtggccttctcctaggggacgatgagagtggtcttttgactcttttccatgtgctgctaggcatttagtggtgttattctagttgtcgatgaagagtgcctcgaaccgccggtgcgcgcgtgagccggatgtttgggatgagctggctagcccaccccagtcaccctttggttgtgctcctctttctcctactcttctgtcattttatgggatcgatggaggagtccgggaaatgctttcgccttgttgtcaagctaaagcttcaacactactcaagccttgttgccatgttactaggctcgagctccattgcttgcaccattgtatggcttggccagcaagaagcaagaggcgagagtgggggagatgagggggtacaatgaacattttatagtgctatagtggcacatctttagaatagctccattcgaaaatataccaacctagtattgaattagatacaatttagtactatgaatctagatagggttccaaattcattatactagactatgctaatctaatacgatgttgctatattttgagctgaaagatgtactccctccatacttataaaggaagtcgtttagaacaatgtttaagtcaaaccttaggaatataaatcattaataaccctcaagttgttgagtttgaaaatataaaaattatatgaatatatttgtcttgaaaaatactttcataaaagtatacatatatcactttttaataataatatttttatagaaaaaagaagtcaaagttgtgttttggagactgcgtctctgtccaaaacgacttcctttacgagtacggagggagtactttctctatatctataaaaattcaatcctaactatgaatctgaacacacatgtgttcaggttcatagctagaatttgattttttttataggatggaaggagtactttcttcatctcaaaataagctaatttatgttataatgagacattatctaatacaacaaatttagaatgttttttcttatctaggttggctaacttagtttattttagggtggacaagtatctgttaaaattattttaggctgatctttagatgttactaaaacttgtaagtctttatcacattagatgtttgaacactaattataaatattaaatgtagactattaataaaacccatccataatcttggactaattcacgagacaaatctattgagcctaattaatccatgattagtctatgtgatgctacagtaaacattctctaattatggattaattatgcttaaaaaatttgtctcgcaaattagcttttatttatgtaattaggtttataagtagtctatatttaatactctaaattaatgtttaaatatagaaactaaaattaagtttctggatcccaacaccaccgacttggttcgattttcagagagctctgggcacagtcaaaactcaaatccccaatcgtaccattccacacgctttcatttattattcacccgaaacgaccctc

SEQ ID NO: 4806 - DNA, 10908 bp, Oryza sativa
  unsure (1)..(10908): unsure at all n locations
atcccccccccccccccgccccctcctcgtcggcgccaccgccgccgcaggctcgccgcctagggttccttccactctcggcgcaaggggcgtagggaggttgagagggagcgagcgagcgatggaggggtgggtggcgacggtcgcgtacacgggcacggcgctggcgtgcgccgcggcggcgacggtggtggcgctgcgcctcgtctaccgccacctcctccactacgccgagcccacccaccagcgcttcatcgtccgcatcatcctcatggtcccggtaggcactcgcctccgcccgatcccctcctccccctctcgttccnccatgcgtcggctacgtccccagcttcgcgttcctaggcgggtttagtttgtggtagctccgatttgagagaggtgcgcgtgtcgattccttgagcaattttggtatcggcggtaccgtgagaggcgcggatactgctgctgcgttgtgagttgattttactacaagtcgatagttaatctgggtcgttggatactgggatgcgaggccccaagcctctacctgtttctcacttctgaacgaacaggtttctattggcgaattgttcaggaagtgattgtgaatctataagttggatgggagtgtatttttttttagtaatgttattgcagctagctaagttattccatttggcatgcaagctgcctgtatggatttctgggattgcggacttgcggtattgtttgttcagagtctatgtgctgattccataattcagtcaaggccacatggttccagctgcgatttgagtgcaagtgatacatcatatatgttggtctgttggtcaatttgatctgtgttggtgtcttcttgatggttgtggatttgaaaggaaaatactattttgtgtttattgttcatctcaaagtgaatttaaccaacaatgtgttggctattcaatggaattataacttgttagggaatatattctgcagttataggcttatagcattgatttaatccttagttctttatgagaaatgcaagtctttctgtttcatatatgcattttaatacttgtagtgaagctacaaaagcttcttagaatgccctgtaatatgcattattttttaatggtgctactattgtaattccaatcctgaatgattctgatatttgtcccatagaatcaaagatgtatgcttgtactataaactttgcttgccaatattcacttatgaatgtaaagtttgctggttcagtttagttgtcattttatttactcatgttctcaacattttatttcattaactatggataaatacattattgtgcaggtatatgctgtgatgtcatttctttcccttgtactacctggtagcgccatctacttcaactctattcgcgaaatgtaagtttgactgctaaccaacccttattttatcctgtacattgcgccagtatacttgatataggtattgatacttacttgtttatgccttgacacttcatacactatatttagtttcacgaatctcaatatcttggtattaagaagatggcaaaaataccaataggtgtcagctttgctccctattgcaaaaagatttccctgttacaaggttgtaaaggcactatatgctagttagaggttcattgatcatgacctcgaagttttttctgaagtttcagggcacattatcgtttttcatactgcagtttctgctaagtaaatagttgcttttgattaatgaagtgcggcctggcattttgcaccaactaattctttttgtccgtaatagaagtagtcagtatgtgattccagtttgttgatcgatacttctttgggtgattcaaggtgtagcattgattcggacattcagtaacaacattttctggattaggatgctttgttgcttcagatccttgatagcctctgtgttatgcatgaaatgtaatcagcaaccacttttttcactatgtatattgttttagttaggggtgggcgttccgtttccttggtttaatcggatcggttttttcgggttgcctggaatttggttttcgtaaaatgtaaactgaaggaagttccagaaaaatatcaaccgagcaaaataaaccgaagaagatcggtttggttgttttgggttcagtttttactgagaaagatctatgccgcacactgcggttgactttccgcaagtatgcacggcctgcccagctctgcctgagggcctgtgcttgatttggagagagggaataggatttggtggatctgttagctgtcatgtattttttgggccacagtgaaagttgggcttgatgcacacgttagtgggcctcgagcattttggattggctgaacactcatctgtttcttcggtctcgtcggttcacgtgagatagaaaccgaagcaaaagccgaacaccgaactacaggaaaataaaaacaggacaatcaaccgatgacccaaaaaacggcctcttcagttcggttcggcttggtttggtgcggttttcagtcttcgggattttttttgcccatgcctagttttagtcaactttgttcctatgactgatcaatcctaaatacgtttatctggttattggtttgctttgttttcattgatgattagaggacacgttttgtgttttgtgcatgcatgcgaacagtatttaatttcatcggtatcaaaatcactaaccacttttttcactgtgtattgttagtcaactttgttcctatgactgatcaatcctaaatacgtttatctggttattggtttgctttattttcattgatgattagaggacacgttttgcgttttgtgcatgcatgcgaacagtatttaatttcatgcggatcaaaaccacagatgcattgttaaaaaaaatactaacagaatgctgtaacaaagattaaagcacctcagcatatttcacatgttctctatatatccaggagcatattacgtttgtcttttatgctacgatttcatacagcttgaacaattacttgaaggtacattatttattttgtgcagtacttttgcagaattccattggtcataatccataagaccacaaaggctttgcatattgattagatgtggtttttattgaaaaatcatggaaaaaaaggctggataaagaatttttcgtaagcttcactataatttcttgaactctcatcaaatgtgtgttggtgtacttacaggcaaatctataaatgacagaaacacgaatgcacttacactgtttagtcatgtttactttcatatgaggtgacttatctggtattgtgtttattgtgacagtaaaatggtattaaaatgttattgagcttttcttcttttctgaattgtgttttagctatgacgcatgggtcatctacaatttcttttcactctgcttggcatgggtaggaggtcctggtgccgtggtagtaagtttgactggccgatctctgaaaccgtcatggttcatgatgacttgctgtttttcagctgttcctctagatgggtgagttctgcacttccatgtttgaaattgcctatggtaactagcattatcttatgaattttgatagtgcaagtgctgatgattgatttttcaatgttcgctacaggcgttttatacggagatgcaaacagggttgtctgcagtttgtgatcctcaagccaatattggttgttataaccttcattctttatgccaaaggaaaatatgaagatggaaattttagtgtcaatcaatcctatctatacataactatcatctacacaatttcgtattcgatggcactgtttgctctagcactgttctacgtagcatgcagagatcttcttcagccatataatcctgttccaaaatttatcattatcaaatcagtggtgttcctcacctactggcaggtaaagtgaagttattaggattagttatttcctttctctatatcttatctcggagcctctggtctgatcaaagtgctgtatagagttgcatttattgaaacaaagtgatttctatcacagaaaccctctttttacttgatgaggagaagtttagtactccctctgtttcatattataagtcgttttgacttcttttctagtcaaaattctttagctttgaccaagtttataaaataatatagcaatatttcaaatatgaaacaaacatatcattaaaatacattcaatgaaactaatttggttttgtagatgatgttaaatttttctataaacttagtcaaagtgattaataatatgaaacggagggagtaacaagttgaagcttttctcacagggcgtcctggttttccttgctgcgaaatctagattcataaaaaatgctgaagaagctgcttatctccaaaattttgtgctttgtgttgagatgctcatagcagctattgggcaccaatttgccttctcgtacaaggagtatgctggttccaatgcccgtcctttcggtggattcaggggaagcctttttcatgctctgaaattcaatgacttctatcatgatactgtgcaccaggtaaacaagatatcgcaatatgacatcccccactctgcccttcatcctgatgaagagtccttcatggcacaatgactccatttgcattatgggcttcatctctgtcttaatcatgattgttcatgtttctttgcagtttgcaccaacatatcatgaatatgtgctctacagtaacgaggaagaggatgaaccgacaaaatatagctctgccagtgttgtgtcaacagtacaggacatacagctggtagaagtctctgtcgtggactcgaaagctccgttggcatcagtcatcctaacacatgaggcagataaaacaatgccctcccatggcatggaagaaactgttgccccttcagagccatacgacctctcaaacttggttgatgtagaactgtccaattactctgctgaggtccctgcaattcctgatgtggggaaacaatgatattgtgtgatatatatccgtcagatgtaaatgggtagcgctcacgagttgttcatagattacactgtaaaggtatccttgtaatcctttgtttctgccaatttttccccgttgctagggacgtgctgatatctttggttcaaattgagctaaactgacagattagctgatggtgtcaagtaaatttgtaatgtagggagaagagaatgtaacatgtttctcagttttgttgttgctgataaagcatgtctggtcaaatgcgttatgtccttatgggtatcgatgcactcctgttacataatcagagtgggtggtttgacctggcaaggagcagatcaaattacatttcataatgtattaatccctttgtcataaaatatatagcaacccaggactcaaatatctcgacagatggtatctagtaatccaatctggacatgtggtctcttgttcagatttgtaatactaggcggtgtctaattaagtactaggttggtatattactatattttacacagaaatttctcgacaggtggtatctagtactccaatctgggcaggagtctcttatctagatttgtaatactaggtgttgtctacttgagtactaggttggtatatttaacgacgaagggagtaagtagtttctttttttttcaagttcatatgcggatatgccccacggcaggattaacacagtagaacgctatgattaaacaggcagcatgcgagtaagcaactcctgcttatctggaatgcaaatgttactgtcgtctgtcgcaaggccaaacggaggtctatatgcacatgcactcatacagtgacaatcatggattcaggatcaaaatggttaccaagcggcactcagggacctgcggttgtggattcttcaggggacatgaggctgcttcatgacagcttccaggttcatcagttcatcactgcagaagaaattgtctcaaacaggcagataattcatttttggagacggaccatttcatctttggagatgatccttactttttcctaaacaagtttggaagcgctatattgtagctatccagcacaatctataaaagagtacatatttggagacattgttaggcgaaaaagaacacctccagatgctacattatattctcacactaacactccaagctgactaagtgaagtagaagggcacttctggataccattactggctgttaacatcttctaaaaagatctgggcacaactctaagtctctaaattacttcctttctacacagatcatacagtacaaaaacaaggaaatcattcttcagtatctcatctgaagcaggccagcttaacctcattcatcgtcagtttcgaaggattcattccagcagctttcatctgatacaccaccctggtggcctctctgtacattccaccgcgagcatatgccatggccatggcgttccagcacactgcgtcgggtttgccatcaatagcctcaaatgccctggctgcatctgcaagctgcccttccttcgcgtacatatgaagcaaccctgacccgacgaactggttcatgtccaggccacgcttgatggcatcagcatgcacctgctggccatagcatcctttgttcttcgcctctgcacagaccgcaaggatgcttgacagagagaagctgctcctggcaatgcccgaggaagccatgcccctgaagacatcaatggcatcgtcaagaatgccgtcacgatggtatgcggtgatcaagctggtccaggccgcctcaggaactggttcttggcatgagaacctcatcatctcaagcacatgccgtgcgctgctgagctgcccactgtcgcagtacagctgtaatagcgagctaccaacatcgccacagactccatttttcttgacaacaaaagcatgtacctgctcaccgaactgaagctcgttcacccgagcacacgaacgcagcaccgccacaatggcatgggtgtagtgatcaccggtgatcccccgcacttggtgacacatctgcacgaatagctgtaacgcgtcatgatggaagcaaccatcggagtaggccgagaccatggtcgcccaggtgatgccattcttgactggcatttcatcgaacacctggcgcgcagccccgatgtccccgcacgccgcgtatgcaagcaccagccggttggcgaggggcaaagggaggccagagacggcgaattttccggcgatgtgcgcgtggacggaggcgacctcggcggcgtcggcgcagtctctgaggagggagacgtagacgtcctcgtcgggcgggaggcggagcgcgtccagcaggcggagcacgtcgccggcgccggacgagcacagagaagccgtcgcgcccgtcgccggcttcctccttatgtccccatcgtcgtcgctggaggtggtgggtacggggagactgggacgcgggtgcaggggcggcggcggtggtggtttggtgggtttccgcagggccggcagcggcagcgctcccctggcggtggtggcgttagcggcgagaagacggcggcggcggcggcggggagagaggcgcggagcagccgcggtggcggtggcggcgaacggcttggcgacggagaaacgcgccatggatggtgtcgcgaacgggggcaggaatggtgatgggcgcacgcccgctgcaaaacaaacgggctgtttttctcacagcgccagtggctgtttttgcttatcccctgcgcgtgcgctgccagcgcctgctgtagtgctgtctgttgagctgtacgagtggatgagattaagattttcgtgttaagctttttaaactactgaacggtatgtttcgtgcgaaaactttctatacgaaagttgttctaaaatatcatattaatttattttttaagtttgtaataattaaactcaatcaatcatatgttaatatcacctcgttttgcgtaaaaaacttaattttcatctccatctttatttttaggagaaaagaacaccacctatgatagagagtatattattatctcggttccagaatgttccagaatgcaagaatatttagggttggacacggttattaaaaatgttggtagaattaaatggaagaatgttgtgattggataataagtgaaagtaggtgggaaaattgaatggtggagggttgtgatttgttgggaagagaatgttgatgaagaagttgatatattttgggacaaatccctagaggctaaatattgttatattttgggacggaaagactagataagctattgataaaccatgaggtccacttgatacgctcacaactttggtcggcacgatctttcggtgagttgatcatagctacaatttggcgacctcctcccccacccgccggccggcttgtccaatgaggagaaaagtgagagagagagagagagagagagaggtggaagggagaggaggggaaagagatcagatgatgacatggcatcctgacaggtggggcccacgtgggtcccacgctgattcagccgtcacgtcggataaaaccgaggttaaaaccgccgaaggacctaaagtgaacggttttgtaagttgagggatgtcatatctggttttgcggttgggggacgattttataactcgatgacaagttgacggaccttcgatgtactttttcctataggtaacataacaccttgtttctgtgactgtggccaacatggatggaatttggggatgaggatggatccattggaaagaggatcccaagagtttccatcaaatacttacgagtcaaaaacggagctcgtatgcttggcagccgtttgaagtcaatgttgttgcaggtggccgaattagattcagaacttctacaacttgatctttgatatcttctagttgcctatgatgtgaaaaatggttgaatctatcgtagccatgattacatcagctataaggttatctctgtttttcttctcatctctctatctcttacctatacatttaatttattcatctaggaatatgtaaatagctagcttttgtatgagagacaatcctcttcaattttcaaatcctctctcctccacataagtcagttgacttatagcctactattaaactttctctaataacggcctataaaccaattactataaatttatgtgcaggagagaaaaaaaataaaaggtgttggttcttatataagagctagttctacatatgttttaaggtaaatacattaaatgcataagtaagaggaagagaggggagaaaaaaaaagtaaagcttaccttataagggcaatctcaatccaaacactgcaaaacagtttccatacttgccatgtcataaatacactaggtatagttactgtatgccgaatgggtggtgtcatcaaactaaattctcatccaatcacctctcttctctaatttaatccacctattctttattttcgttcttgattcttgtgtagagctggattcttgtatgagaaattgtttcttcatctttttccctcttctcattaactctcttgctatttcaactttttgcttatgtgatagtatatttaatgcttcgacaccagctgaggtggagggttgtgactgctctaagagcatcaccaacagtctacctatatgattccaaaaattgattttgagggattttagtaaaagaacagctccaacagatgccctactctcctacccgagttttgcagttcccttctcccgattcctcgctgcatttatatacgggcgcgaaactcgctcccaatcttgcactccccgcctttctcctcccgttcccgcgcgtgggagatagcgatctttctgcgtatgaaagaaacaaaaacggaattttctgttagtagtttaacataagggcacacttttaattttcgaggattgaatttaggctatctgttggagggaggagttttttcactttctattttcagtttaggaaaaccaaaaaaataattttggggaaagattataggtaatttgttggtgatgttctaactaatctatatatattggctctaacataggttaatagttaggagttagctcgatctgctattaagcttgctctaatacatttattcctccactttatcaaatctcaatgctaattgtttcccactttatctactcccaatacatttattctctacttttataaattgcaatgcaatgattacgggatagagggagtactccctccgtactcgtaaaggaagtcgttttggacagcgacacagtcttcaaaacacaactttgacttcttttttctataaaaatatttattggaaagtgatatatgtatacctttatgaaagtactttttaagacaaatctattcatataatttttacattttcaaactcaataacttgagagttattcatgatttatattcccaaggtttaacttaaatattgtcctaaacgacttcctttataagtatagagggagtacatattaagtaaccgtctgttgagtgatacgagatatttttagagaggtacaatagcaggctataaattagctgtaaacatattttaaggagataaataaggagagagaatggcatcgggctacagatttgtagccagctgcagcacggactccaagacgcagggtgtgtatgacaggtgagaccaggtattaatagtgtactatgtaactattgtatgaatgagctattagattggctatagataaattagagctagtagttggctatactattaaacttgctcttaggtatttacatgttaagtgatttagaatatatttgaaatttttactattgtaaaaatgttattggcttggtaacctggtcggttgtatgcaatacattgagggtaggcacattaaaagggaatcgttaaaaaaccgacgcaacctttttaaaaaacttctatatataactatattatat

SEQ ID NO: 4807 - DNA, 13840 bp, Oryza sativa
caaaatatccctaaatcggctagggtttcgatggtgaggttagcggaagaaggccgagaggtagcggttgtggcggcctcgacggtgagattagcggcaaaaggcagcacggtgcaacggggttagcagtgacacagtgcagccggattagcgcgggaagcagcgcagtgcgtcttgcacgctaggcatctacatggattctccaagctcgtccctgtcttgaagtcaccgaaagaaggtgttgttgatcaagtgtccgttgtgcaaggataaagtcattttggagcgcagagcaatgtcaattgctaatcgggacatcattttctatacatgtaaggagaagaatgagagggaagaacaatttgaggatttttttgggattctggtgtcactatataaccacgaggagatatatgtgacgtgttgtaatatggagggggctaagagcaaaagtgttgcctacgtggcatgtcacgttggcggtcaaacacagtcgaaggacgtttggaccggggtggtacattaaaccaagttcatggacctaaacgtgcaattttcaagttcacggacctaagtgacaccaccacataagtttagggaccggccatgtattttactctttatataatttatgtgcaagttatatgcaatgtttttaatactcatatacatattatataaaaagttccattataactcattatattgccgtataattacatatttaaatgttttcaaccaaagattttttagacagtcctgcgtgaaagatggcatgcagaaagtcttttttaagtggcggtcgccttgggccatatcctctggaaatgcacacatttctatatttctatagaagcggtcgcctttggaccaccgcctctaaaaatacacacattttcatctgcttacgatgaccacatgtggaaatgatgatatttatacaggcgggtggtttttggaaaattgtttcctcttggacctcgaaagtaaagaacatatgatgctccctccatccaaaaaactctagaacaaaaattgttaaagtttagatgggaatagtattttcttgagtacctatatatttatgatgttacatttctcatcaaatcaatatttttattttaaagtacatatattttgcactataaattttaaaacttactacttacgctataattttactactgctatatatgagaatttagacaaaaaatggaatgcctcttttaaaaagaacaacatccatcccagtcatgaaatgcatcataggcaagatggtgaggagactacacgctgagtgaatgtgagagttccaggcatggtttacatagttatcgcggttatcacctgcgataaccttatcagtttttaaaatcatggtatgtctcacggtaaccgcacggttttcgtgataaccgtgcggtaaccaccaaaccgtgggatggcagtaaccacccaaaaaacggtttggggaaccctggttccaagttcaactcctatatactagacgcgcatatattcatgcgtaaaaaaaaatcagaagctggaaattcattttcacaagcggctattaagaaccgcacatgaaattgtttcttcatgggcgaatgactttgtaccatgtaaatatgcgattttcacaagcctttgtagatgacttatggggacaacttgtttttttaagtagtgatagattatcagtgttatacataaggcatacccaatagtttttggttgggcttggcagggtccaccatattacaagtcttatacataatcatgacacatatacaaaaggtgttccagagataaggaaagagagacaaaattcggtcggacccggagttcggccaaacttctgggccacctcccgggcctcccctttggtggggagacttcttaatgggccctcaacatcatatactatggttgggctcaatcctaaatggtttttactgacttatgggacctccaatccgtataaacgcatcttgattgttcggaggtgtattttatcacatgacgggtgtgttttcttcataaaatacctacatacacatatttacgaacactagtggaaatgattagtaatagtccctaccactaagttggataccatattttatatcattatatgcaggcattgacggtcggatattataatttaaggaccgtcaacagagatcgaagttgattatcatggaaaagttttccaagtgtatagtacatttaattttcttgtgtcgccaatcatggtgatgcaaccagtattaacctgaaaatggatacaataaaatgcaactctcaatcggagcatttagctgaaatcccattttcgtcatttctcccaactcaaaatgtgtttgccactttttagaggcatcatgaccaaagtgccccatattgggattgattcagtccaaacgggaatttttttttggcagaaacgatcgattcagcacacattaggatcaattcaaaattgtctaaacaagatatcaaagtcatcaaattggatgctttgtgagcaacaattctggatgcaattcagtgatgcaattgattgtgtgagaggcacacactgagctccccccagcgtagtgttgggccttggtagccaagaaagcaaccacaattcatggatgctgaaccagcccaataggatctgaaggtagcagccacaatccaacacaatgctttgtttccgcacttcaaatcttcagatgcaactttccttgaacattctttcaccaactgatgaaaactaagggcaacggagattcgatggttggagcaactgaggaggaaggagcccatgaggtatagcacagtgagcccatgcctcctggtgcctgaccacatccctttccctcttggcgtggcctggttccggtaaaaactgaagaagagaaagagagagacactgatggaatatgatgcagcatgctcgacttgacctgactgaagcagtacaatcagggacattttagatggcaaatattggaaaaaaaatgggaaagccattttaattttggaaaatggcagaaatggagtttcagcatacactcgatgatgagagtggctttttatcgaaacccattagcgggatgtcattccagtgatacccacttttgatgacatcgtatatccaaaattctctgactgaggaggtgtaggggatgagtatctaataggttcctgatcaatgtgcacaaaacttataggactcatttatatgcaatctctaggtgtgcctcccagactagttggagaaagccataaaaaaccatcaaaatgtgaccaagcggaacctaaactaaaattgctagaagatgatgatggaaaacaagagcagatgatgccagacaactctacatgttcaaagggtacatccacgtataacactcgctggtcatcgagatttggccaccaccaccactacattgtttgtgcaacgtcattgagtacaacactggactattaagtttaagtccaacaaacgtcgtacaaggcctgagctgctcaaacccactaggaattaggatgtacctcaaaattgttgtaccgctctgtagctagggacgatgaacctgaacttgccaccagttctggatactaggtgtggacacatgggaaagctatgtaacaacatggacactttagtacgtgctttcattaatattacaaataatctttatcatgtgccaagattaaaatgcctaatctctgactgataaactatgacaccccggagtaactgaagaaaaaaaagaaagagataaagagaagtgctagtgggctgctttggtggtttttgggccaagctagctagagtgcagtgtgtgcagaagttgaaatgcgcagtaccacatgtagtgttggactttagtcccacatcgctacttagttgagatggacatgtttataagttggatagcacccaatgacaagtaacacatgtttgaacctttttgcgtgaagtgaggactgaggacgaaagcacagagtgtaggtatggtccaaaagtgagttaggcttaatcattttttggagttaggtttgaatcatttttgggcctgggcaatacataaatatgttaatttagttcatacgttatattatcttgtaggttagttaatgttcaccatttttgtactactttttccttgattcttctaaagataaagaattccatatatataagccatggcaatgacattaaccctcttcttcttaatgataagaatgaactcttgaatccagttgatgcgatgacaacactatttatgatttctatcgtgatcaacaactaatgatgaatagtaacagcttgttcaggatcgattgaactaccactgataagccgttgaaaaataaatgaagcaaccaaaaataatttatgtgtacaacttttatatatgtattgttcgcggcttagaagccaaggttggaaaatagacataactgaaaaaaaaacaaaaaaccaactcaaaattgttctagctaataagccaacaagcagacaatgagatgcacacactgagctacacgcaacattctaaatcatagctggtatgggatgaacacatgtaagtgttttgcacggttgtagatacaaacatatacccacgacaaattgagcattttaggcttgcatttctagccattatagcataaccttatcactttgatcaatgtttatcctattggcagctcataactactagaccatttagtgtgatagctaacctttttgagatgttgatgcactcggcatacatggaacgccatactctagctttctttgtggccgttggattgacctagatatgaacggccgatgtatccctgcgtcccctatattatgagggaagtcaagtccccatcttcgcactgaccaatccccttgttgatttgctccatattgaggttgatttgccttccctaatatcctcccccatcgacaattctggcccttgcttccttccttgggaggtgaattatagtggctacgattgactccttcctcaaccaggagttggtgatggcaaccgacaggatgccggatagtcactttatggcctctagcaatggtggggcctgctaccaaaacactcatggtactccaatcactatgggggtccccaacttaggttgtcttgttgctagcataggcattgctccgtcaagctctcttatgccggagaggggtctggcaaccgctaattacaacttggttgctaactttccagaagatgctgccgtggtgcctcaacaacagcagttgcaagctgcatctagtaacagcaactcagggttgatcaaaggagggtggacaagagaagaggatgagtaagtgacggatcatccggcttcgactcagatttttactcttgtttctcggcatctctttcttctcatgaagagatcgtgtactatcattgtgttttcttgattgtagagttcttagacagatggtgcgacaccatggagatcgcaagtgggcagagattgcaaagagcctccccggtcggatagggaagcagtgccgcgagagatggaccaaccatctgcacccggacattaaggtatggatcttgtgacattcctttggttacatgtgtagatctaagggatctagttttttttctcaatgcaatttttgaggtggaattccttttcggatttacgtaaaaatcctagaaatttcatccctccattccaaggtgaccggttattaactgctgagtacggtagtcatattgcataacttttgttctagataataaatatgggaatttcttcattatggccattaatgtgtcccatacttagtcctagggaactcgtctggacagtactccaccaagtttatttatgttcttagtcgttgttgtctatgctaattaagcataatgttttggacacttatagttaaaaatgtcttagacacttattagtccaatgcctatgtttttatatgctgctttatcactataagcaagcaatatgacattctactaggtttaatatattctttatttgtcgccagagtaatcaataacattatttggcagtaccctgcattatcatgtatatgtatatatgctttttatctctcaataaatgtgctcaaattaagaaaatcattaaataagaatccgtaaagttccggatacattaacctttaattgccttatgctgttaatcatatagatgcatccaatattaataagtagcaaatataaattacactgcagaaaggcatctggacagaggaagaggacaggaagctgatcaaagctcatcaaacttatgggaaccgttggtcagcgattgccaggtcgctccccggccggtcggagaacaccgtcaagaaccgctggaacgcgaccaagcgaagcctaaactcaaagcgccgactgaggaagaaaaacaatgagcaagcagtgccaaggcagccttccctcctcgaagagtacatccgtagctgccagcacccactgcccaatgagacagcaccacccgcatcattcgatatcggtgggtacggtaccggtgggacgatcggtgcaagtccaaccccacccacagtgcatgcgttgggtggatctactccactagggttggtgatgttccttgacctacttaaccaggctacaccgcacccaccacagccagacttgaacttgttgaacataacaccggtggtgccacatctcaacactagtgaatactgcctacagctcgatgcgaggggcaactgtagtatggccagctgccggtgcaaccccacgggatcagcgcccaggtaggcccaagcaacgtcggcaccagtggcagaaccggcggcatggacaacaatggcgtcatccagatggcgtctaaccagttcgtgatgccatctgagggtggtggcattcctgacatggccaggtggatcaactgaggcttgcttgcagtattgccggatcatcactcgtttaataattattattattattattatcatctctgagttttttttctttttggaatttctccaattaagttgaactctcacctacaattgcagtttgtatggctatatgcctatactttgatttgtttggaacatctgagtcttgagtcgtccctgtggtgtgggagcctttattaatttcttgttctttttaagatattgtttaatgtatgaacctttattgtgttgtgcttattatatttaaggtgtcaatcaatgtatgagttacattgttctagaatttttacttttctttctcaagaaaagtagcatatttaagttttatattgttgagtgggagagtggtagtatctggtacccgtcccataatacaaatgattttatgggaacacgcgtggggagggggatgtttttttaatgttagaaaagctcaaatatgtaaactagacattagagataactagataatacgagagtcctccatttggctgtagggttaaataataaggtagctctgctcgttaacttaaatgagttaaaagtgtagcttggcaagctgagtataaactgctattttaagctcgctgacactgtctaatttatttattgcacctaaaaaattttagcatttgaatttaatatatattaacaagataatataactaaatggtgaagtagtgattaagtagtgatgtactaatcttggaagtaacttaaatcattaagtactaaataagaatcactaagtataaaatgataaagtttactttttgcctactatgctcaaagtccccttttttaccctgaagtccaaaactggttgtgtttttaaccctacttcaacgggaaactgtcttaacctatcaatcccacattggtcaaaaaccattcaaatagttatgaatcttttttttttaaattacaaattcatatgacacacacacacgcccacacacacacacacacacacacgcacgcacacatatatatatacactactttacaaaaaaaaatttagttcctaactcaactcacaaattgagatataaaaaaagataaatttagcagcatatgaataatagtggtactatttatacatgaatttatcttattttcaatgtgtaggtcatatttgaacttgatttttactggagtgtttaggtatcactatactctacattatcattcttttcttaaaaaaattttataactctttacattgaatttggaagaaaagtctaccttggccagctaagtgtaaactggcttgtcaagctcgctcacatggtctaacttatttatttcaccttaaaaatgagcattttaatttagtatatattaacaagacaacataactaaatactaaagcagtgattaagtagtaatatactaatattggaagtaatttaaagcattaagcacttaataagaagcacaaagtacaaaatgacaaaattaattatttttagccagctctcatgtggtgtagtattttttttgtcactattggtatttcttaacgacattgttgacggtcgttattgaccaatttcaaccgtcaatataactaaaataaaggagaactaactatgcttgcaatggatatttattttagaataacatagttacacctgtacttggagtattatttgtttgcagagattaatacataaatggagaagaaatgagaaaacttcacttctaagcaagcttaaggataagatgggctcacttgtcaggtgcaaccgtcccggaaaccgccataattgccacaaccgtcatagggacccacctgtcagtgaccctgggaagtgtggaggcctgctgggccggcccaggttcgaccgaaccctggtgacgccagctccagttggccttacatgtggacgtccaggattgcttgctgatggtggttgtggggcatttcatacaattcgcatcaattacaaccgtcatacttgcctatttcaggaggagctcattttactttcaacacgcactcaagcaagacttgatctcgatctctctctctaaagtttagtttagtgctctagtgctaagtgtagtagtgttccatctgatgcccaaatgttcccagcaacttttactgtaagggcaagagaaaaagagatgaatcaatgtttccctggggcctccacagataccacaatttaaaacaacatcatccggtgcacaatgtctcttatcaagcatgtcccttgtgtttaatctatcccacaacagatcaagccacatgaaaatcttgatcattttcacacatttggttttccagatccactagaaaggtcttggaacagagattctcatgaaattaggcctatagaacttatgagcgtaaaaggttagggaattccaaaaaaaaaaaaaaaccaagagtcacctctctatgtgctaggtcctaaaccatctaactctgattctagctacaaatattgtatataaacatgtggttcaagtggaaggttgaaacaatcttcaagatgcacattattataaaaacacaccaactcccatctgacagttgtatgatagaaaagacctggaaacttatactttctgatttttcccattccaaagatcatcccagaacaaaacagtagtcctagactagattgtgcattgtgatatggctctgtatatgtcagataggtggaaaattaaatagggaacttttgtcatgtaatatgaatcccaaataagtcttacccagcgcaaatcaacagtagtgtacaatttgtgaagatgttttaggagcagagccacattctgaatgtatagatttataacacctaaacctcttttgtctttcggtctataaactttgtcccaggcatatttttcaatcaaatgggcttgcttgtcattgacttaattttgtagctaagcttgcctcaagtgtgatcaacgttttactaaccatagtacgtacttgtggcaagccatcctatcttattataaaaatctacgcttaaaactaagcattgtgcttaacgctaagtcatttcagcttaacgctaagttgggatgggggcacgcgaccttgcgcggttgcgccccggagcactcctgcagtattagggtttccatgcatttgtacactggaagtgtgcctttatattgcccctccatttctacgtttgctccttcaagagacaggagctatactcgatcgagtagccggtatagctcctagcttgaaatcgactgccatggcgccagaggcggctgctcctcccgccggcgagaagatggccatccgcgtcgtgagccgccgcctcgtcaaggcctccgacgcctccatccagccacacgtagccgccgtctccaacctcgacctgtaccctaactgctagtctgctatcaagcctccatcgtctgcctctacccaaccaagcttcccaacgccggtgatggcgactttgacgccgtcgtcgccaccttcgaggccgttctcccgtcattgctcaaccacttctaccctctcgccggccggatcgtcgtggaccctgccaccggcctccccgagctgcactgccacaaccagggcgcggagctcgtcgtcggtgaggtcgacgtcgcgctgggcagcctgaactatgccgtgaccaactagtcggtgaagagggtaatggttccgtaccccaaggacgtgccgcgcgctgtcggtgcagctgctgcggttcgcctgcggcagcttctccgtcgtgtgggggaactacaacctcctccacgacggtcaggtcagcaccatgatcgtcaggatgtggtcggagctggcgcggacggggaggatctccgacggcttgccgattaaccacgaccggtcggtgttccggccgcggagcccgccgtcgtacggcgccgcgatcgacgccatgttcacggcgtacgacgacgggggccggctcgtcaacgccctgaccgcgcacgacagcttcgtcgagcggctgtactacatcgaggccggggacatcgcccggctgcgcgacgcggcgagcgccggcgccgagcagcagcgcgcgtcgcgggtgcaggcggtgtcggcgtacctgtggaaggcgctcgccggcgtggtggccgcgtcgtgcgtgcccgaggagcggtgctgcatggggtggtgggtggacgcgcggcggcgggtggcgtcgccggcgctggtcccggcgatgtgcggctactgcggcaacgtgacgtcgtacgctctcggcgacgcggccgtgggggaggtcctggagaggccgctggcggaggtgccggccatggtgcgggagagcatcgcgtcgatcgactacgacgagtacctgcaggagctggtggactgggtggtggggcacaagacggagaaggtgatggagaagggtgggctcgggctgggctcgccgacggtcaccgtcggacggtgaaccagacggtgttcgcgtcgttcccgctcgacaccgacttcgggttcggccaggcggcgctcgccatgcccatctgggaccacggcaagatgggctgcgggacgctggccgtcggagtgcgcccgggaggcgacgggtcgtggctcgtgagcgcctacatatggccgcggatggcggcggcgctcgagtccgacggcgtcttcaagcctctcacggcggcgtatcttggactcgtctagctttgctatatatgcgcgcgcggggcttttttttgccttaattattatatcgtgcctaagataacggccggccttgtgcgcttgcatttgggacttctgtgtatttcacttcaatttaccttttttaaataaaggggctgtctatacgacagccggttaaattcaatttggtttgatcattagaatttctgcctaattaaacgtacgatgttatcggccatcccgtatgccgagaattagttatttttagagtaactaggtattcaatttgtttgaagagtaactagtactctatttttaaagttatttttaactaatacttaattagttatacattaataaaccaccacgttttcgtgcggggaggtggagttccaaactttacctaatataacatataggaaaaagttcgaattaccccccaaactatcgcggcgaccgaattactgccccccccccacctaaaaactaaacattcctcacccctgaactatcaatactggactaattaccccctcaacccaatccagagcggttttattctatgtggcgtacgcgtggcagtccagtcaacattttcttgtaaaaaaaatagtgggacccacacatcattcctccacttcatctcttcataatctctctctctctctcgagcgggcacaagtgtgcacagcgatgcagaggggcaggcggcggaaagtggcgcgcgggggtggcagacgacggtggcgcgcggtgggcggcggcgcgtgggccggcactcaagcggacgtaggcgtaacagcagcagcaggagtgagggcggcgcgaggatccaccacgcctgatcctcgggagcgacgccggcgcgtggatgtggaggccttcatcctctagagcggccagcgggagtggacgtgggaggcgtccttctcctctaccccctcgccgtccccctttgccatcgccgccgcggcctccgccccctcgcctcacggccgccacccatccctccacgtgcacagtggcacgcacggtgcagcgtgtggacgggaggtgggcgccggcgcgcgggaatgcacggtgggcaacgagcagcaactcgacggtggcttggctgtgcccgagcaggcggcggcatgagacggttagcgccatcgcttgcctgagagcgtcgtcgtctttgagcttctaccgtgcggcgccgtcaccgcatggtccgagggccccgtgccaccgcgtgcagaggccatcgcctcctgctcctcctcaagccaccgcgctgccgtgtgccatccccttgttgtgctcgagcccctgcatagccacgggccactacaccgccaccatggcctcctcctcctcgtcgtacccgccgcaattgacaccgcctccacccgttcgctcccgcccatcccggcacgccgccgcccacctcccattcccgcgccgctgtgcctgctttgcgcccgagagagagatagaggaagagggaaagagggggtatgacatgtgggtcccactatttttaaaaaataaaatgttgactggatttccacgcgtacaccacgtaggacaaaactgctctggattgggtaagggggtaattcgttcggtattaaaagttcagggtgaggaatgtctggttttcgggtttaggggtaattcggtcaactgcaatagtttagaggggtaatttgtactttttcataacatgtatacaactataaaatatatgcaactttgtaacttatataggttacagtgtagttacgctattgttgtagtgtaattacattggtatactacgactatactatataatactatacatagttacaacttacaacagttttagcaaatcataagcaagcttataacaaattgcaagcatatgaaccaactaaagcgaggactcggtgctaccaataaagtttcacgatgtttcttaaaaaaatagtcaaagaacattcaattgaaaaatgagaacatcttgcttttaatctaaactttgttccacctgttttctatacaaagtaatacgcatgtccgcgtgaatgtactaactacagctaccttatcttaaagaataaatttcaaaaaactgcaactttagtgacaaaactatcagtttgctgcaacattagcgacatgtttcagattgctgcaacaatagcgtgggaaattatcacaaagctgcaacttttacgttatat

SEQ ID NO: 4808 - DNA, 3565 bp, Oryza sativa
aatgttgcagcaaactgatagttttctgaaatttactctatcttaaatgataaatatttatgactagagtgattatcaataatatcttgcccttttttaaacaaatactccctctatctcataatataagacgtgcacatattacaggattcaactttaaaaacatttgacgaataattattataatataaattaaattttatttattaaaattaatattattggattgacatttaaatttactttaagatgattataattttgttgcaataaaccttataatatatgagaaattttaagttaaatattagttttgaagactgtgtcaagttcgacaatgctttatcttataggatgcggggagtacaatttattaaagatgaatttcaaatatgtatatatggaatagaatcctggtactatcgcctaaagcaaacatcgtgcataggatatagatataggctttcttgatttcgacaggaaaggccgaaagggagactgaactacagaaaataactttgatgagcttgacagggggcagcggtgttgtcgtaagccgtagcgaccgtccataagtctctactacaagcgtgtgcagtgtgcacaccgcttaacaaccggcatctcttgggctgcctccatggaaaccgcacatttcgaggttttttgcttgctagctagctcatcatgatgtgtactaacgtactccctccatctacttttgatagttatatttccaaatctgaaaattttatttttgataggcatatttcaatccaacaacttatcatcttaatgactttcttagatttaatgcatgactcttcattcttctacacatgattggctacatgggcatttagaaatgtaaatattaatgaatcacttgtttacgaggaatgactagtagcatatttaaatggatgataagtaaaattacttatccttggtctatgtgccaagattaaatatgactatcaaaagtagatggagggagtagtagcaaatgaaacattaacgcttgtggttattaatcatacgttgcaccgacgttccaatcgaattaattgcctcctaactaacgggtttttaccatcaatgcaaaatccgcatctcttataatcggttgatcaaatgagaacttgtgaattgtctgtcatggccgatcaccaaactctctccgctgtcttcttcctcctgctcgtcccgcacgccgcgtgcatggccatggccaagccgtcctcctccacgctgctgcaggacaagtgcgagctctacgccgccggcgaccggcccagctacgactactgcatcaggacgctgcgggcggacagggcgagcgccaccgatgacgagcgcgggctcgccgccatcgcggccaggatcgcccgcgcgaccgccgtggccacgggcgccaagatcgccaggctgcagcgcggcgagacggcgcccgcgcggcgggacggcctggccgcctgcgccgcggagtacgccgccgccgtgcgccggctcgggcgcgccgcgagggacgtcgtgtcgcgctcgcgcggcggggccggggcgagggagatgcgcgaggcgcagacgctgctggcggaggtgactggcgcgccggagcgctgcgacgtcgcgttcgaggccgccggcggacaggggtcgccgctggacgccgtggaccgagatcgagctcgacgtcgtggtcgggttggcctccgacatcctgccgccgacgaggccgacgtgatgtgatctggcacgcttagctcgcgagtgattaaccacactatatatatggatttcgtgagattattgaaggtaaaatttcacgttgaagagttcgaatctcagcttaaaagtttcaatgtaaaaaatttgtagttttaaaaatttctggttgtgtttcttacaagaaataaagttcgtcgcagtataaggcgcacactagatgatcctaaatctaataactcgtgacgtctgcccaagatatgaatgaagtacgaaaggtcatgtagcctggcgggtacagtgaagtcttaacttcgctaagagatcagagatgtgtcgctagccttcatctacagagcgtatgttaaggactcactaggggtgcatgtacgtagtgttgtatgtgcgtgtgcttctgctttgcaatataagaaaacaagttgtacattaattagtgtttccatagcgaacactcaatgtagttaacctcgcaatgctacaaacaaacataacttatcttccacaaaagaatttctaggggtgcatgtacgtagtgttatgtgtgcgtgtgcttctgctatgcaatataagaaaacaagttgtatattaattagtgtttccatagcgaacactcaatgtagttaacctcgcaatgctacaaacaaacatagcttatcttccacaaaagaatttcagaattgtaaactagttaaaaaatataacaagcagataagcctttcctgtcaataaaccttggagatcagcatctatatgactataaatcctagagatcagcatcgaacagacggagtgcaacctaaatccgtagcatggcgatggcgaccgccccaagtgcaaataacagcgcggtgttcgacgtgccctccagccgcgtcgctcctgcacgcacgaataccattcggattaattaaattaagttcaaaacgtaaattaaatcaccgttattttctccaaaccttttttaaatttcatcacaaaccaatctactccaacaaaaataacatgaaaatccagttcaatctacattttaacgatcaaaagctcgcaagaaattaaattgctcaccggatgtctgcggaggcgccggcggcactccggtggtaaacggatattccggcgtaagtggcggcagcggcttgcctgaaaaaaaaaataaatatattaattaatcaatggagatcttcataaacgtccagggatcttccggctaactttataaggtagtgagctagatgatccgagtttgaagcctcaccctttctaattatttaatattagtttcttccttccaaataggttctttcctaatattcgcgcttttttatcagtggagattaagcacgataaatcttctaattatttaatattaggttttcctaatattcgcgccttttaatcagatcagtggagatcaagacaggattaagcacgattaattgattattagttaattaccggcgcaagagcgggcgatggacatgaggacggaggcgtcgccgaggcaggcggcggtgacgttgaccatggcgcgcgcggtgtcgaaccccgggccgacgagccgcgccacgtcgccgtgcaggacgtgcatcaggcagcacggctgcttggcgacggtggcgttcagctgcgcgcagcacggccgcggcaccgcgtcggtgcggtgctcgatgaagtccaggcacgacagcatccgctgcattgtacgcacacacgtcttcggcgccgacgccgtcgacgccgacgccggggggggcgacatgacggcgaggagggcgaggaggaagaagactgctagccttggcacccgcatggcgtacgt

SEQ ID NO: 4809 - DNA, 19727 bp, Oryza sativa
acccctcctcctcctccaggcccatctccatctccgccgccccgtccgacctcctcgccagcgtccagtctgtcgcctccgccctcaccaccatcgtcctcgtcacgagtcaggccacttccttgccgccacctccccgatgacgacccggactccgacttcgcgcccgacaacccggacctcctccgcaacagccccgtccccgaccgcctcctcgtcgtctccgggggtgtcgccgccaacctcctcttcaccttcctcatagtctacgccctcggccgcccgccgccgcccctcttgtctccggcctcctcggccgtagatggggaagggggagagaaaggggagagagaggggggaagggaagagccagacgggttggagagagaggatgacatgggagccccacatgtcagtgggtcccataatatatatatttttttgtgaatgacagatgggtcccataatttttttttaaaattctaatgccacttaaggccacgtgggacgaagactgggtcaacactgccacgtcagcgccacgtcagtaaaaccgccctccaataccgctgagggagtcaaatcgcaccggtttcaatagttcggggagtcgttctatccggttttctggttgtgcgatacgaattagattcggcgtacaattaagagagtcaaagtggactttttcctaatagcaataagccaatttttcaaccctaggctgagttaatagccacccatcttggtaacaaattaggcccaagctcagatcaagtcgcattgtcctaggttgcccataaataatacttaggatatgtttagattgtagccaaaataaatcttactaaatttgacatttacaatttggcaatattggaaaatctttgagatgactctggcaaaattccataatgcaaccatagacaatcaaccatccattaaatctgcttgattattggctataaattaagcgtttaatgggctagacaaaaggcccaaacaggaattgggtgtttgttgggcctgatcaaatatatattccttcctagaaattaaatactccctccgtttcgaaatgtttgataccgttgactttttagcacatgtttgaccgttcgtcttattcaaaaacttttgtgaaatatgtaaaattatatgcctacatgaaaatatatttaacaatgaatcaaatgataggaaaagaattaataattacttaaattttttgaataagacgaacaatcaaacatatgctaaaaagtcagcggcgtcaaacatttcgaacagagggagtatttattattgggtctgcaaaggctgagtgctactgtggtagttcaaatattcaactcttcaacttcaaggcctcgtcaaatccaacaatattggcactcgagtggtttttttttaactgaagcactcgagtggttagatgtggttagactagttcattgaagatatggagagaagggccggagaggaagacagagcaagaagaattacaagcccaaaaggaaagattttagaggaaatacatgctccgaagcaaaacattttagaacatacctggttcaaagtgaaaccattttgtgagaaatacatataagagtggtataaaaaaagatagtccaaaatataattcactcaaccttaaatgtagctagatcgaccgattagtcccatcccgatggaatgattatattattctctgccagcatgaaattaagctttgaattcaaacccagacttcaaatctagaattttatccacctctcggtattgtaccgatcgatttcaaacctccccatttacttaatcgtatattttgtccgacatataatcccgataagtcctgtgactcgatccctatcccttggtgcatgtacacgtccacatgcatgcacgatcgatctacccaccacgtctcaggccaccggcgataatgggtcggtcgtacgtacgtttgaccttaattgtgtgagtcgatcagttagaattgaagcttagctaagctcgctgcctagcttattggacaagtaaattagcacgccactcacatgatctaaatatctgatcccaaacatttggagtatatagatcaggatgggacgcccaaaccacgcatcagtgatgtggcaacgcgccatatgcataacacgtggtccccaccctatccacaggataagaagtgaagtagtacatgccaacgtttcaatgcaaagggcacaggaagatatacgtttaactatttaccttatttaaataatttacataactataatttagtttattgtgagttgttttaccataaaagtttttaaacatgatttatatcttatacatttgaacataaattttaaataaaataaatagttataaatgtgtgtctaaaagttaacggtattacatatgttaaaaattaaatgaaagaagtagtaagtagattaaaagaaaggagtagtaagtaggtagcatatcgtgtacgcaatcattcaatcgctcgagaggatagatatttatgatttctatataaaggcaaagtaaaaaagacatcaagtctaaaattatagttgaaaatttaaaattgctttgaattataatccaaagaacaaccaagagcatatacttgcagcacattcataatccacacaggaccacacagtctggttggcaggtgagcgtgtagccgtgtacccatgacgatatgtttatttcagtttgtactgatcaatatgtacattgcacgtggcagtaggtgccatgagccatgcatgtgcccaagaaaaaggccaggtgcgcgtgcgtagtgcgtacgtcgtcagtacgtcggagtaacttctagttattctacctgtcaaaaagagaaaagagagagaaacttctagttaaccggcggccaccctccccttatcatacgtaccttaccatcgattcgtgtgctcgtcgtgttcatttttttaagcaggtacaatagcatactattaaccagtaagtatattttaataagataaaagatgagatagaagagcagtggcctacagatctatagccagctgcagcacggacttcaagacgtaatgtgtgtatgataggtgtgaccatatattaatagtacagtaattaactattttataaattagctattagatcagctatagatgaattagagctaatactcttagtagtgggctatactattaaacttgctcttacggcaacgatgtcctacaaggctacaacgttatctgagagtaaatagaaggtacgttgtggatgtacagctttatcacacctcatactggattacattagctgggttgttagcgtactttagcacctactttagctgggttatcacacctccaactttagcacctaagatgaaaaaataggaaaacgcaaacagctttaagaagacccggtttgccatatgaggtcggtctaaccgctaccacagggccggtcagactgacggtgtgggcccaatctagccgtcagcatgaggccagtcagaccggcagagtccaacttcgagtctgatttatcggttcttgggttttcttgtttgggcctgaggttatcttcaaatcgatctaaactggcctcaaggctgatttgatctctaaatcggctctggtagccagtttaatcttcaacacctatcttgatttagagttatctagatcatgatagtaggcgactccattaacaccgcaaatctttacgtgagtctcatgttgggactgaaaaaggtggcaatagaatgcttacccaccacatccacaaattcaccctccccaccgctcattgtcctattagcacagtgtattctactagcactaattgtactaagtaggccagtaaaacataaatctagctgtcaatgcaatagacaatttagacctactccctcttttgttactttcggctataaatttgatgtaatctatgcctagttcttagctattttttttctagagcgaagggcgtgtttttcaaagaaaaaactagacctattcactatgttcaaaaccattgcacaagttggagggtagcactcttgcccctcactaggccgtcatcatccatgactctacgccaccgcttgtcatacctatatgagacatcctatactaaaattaagtggctcccctattttagtcctcttattatgcaagttttccctactattcagttagggaagtccaatagcttggagacctaaagtactcttttaatcacattttttctatgtatacaacttactactatttcttctattttggaaacttttttttttaccttagcgaagcaaatagttctagctagtagaaaaggatgggtttgactaaataaaggacaaactttagaaatgcctttagtaggacactggacacacactttagaaatgctttttttttatgggatcgtttcatctatgatggatggaatgatcccatttttgtaggaatgatagggtatggcccgcaagtcaatgagataaaggaagcggattggaatggtccttactggattcggttaagaaaagaagttgatcaaccgatggaagcatatccagaagagaccgagttcaagaaggaatcgtgaagaccatggcatggcaatttaattaggtaggatctagtaactttcctttatctttaggaagttttgtctagtgtccgatcggaccttttatcttttcttttaggcaaaatttgctatagggcatcgaaaaaatgtgtaattagcttgtggacaccgcaagaacgagaatttgctgtcgggcataaaaaaatgtgtaattagctgatggatactcacggccttattttattatttccgatggatttggagagagaaacactggtgagagtacgattttgcccctgccatcgtttcacttacagtagactgtgtctggttcgaaccaagacccagtccagtctcactcccctgtagccatcgcgcacggcgaggtgatgttgatctgcctagacttgtaccttgttcaagaggtgacgagcacggaggaaagcagagtcttcgtgagcggtcgccgaagccaccgaatccgaccccaacttgatgtccgcgctcgcaccggcgggctgatctaccaaggagcgggctttgcagatatcccgattccgaccatgcatcgccacaagaggcagtggtggtaggtgacaccaggttcgtgccgccgacgctgcagctggagagcgcctagagaatggacggcaacaggatggtggtggcctggcttgcactgtgcgcgccggcgagcatgacgaggtcgcgggggtgaggtgggcacgccgccttgcgaccggtgagggagagtgcccggagtagaaacgacggaaacatgcttgtacggtacggtgaccggcggcgatcgagtcggggatgaattggggggatcagcgtctaaggtttgcagggatgaatcgaatccaatccaccacgcggtgctcgccttctcactccctcgttgtaagtggaacaatggtaggggcaaaatcgtactctcaccagtgtttctctctccaaatccaccggaaataataaaataagcccgcgagtgtccaccagctaattacacgtttttttgatgcccgacagcaaattctcattcttgcgatgtccaccagctaattacacgttttttaaatgccctgtagcaaattttgccttccttttatctttaggaaacttgtatcgtgtccgatcaggactagtatcaatccgagggtataaatatgtacacccgggttctttgtaatctatctccacaggacaattacataattacttttggactatcgcaacccttattccaccgagttcttaattagtttcgagttgggttgcacggtttcgatctccagcgaggaactaagtttcgtcaacttcgctagtatcggcgtggctagaactatctcggttaagtccgatattctatctaggttgatgcaacgttgcctatctgatatattgattcgatatttaactgcattgttgtttagagtcgtatcaacttagttaagactttctcggttaggtttgatattttgactaagttgatatttctctaatcatactgctgttctagatagatttgttatatccatcatgtttgtgtaaatctatatactaattagatttttcttattatcttcaatcttatattgtctttgttaggtctgatctattagattgctgctagtaaggttaattctagtaacccgataggtttttacgcaacgttcatcggagtgctagccaatgagttatcattattgtgggtttcagctatcagatatatcaattagttagccgatgtacattttaatttacttacatcggatctccaaccaaggtatgctttaaccatcagatttacatttatcacattatatcagtatcggttgattggttcatattatattaactcgttgcatcttctgagttacatcaattcatactcaaacgtgtataatctttaattaaatctatctttatcaacttcaatattgtactgtctcggtttgatccgatctatcaatattgttttttataaagaacggtttattgatgattatgcatactttgattccagccgatgacaacataaatctcattgtttatctggtatatttgaatctacattgagtctatagttgattgatcaaaaccttatcgacatcagctgacatcgctacatcacatcggcctactggctggcaactccttgatcatcaatctatttccatcttgttagttgcaggatcaaactaactggcacgccctgaaaccgattgattaaacctgcactggagctaagcaaatctcccaatccttcgtgtgaatgatgaatttcgcgtcaacaacaccctgaaaatgggttcaccctaacccatcccatcgccttgctccgatcaaacacatgcttagggatagggatgacaatgtagggcccaatcaccaatccgtatggtgaattcatcaattaggcctagatatgacgaaatcttttcaccacgagtcaattagtaggcccaactctcatgtcggatctatttaggccatggctgatgaagcattcactttccccgctaaccatcaggagacctaataaaactgctcacacgtgggattacaatataccatgtataaaacctgcttcaaaccttagatctcaccatgttttgtgaattttgtcttctccaccccacatcaccctctttatttccatttcctcctctttttgctcctttcacctttcgctcctctgacgctagcgcctccactaccatatgctagatcagtgttacccaacattcttccagcaatcccgcgtgcaccagattatcgctgctaccgctacacatgacctctaggcgtgacaacctcattgcctctcactctcagtaattgtgatggcatgtctcggtgagtttctcccttgcaattctcggcagttgttttgggtccctttgataagtgcatggtttgttgggaaagatttagatttctaattgttttgaccatatttttacttgattggtagtgttagcgttcatttgttgtttaattgtaaattttgacacctaaaaattcctacacccccgcttgcggggtatttgtcaggagaatttactatttgccatcctaccaaaaatatatgcccaaatgccactcttataaattttcattcccatttgctatccgagtctacatgtcagccttctttccgggtccacacatgttcacaagcttaataaatagaaatgaaggctgacatgtgagcccaggtaataattgaaaataaaaatttaggaaagtggtatttagccatgtgtatttgggtaggatgacaaataataagtaaatcctcctggtttttgcctgttcctagccggggacggctgcctgtgattccagtagtaatccacggaccagttttgcatcctttaccaattaccagtgaaccgcgttcacataaacccgccgcgccgtttgcgtccattccgtgagaagcgaacacgacccacgggactcgacgcccaccacacggcccagcatgaccatgggcccacttgatccacagaacctctccccacgtgacgccggccaagtggggccggggcccccttagtctaagggccccacctgtcagtcagagctttgccgtgtcacagtcgaggtcgggctctctcccctccctttatttaggccgcgcgcgggccgaacgaacgcaacacccgccacaagctaagctagagcacgagggtcaggcaacgcgtttctctctcgctgaaaagtttgctggatttgctcctctccctctctccgccatggaggaggcccagtgtacgtctctgtctcccttctcttctcttcatctgttcatggtgagtttgattggtggtgtggtgtggtgtgggactctgaggctgtgattgattcgattctgggcgctctctctctctctctctcgctgctttgggagtatcgaaaccgagaatcgggatcggttcttgatcctgttctgttctgttatgttctgggtgtcatggggcagagccccattgggatgtgtgatctggtgtttgagggggagaggttgttacaagctgtttgttgtttcttgctgcctgaattctcggatgaatttggcactgttcttcgttagaatgcacgatgctcgtttgagatctcgtggatagccaataatcatgccgaccaaatcaggattagtataaactctgagaattccggtgaccaccgggttcgattctccatattttgtggagctttttctgttgcaatcgttgttcttggggtcccaaatctgaaacctttttgcgctcgcttaatacttttttttaatgtccattttcaccggaatctgccaaaataaacgcacgttggcgactttattagagggttggtggatgtagatgctcttttttttttctttctctttgacaggaagatgcgtgtgagctgtggcaatgtcattagaaaagtacgcctttttcttgcgtgtaggttgttctgttgagagaaagaaaaaactgatgagaagactatctcgggctgggcatcgcatctttagaattgattgagtgatcaaccggatcaagtaggatatccttgtgagttggcatccctatcacgccatataaggcaaatgcagaactcgtgttcggctggaaacaactgaaagtagatgagagcgatgtcatgctgtctaccggttgtcacagtaactctgttctattgatatgcgtgtaccaactggccgttgatgcctttggatggaaagaagaatctgcttttatgtttctctgccttcttggcatttgtagtatgtctttgacaagtacaactaatctgcctttctggacttcttgcctgatttagtttggggtaaattgcaatactccggatgttcagagacaataagagaatttactcgaattgtcaatcagataacgtttggtagcgatcactatacttttagtacttgttgttaaacttcgttgaaggttctactcttttaggtctctctgcttatgaagttgccaatgatcatgtcctcaatatgtaaaataagctaaaataagttacttttcctgtagttgtggagtcaaaggatggaaccatctcagttgcttctgcatttgctggtcaccatgaaggtaagagtaaaataatgcttctgcattagtcttctcagtttgatctgcagcccagctttcactgtttgggtgatttggggcgcttttaaggtcttccagaagaactgcttagtgttaacttgagttttggaaaaatttacagctgtgcaagatagagaccacaaattcttgacaaaagcagttgaagaagcgtaccggggagttgactgcggtgatggaggcccctttggagcagtcgttgtccgtaatgatgaagtagtagtcagctgccataacatggttctgaagcatactgatccaactgcacatgctgaagtgactgcaataagagaggtgaaatgctttatttatctgtcactgctcgtaaatcatttgttcatgagaatatgtgtatccgtttgggccttttgcgtgttaaacttcgaattgtttaccacaccattttcggatagctactcacattgtcgttctgttaaattttcaggcttgcaaaaagctcggaaaaatcgagctctcagattgtgaaatttacgcgtcttgtgagccatgcccaatgtgctttggtgcagttcatctctcccggatcaaggtctgcacccgtcaattttcctacgcataacctcatcacaaatatctgacgattttatttaacacaactgctaattcttcactacagaggctggtgtatggagccaaggcagaagctgccattgccattggatttgatgacttcattgcagatgctctgagaggcactgggttttaccagaaggccaacatggagatcaagaaggctgatggcaatggagccctgattgcagagcaagtctttgagaagaccaaggagaagtttcagatgtactaatgtgcaggatagagtctcagatacgccaaagtccccctgatgatctagggaggaataaaactacaatgttcagcttttccattatttctcaaactgccaattcaaatgtattttcatcctgataacatttcaattgtctgcatgttaatatcattcaatgaatgggtacctacagaaacaattgcaaaacagagtttgcatgtctatttactcttaaaccatgaaaacgacagatgatggatgctaattaaacatgttgattgaaagcaacgggttactctacattatagctaaaataatatggaaatgactcaagacttgggtggtggcatcagatttgtaaaatccttcttctggtactgaaagaacagaatactcaactataaattgtttctgaaactatcaactcaaaggtgtatttacattctgatgacactcaatatctgcgaattctgttatgtgctcttgcatgaatgttcagtttatacaataaactttctaattaattttccatagatcaacttgctaaaggttagaagtccttgttttcaggttgtcagtaatggttccattgcactggtgcctaaataattctcaattaatcaatttacatcaatgatgtacactaggaatataacactctcagaaaatgtccatactattttgagttttatttgtgtactccatcttttgttgatttcttgattgatatgtagcagactatcagtgtaccaccttctcaggtactcattccatcccaaaatagtttttaaactttgtctcaaaataaaccaatttctaccttcttatctaacttcagcttgcaagtttagaaattgtatcccttcaatacccctcacctaccaaccaaccaacattaattctatattaataagggatatttttgtcttttgactttctccacattggacaagggtagaagttactgtgcatcaacagaaattgtcacattgttactctaatagaaagtggtaactgtatcttttacactcctttgaagttataaacatgggttgcttttatttagagtaagaatccaaacaatacaggacattgaaataataacatcacaccaacagttatctccacaaagctctatacacacgactacacaaggcaagccttaaggcaaaattggaagtcttcaacaatcacttgcaccaaaaataaaaatctacaaggacatagttgatgattggggcgtctaactgtatagagaaatgaacttgaggaaaggattttgtaaccgggtagcgcccgacttatatggctgctgtgctgctggcactgggtagctattaccatcatagcatacttggcctggcccagggctgggcctaagttgctcacatatctcaggagctacagaatttgagaacccttcgatgagcgaacaattccaaggatcagcagatttgctactgagggacacatttgataagcaaatgttgctaaagatatccccctggatgcccagcaacattcctgcagtaccaatgtttacccccaccacattttttatcgttatgttgctaatgactggaagcgcattcttgtcatagttgtcgtcaggatgttccccatagtttccagtgatcctgatggctattgagacattgtccatgctcacatcagctatgtatatgtttttcacatacccaccgcgccctggggcagtcttgattctgattccatgcaccgagttgatgaaacgaaggccctcagctcgaacgtctgatataccacctgacatctcgcttccaaaggctattcctgcgctgttccttgtctgtccagtgatgttgcggatgctaatgttggagctaggatgggcaaaagagataccatactcgtcccaaccgctcttgatgacgacaatgtcatcgccgtttctgatgtagcaatcttcgatgcacacatttgaggatgagtctggatggcattgaagttgcattagcatcagctattgaaatctgctaaatgaatgcaaacatacaaaacaaggggaaaaaaaaggggaaaccaggtatcagagcaaggactactctaaaaattatgcattaaagtggtcgctttatctaggggtgcatggtacattcgaaaaaactgaatcgaagctacatttgaggcaaatatctcaggaagatgaactggtatgctccatgctttgaactgttattccatcgtatatctgtccacagttagtttgtgtttactaaggtaatgagaagttctgtacattgtatcggacagtaactatattgaatcatggttaactgcaagttaattgaaattacatgaaaaatattatagaaacattcagaattttggtcatattaactcaaataaagcaagcacacctggatcaatgccatcagtgtttggtgaactgataggtgctaggatcgtcagatgctggacaagaacttggctgattattttgaaaaaaaataatcaagataagaaataggtgcaaccacaacagctggcactgttaataatgaagcagagatgtagacaaaccaacctgcagtatacaggatgaatattccaaaatggtgcattcatgaaggttaaattggaaataacaaccctgtcagagtacatcagttcaagaagagggggcctggtataatttagtgtgtgattgtgaaaccagttccaccaaagttcaccttggccatcaatggtgccattagcacctgcaagagcacagcaatatgaaatgcatcattacaatttacaagtaggctaataaatacaagagcacacatgatataaatatgatacttactaaccagttattattacatcagtaagattggatccaaaaataagactctggtgtcttttaccagggagttctctgccacgcccataagatggcagaggatcaataactggccagtcagatgaatcctgcaaaagaattcttatgacgatcgcgattgtaatacttcttgcactgtttgttctagtgtaaagtattttcatgttggaacatgagaaacagttactgtaagttccaataatttgttttcaggaaagaatgttatgaaatataaaacatttcacgttattctgcaattttgttagaatgcgatttatgtaaagcagtataaagttgaatgcactagttttgttaaatttcataagacaataataaataaatcacttctgtgaaatgaatcaaataatgcataaagttatcttacttgagatccgattattactgcatcggcgtcaagtgacacagtgagatgactgataagattaaaactcccagtcaaccaccttccagcaggcacaaagagctctgccccacccttatctgcaaatgagctgaggtaaaagattgcattcttaaacgctttcgtgttaagagtaacaccatcattaacagcaccaaactcagtaattgacacactgtgtggccgatgcacgcttgctgtcaagtcgttgcagtacatggcagatgaagtggcccattgagtcgcagcaaaaacagttgcaaaaaccaaaaggacttgaagtgcctacaacaaattccagaagatgaacgtcaaaaaatgttgttcatgagctgaatctgaatagtgcatttttaaggaaatacaaagcaaatgaaacatagttcaaacacagagtaaacactatttgggggggggggggtgaacttgtttagtttgccacaaagattaattcaagttatccatcagtctttgtccttacaatgggttggataaaatgtcagcatcaactgactttgatttccgtagtgttgccaatgctgacttctaagttctaacaaggccacgccgccttctgcaatgtcggaatccatggtataggggaaggaatcacaggtaaaagcaaagcatggagctcctccactaggagcaaaggtctcacacatcatcctcggagaattttcccaaaagaaaagtggccaaatgggaattataaaagtcccacttgaatccccatgcaagaagacagatgtctccatcaaaaaaagacaaagacagcagcagtgcacttatcccgtgatgcacccattaggctgtccatcacagtgcccgatcttaaaagaactgaattctaagcgaactgccaaattctacccaaataattcttggatcagttgattcctatccaaatctatagctcaattctaccaccacattagagttcttggccaaggcaggacatgctactacaaggtaatcaatcagagcaaccgaaacgggacccaaaacaagaaatcgtccacttacagatgcggatcggctcatcattttctctagcagcgagtgaagaaactgtcaagtcagttcttcctccctcaaatcgactcaccagcaggcaccacaccagaacaacagccaagatcgacgacctgcaaccagccgccaccaccactaaccagggtcaccatggacggaaatcaagaacgaggagcgaccaaccaacaagaacacagcacacaaaacaaaacaaaaaaaaaaaacgcaaacaagaagccatactctctacttctccgggctcgccttctcgggccgcgaacgcagcggcgtcgacggcgacggctatgccgatggcttcactcaacacactcactccccatcaccttctccggctccaagcggcagcaaagagaagagtaggactggaccaagctacagtcacgaggtttattcactttattgggaggtgtgcagaggctgctggctcatcgattgttctggtcggaggtcggatagggggaacctggtgctgctgctgcccgatggaatggaatattggacggacggaacaccggttcttgacttggaatattgggtccgtcaaagtctcattggttgccaaaacgttttaccagggaataaaattaatttttaggtaattttttttatattcttcatagtgacttaaaagccaacactaaaaagaaattgcattaaaaatatcttaaatacaacttcaagtccgtaaatttaaattttagtattttactttggcttattagatcaaccgatgagacttttaagcgtgtgtttgatttaagggatatgatagaataggtttaatttaaaagagaatgactaacataagttaccatctttcttaaaaattgttgggtcaatctaaccgatcttttttttttcatttttttcagtgactagcgaaatgtccgtgcttcgctacggataaattatttcttagactaagtattgattagaaattttaatgataattaggatggataaaaccaccattacatattgatatactcatgttctcataatactcaagatgggcatggatggtctgatgatcaaacggcgatgaggactgtggtaggatgcatatcacaattggactcatctattgatggtggacactggcaactaagaaaatcagaacagcagaaacgcgactcacaatattgttccgctagatagagagagaaatgacaatggcgacatccgggtctgatttgagttgctcatttttttcggttcgatctggtttttcttctaataatacacatggtttttgctgagttttttttgcccgatctgattttttaataatacacatggttttttccgggtcgcttattttattattttatttttaaataataaaatagcatatattttattttattttttctagaaaaaagtccgtgtgttgctacgggtgactattttaatcttattttgctacgatccaggtcgccgagttttttccggctgatctggtagtttttgtccgggtcgctagtttacggttttttttgttcgatctaggcttttggttgggttgccagttggttgttttttccggtccaatttagttttatacgtgtattttatttttaaataataaaatagcatatattttattttattttttctaaaaaaagttagtgtgttgctacgggtgaagactattttaatcttattctgctacggtccaggtcgccgagttttttccggcccgatctggtagtttttgttcgggtcgctagtggacagtcttttttgttcgatctgggcttttggttgtgttgccggttggttgttttttctggtccaatttagttttatacgtgcctaacctagatgacggatgaaaattaagataagtacggaatcatcttcaatttttataatagataaagatgaaaattagttaactctatttgagattcaatcctttcgtgtgcacgaagaaaaaaactaatcggaaacagccgtggaaaagaactgggcccacaaaaaaccgcaacaaaataaaatcgtgacccactcagaaaaaatcggacttaaaaaccgggcccaaataaaaaccgcatgcggagaaaaaaccacgtcggaaaaccgaaaaaaaaccgcgttgcggaagtaaaaaacgtcggacaaaatttttttaaaaacagtaacaaaataaagtcgtgacccactcagaaaaaatgggacttaaaaaccgggcccaaataaaaaccgcatgcggagaaaaatcccacggaaaaccgaaaaaaaactgcgttgcggaagtaaaaaatgacggacaaaagttttttacggaatcattacttatattttaattagattttaattaggtatagatatagatatacggaccatatcgttcaattaaaaaatatttattcatctcatccctatatgtgcaaatagatggttggaatcataacattttagaaagaaagggataagtcttaagccatctatctcattgtcaaaccaaacacaaatacttaagttgcatcgtattgagagaaaattcgatgcacaacacagaaaaaaagcttgtaccataaatagtatatttttttcccttttataagaagcatatgtcatttgtttttcttcgattcgtagcactcccatcacatttgccgtaggtgcccttctacaattccatctttctgttgggctaaattccctccacatggacctttgttcttagcccatttgcagtccaaaaagtctaacaattgtgagccattgattcatgtcttgatcaatggttgagattacctcatcctttagtggtgggaagaaaaaccctagcctttattggagggagagtgagaagtagctttgaggtgaaataacaacctagcaaacacaagagagggagaggagagtagagaagaagaagggcagcttgttcagcttaggggctcttacctgatcttcatcaagtcagcgattggaggatcaaacatggttggattggcactaaacttggtgagtttgttcctcactttgagcacttcaatctagacagtttggatgaggattggttgagtagagcaccagatttgggtggtggtttgtcagctcgagttactgcggttacagattgtgcagcagttagtaaagtgtcagtttgaggggtcaaacagtgtccgatttggttgttttttggatagcctagaagggactcatagaccatcacttctgccatgtttcgtgcaatttgcatttgtggtttgggagatctcagctaagaaccgaagaggacaaaatctgccatttctctgcttgttgttatgcctcttgttagttgctatagttgatgttgatgatgccaagtttgtaacttgatgttatagttgctgttgtcatgtgcctctagatgttctaaagaagaatccatttgtacccattgttgattagtgcggaagcttggagtggaccgttggtcccgtggttttttactcctcacaccgaggaggtttttctatgtaaatcaccgtgtcttgtgtgcgtgtgtttattgttgttccgctgttgatttgatagttgaaactatcctcaaagttcatggcaagataaggggttgattgtgttgtggaaattataagcacgtaatgatttaatttgttccataaataaatcatgacattgcagatgtaaactagcatgaacgcatcattagatctacatatgtaaactaagcagtaaaacacgaacagatcaaatatgtgcaacatgttgaacacgtaccaaggttgcggaaagaccggttgcttagcaggaaccactcgcggttgcgggcgtcgacgaaggcacgcagcacgcgagtggagaggaaggcgagccgtcgtggatgaacagggagcagtcgcgcgaagcgcttcccaaaaaccttattgccgccttgtcccggtgtaggacgtcgaaggtagaggttccggagacctgctctcccgatcaccggtacacgccagcgagcgagatggagtagtctacgagcggtggcgtagcacagagtaggaggcaaaccctaaattgatttcgtgtgtgttgcgtgaaggcggcggctcagtttatatagagataggtcgcttgatcaaggcgcctgcacgatctccactccgcgtaaccgaaccggataaatctatccggactccacgccgttttcacgcaccggttttttcggaatgtttccaaaacaaaacaaatccaaattttcccgtagcaaaacaaaactgcaaaaggaggctgcatctgcgcaagggtgaggtgttggtatttcttacgatcacagatagaatccgcaagcgcacggatataccgatgtagcacttcccttatggagtattccaagggtatcgaatcaagggaacgtgtgtgattatctcctcgttaggttcatccaagggcacaaagctaatgtgggcagagggcagagaggatttcctaatgagaaacagtgtctaaggaaagcttaactttaatcctaatgcaatacttcaggcactggtaacccgctgttcctagatgtcgctctactacgtacccggacaaggaggacttaagtgctcttgagggttgtcaccacctctacacccacctcaaacgtactgtgggatacgcagcaaccactgaagattaattacccagacatcgcgtctatgcaattaataactactctagtgccgatcaaacactaaagcaatcactataaataaatggactatagtgaacaatgatcccgtatgctaattaggaactaaccaagaagtaattctcactaagcaaatcttaattactcaaaatgatatttctattaaagcagagtaatta

SEQ ID NO: 4810 - DNA, 28834 bp, Oryza sativa
ggctttggtggagaacccctcagcccaaatgtacttgcaattggcccatttgaatgtgcttcattatgtttgtgggtccaaaactccataggtttgaatatggaagtttaattcacttcctcctctatgtatcttttgtctcaactttggtggttattgatggcgttaatttggtatttaacagccgtcaacaaagaggaaccaattttgtggaccattcgacgcgtacgtcgtgcacgtgcgctgcctgcctccgaggcgaggcgagcgagcgtgcgcgtgtgttccccctcttctctccaccacacatgcttcaagtggctaggagggcatcctcccttttaaggaggtccccctctcctagaataagcaaggtgctactaaactccccatgcatgccatcccatgaggtgggcttttgtgattttccaaagaattaatctttgagtgggctaaggcccatctattaattccaacatgtgtaaaatatgtttaccggttggtgaattgtagtttgcacattaaaagtgtttggttcagccccaaaactttcccctttccttcagttcttcccattgatcttgtgcagcacgtcgatgtgtagccatggtgcagcatggctgccgaagctacagacaatgcggcggtgcggcgcgacagccggctctgcggtcagcccaatagttacagcgcatggtgtggatgcacatggcacagtgcccaagactgcagcagacgcttcagctagcgtgtgtagcacggtgggacattcaatgtggcggctcgccatgggggtcttgtagcttctcggtagcttgtggcatgcagcctcatcagccattacttctattggccacacatcatccttctccgccctcgctgccaaggcatcggccaccacacccacacccactcgccatcgccgttcatcgggatcgagtcgaatcaaatagccgaggagcccaatttcatgtttggttagaataaagggcaaatttgtcttattaagcctctaatcatggctaaacaattgaactctgatgaaaaatttgatgggagtgctacgaatctagaaaaaaaaaacaagtggcatgtgcttctgatcaaaatgtaaaaatgttgtacaatttttggtagtattttcctgtgttatagatcgaaatttctcgtgtgtggattaccacgctcaagttcgttctactattgtgccaaccctttttgcgaggtacattaatttaatgagagataataaaaatgttaaaagatatacatcaataaaaaaattgtacaatattagtccctcaattttataatataaggcaaaagttgtttcataatatatggcatacatgcatgtatgccattaactaacacctcttctccactaaaatattattatttaaattctccactatcaagatctctaattttattagatgcatacattacatttattaggttaatccaaactatgtgatgataataattatttcttgatctttgggttaagagtggttatgccttatattttttaacggaggaagtacatgttgtcagggttacgggttaggcataccctttacccttcgatatacgttacatatcgatatgacatacccacgcgcatgcggatatttcctgtatattctaaggaaacctttcacggaatctacagaagggaagaatcctactcgggcagaactgggtcattggcgtatcgtatggggtctgatacctccgagtcctacgtggagacctctcgatctacaatataaaagggacctcccggggagggtttaggacatcgaatctcagagccaacacaacctacacagcctatgaagccggagcctacgaggagccaagtcgtcgagggctagtcgaaacaactcgactacaatctcgccagatccgacaagttcccttgttccctttgtaacctgtgttttctaccgtataatcccacatcaactggattagggttattacctatcaaggggcctgaaccagtataattcttgtcttttgtttgcttgatgtcatactacgtagatccttgtaccaacgtaccccaataccctctatatccggtctacgggtatcacccgtcgacagtggcgcgccaggtagggggccttggtactcaaggttctactactatgtcatccagtttcgtcgacaacaacgtcagcaccagcctcagccaagtactccctgcttcaacaatgctggtatggactcaagtcggcgaaatcgtcttcccggtttacaccacgacgccgatctcaaccggtcctccaatgaccggagacgagaacgcagtggctacgaaccaaggcgattccatgtcgaaaaatcctcccgtcgagacggagaacggaatatcgacgacatccaatctcgagaaggattctgatacggccaaaccttgtccttccgacatgaaccacgagttgacaaagataacttccgaagccacaaggtcttggtgtcctatccacaaaactaagaaacacactctgcaagattgctgggttttcctcaacgtctgtgctgaaattcgcgcctgcaaagaacgtggaattcagcgtacttctccaactcgggatgtctattgtcctattcacaagacaaagaatcacgacctctcgagctgcaaagtctttctcggcgccatgaaagctccgtctcctaagtcatatgtccccatcagggataacggcgaggaacaaggagcaactccaacttcagatcgattcgttggggtaatcgatatcgatcctcacgaaccatcggtcttacatctcctcgaggactatgggtcatcgacaacgagcgcgccgcgggaggtattggctatcgatgacgttggcacgtcagctgtcacgtcctgataaattcattccgaaataaaaatcattccctaaaaggaataatagaattaattaaaattcgaaaagaaattggcaaacactaaaatacgtacaagaaaaaaattcgaatgtggcccagagaatttttgttaaattctccttggtctaaaatgagccctcaaattttacttgaattttcagagcaccggaaatatttattaagcaacaaaaacaattatcaaagtttaataaaaagaaaacctaaaaataatcctcttttctcctttgggccaagcccagccaaagtctccctctcctccctctctttccctcctctcccgggcctctcctcctcctcccggcccacctcttccctccctctcccggcccagctccctcccctcccctctctctcccgggcctgcctctccctcctctcctcctgggccgcctccgggcccaagctgagcggcgccctcccgcccgtgccgcgcacgtgcgtgcgctgaccgcgcgcccgcgtggggcccacgtgccaggtcgtcgtcctcctcctgcccggcctcctcctctctcctccgtgaaccctagccatttcctccctcaaatccgcttgattcatttggctaattccaaaattgattaggggttttaatccccattgattcctcttcaattcccccttgattcgtgcccccaatcgtcgggaacagacgcgtcttccccggccgctttccatggccgccggccgccatttccaccgccgttccccgctcctcccgtgctcggctcgcttccctccgctataaaacggaatcccctcgctccgttctatcgttttagccccctcccgcgatctcctgtggtccctagccacctccccgccgtcgtcccctctctcccatgccgccggccgtcttcagccgcccctgccgccgcgttagcacgccggccggctgtgccgtcgcctcctctagcatcgcagccacctactcttcgccggcctgccctctgtttcccgcgaagacctccggaagtgcatccccgccggcaacagtggcgttgccgccactgttccgcctccggccgcctctgccgcgtcccctgtgcgccggccaacgtcgccaccacctctcccggcaccggaactccatcctcttccccggccaagccacggcatcgcccgtatttcgccggaacgccgtcgcgcgcgccgcctctccctcggtcttgtcggcacccactccggcagcccctttcgccgtgccagtgcgccggccgacgtcgccgtctccacctccggcatcgcagcggcaaggtcgccctcggcctcgcctccccttcgaccgaacccctccgcggtccatcgttgtcgtctccgttcgttctcgtcgtcgacgtcccgtcggtcgcccggctcgtcgtctcgcggcgccgcctccgtcgtcggcatcgcagcggcgtgttccacgccatccttgtctttatgcagccgttgtaggctgcccacgtcgcctcctcgccggccccggtcgtcgtcgtcgtcgccctctcgtcgttcccggtcgtcgtggcgttcgtccctccgtcaagccgttctcgttcatcgtcctcgcttcgtcaagtgccgcagccccttcatcgtcttcgtcctcgcctccgcgtcgtcaagcctcgtgccggccgtgtcttgccttcgttcaaggatcgccgccgaagtcgttccctcgccgtccgtctctgccgcgcccgttcgtcgttgtcgttccgacgcctcgtcgcgtggcggtaaggatctctcctctcgctgccccgtcctcatcctttcggtgtcgccccgtacccgttgtgcggttgtcgaccccgatacccgtgtaccggtgtcggtagtcgttcacgtgtgcgggtggtgaccgtgtagtgtccatgttagtgtgcccgctcggtagccgcgtggtttccacgtgtgcagcccgtgtggtgtctagtggagtccgtttgtcggccactcgcctcggttgacacacggggtccgcttccgtcgacccgtggaccatctctgtgtactcggtctaccgcggtcctttaggttgacatgtggggtccgcatgtcaacagcgcagccttcctgtcttttccaggcttgcgcttccacatgttttatagttgcaaagtttaattataataatccgcaaatctccatataacagcattaaacttcggatgatcatatcttggtcatacgagctccgaatcgacccgttcaagtctcttaatgtttgttataacctaaagaaccgtgtgctttctttttatgtattgttattgcttctttataggcttgtagctttgcttgtgtgcttcgcgtagcttctgtcgttccggaggttcccgaagcgtggttcgcggccgtcgccgaaggttcggaaggccgttctctctgagcaaggcaagtcacatcatccttgaacatattgaatcccaatttataaaattattctgatttaaattattgcattatcgctttatttaaattcacgcgttatcactgttttatctagccatgcctatttacctttgttatgaccttattattggtgttattgttattattaccttgttcaccctaggataaacaaaaccccaactagtgggtactctattcatgggtccactagtatgaatttaggtagatgcttcgctgattaattaggcaatattaggtggttttataactttagactttgggaattctcatatcatttggacactatggaatagttggcttatgttggaattggacacacacctccccctctattcaaaacccacaaaatagttttaggctgggctcgaggtgcgtggttgggtttggttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggctcggtagtcgagatgtcatggcacagggctggtgtcctgctgctaggggctcaatcctgcctgcctatcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagatgtacccctcggttatgggcaagcctagcaatgcacccaagttagtgttttaattcttaaaatttgcttaacaactaaaatgtggaatggttggcctgggttggcttaggacgagctaggacctagggtcgggttgccagttcagtctgaatcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattcttaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatggagccgtaggcccgctagtccgctgctgttaaattttgattgtcaggccttaagtgcctttgtaataatgtaaatattatcgatataataaagatgtgccttttgtatcatgtttgtttggtgtaccccggcttttcctgggacggggattaatacactagcgttcgggaaaatgtatttttctcggtcgcgacatcagcgcacgccaatgcagaagcagggaatcaatcgactactccagcccagcacatcagggccgttcaagcgatactgagggaaactccttacgatcccgttttgaacattgacctcgagcgttggacagaacgactacgggaatcggtgactaacctcagcaacgcgtttgaagaagccgctaccgcagcacaccatggtgccccatacacaagacggacagacattctccagaagattggcttgttttcaaaaagttgctcgagaagcacatggcatttgaaaaaggcaagcgagtacgcgttgttgagacgaacgaagagacggctcctcacgaaccggactcaacgtatccagactctgacctccacgtctcacacatcttcggcggttccacaacgtactcctccaagcgagaatacaagaaagtggaacgtgaagtctgctcgacatggcagggggctgcgcccaagatgaagtggtctgagcagaagatagagttctcggaagaagaccaccccaagaccgccgttatcctaggacgatatccgattgtggtcgaacccactattcggaacatcaaggtagtgcgagttctcattgacggtggcagctcaatcaatcttcttttcgccagcacttttgacgcgatgggaattccgcaaaacgagttgacaccaactgatcaacccttccatggaattactccccaatcatcgtccagacctttgggcaagattattttgcccgtgactttcggccaagccaacaacttccgaacagaacagatcacctttgatgttgctgaattcgatacagcttacaatgccatcatcgggagaactgcacttgcgaagttcatggccgcatctcatgtcacgcccggaatttctatccaaaattccaaacgcttacatgtgtgtgaaccctcatccaggaatcagccgaggcacacaataacaaattgataatagagtgcaattattactctaattaataagcgaataaaatgtcattacagaggtagatagttcctctcaatcaataaatatgtaagcagcggaaaataaaataaacggcgcagacgactccactccacaggcagcttgaccagggctacgcctaatcctccacaccatcagcatcactgtagaactcttcctctgatgaatgattgcaaggtgagtatatgacatactcagcaagccacgcagcaaatatgcaagtgcacagggataccaaagaatggcataatatagggctcatttgcaaaagcagcatttagcaaacatttgagaattataaaacagttaagtaataattaaacaatattaaaccaacactatacaacatacccagttgcataggcccaaccattctgaacaaccatcccggctgcacagttctatctccaaaccaggaatataccattccaaaccaggagctaaataaattattaccagttatagcatcttctattatgatgagaagtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctatgacagtacccctcgcacaacacaatccaccacagtgcaccattcctggatcataatcacccccttataaacaaggcatggactccccagcgacccccgtgggcttatctccgccacttctcagtctggtgccccgcaacgaaccatgctatacaaaaggtaaagccgttgcccacgctggcttgtggttggcacgattaatgtttcacaaccgaaactcgtgaaccggtccttaattgtcatgagcacgactctcaaaaccatgtgctcacaacccaccattatcaagttttagttggcaaataattaattaaccaatcacgattgaccatcgtgaactataattaagccatcattaaataatagtgagtcataagttatcccactagtgtgctaatgtttctaagcatggctaagcagtcatatctaatatccagctgaaccaatatatataaagctcaactagtcaagttatattaacctaaggtatcaaggaataaagtaatcaagaacaaaagggctttaacaaacaataggttaattccacccaatgacattcgaaaataaatgcaatagttgaatataaacaatagctttaaacgggatcaacatgctcaaagggttgtttgggatctgtgtgacttgccttgctggccttggaactattcaaattcttctcctgcgaaaacggactctccggaaacgtcggaatctaaaccgaaaagagcaaaaacaccaaaaaagcacataacaaagcatgaacagtacatgtggatatttttaacatgtagatctcaattttagaaaaatttagaaacttgaaccaactaaatccgagctaagatgaattagttatgaatttttaaagattaaatcggattaaaacacttatatggattttaatggaattatgacgcaataaggaattatttttgaaaaggaaaagaggtttattgtgtcagcgggctcgagttcacggtggacggggcgcacggcagcggttcacgggaacgaacggccgagatcgatccatccaaaacggacggccgagatcgatcgggtctacggcggctcacggcagacggccacgatgacgtcagcggtgacgtcaccaccggcggcggctcgggcggcgcaagcttgccggcgaacgacggcgcgacgacgtgaacggagggctccaggacgatgcgggcatcgcggcgaactcaccggtgaccaaagcaacggcggaagatcaacggacggcgacggcgacggcgacgaggaagaagcggcggcgacctacagcgacggcggcggtgctccggcggtctacagcgacggcgaaggggcggacgaggacggcggcgacttggcgaccacgatggtgaccttcccgagcgacgacgacgaccggaacggcggcggcgcacggctgaaacggcggcgacgacggcggcgcgaggttacacggcgctagggctcttccgacggcgagagacgaaggcaagggtggcggcgggtagagaagacactggggatccttttataggggcaagaaggcagcggcgaaggcccacggcgaccggcggcgagaaggaaagtttagggttcggaggagagagatcgatccgaatcgaactcgaatccaacactttccaagcgattttagctggggattccaaaagagaaaaggtagaggagatctcgggaaacatttcccctctattgatttcaccggaaacggaaaggatcgaccgaatttggaaggagacggcggcggctcggcgctagggtttcgggcggcagcggccggaggtagacgacgaccccgacaggcgggccccacctgtcagcgacgggaacgcgcgcgcggctgcgacggactgggccgacttgggccggggagagagagaaggttttgggccgactttcggcccaaagccaaaagaagacatttaaaaaccttttcaatttaaattattcatgaaatgcaattccatttattaaaaatactcccttagctcaaataaatcccagaaaaatctaggaattatagaattaagcaaagtatttaatgaaattttatctggccccattttatgttggaatttattaattaaaattagatcttctcttctaggctttttaaaataaattctaataattccatttaaacaacaatttatatatttaggatttttagggtgtgacatctcactacgcatatcaagtgcttaagatgccggaccgaagggaacaatcaccattcaggggaacacaaagctggcggtgcaatgcaacaagcggagcctcgacatggtcgagcaaacgcccagcccacccgccacgactgagccacccaagaaagtgaccaagacaaacaagacgccgaaaccagacggtgccatcaagattgttccactctccagtgccaaccccgacaagaccgtcaagatcggggcgacactaaacgagaaataggaactcgcgctcattaccttcctccgcgacaatgccgacgtgttcgcttggcagccgtccgacatgccgggggtccccagggaggtgattgagcacaaactcatggtgcgacccgatgctaagccagtaaaacaaagactgcggagatttgcaccagaccgaaaacaagccatacgagaagagctcgacaaacttctcaaagctggcttcatcagagaagtacttcatccaaagtggctagctaatccagtcatggtgcggaagggcaacggaaaatggagaatgtgtgtcaacttcaccgacctcaacaaggcgtgccccaaggatcactttccactccctcgaatagaccaactggtggattcaacagccggttgtgagctattaagcttcctcgacgcttactctggctaccaccaaatcagcatagcaaaagaggacgaagagaagacagcattcatcacgccgtttggggtattttgctatgttaagatgccgttcggactgataacagctgggaatactttccagtgcacggtccagggcgtacttagcaaccagcttggcaacaatgtcgaggcttacgtcgacgacatcgttgtcaaaaccaagacaggcgactcattgattgacgatctgcgggaaacgttcgacaacctccaacgatatcgcctcatgctcaatcctgagaagtgcacgttcggagtaccatcgggcaagctgctcagattccttgtctctggcagaggaatagaagcaaaccccgagaagatcaaggcaatcgagaacatgaagtcgcctacaagactcaaggaggtacaaaagctaaccggatgcatggcagcactaagcagattcgtcgctaggatgggagaacgaggacaacctttcttcgctctgttgaagaaacaagacaaatttgtatggacacaggaagccgaggaggcattcattgcactcaagcgctacctatctaacccccctgtacttgttgctccccaacctaatgaagaattattcctctatattgctgccacgccatattccgttagcactgtcattgttgtcgagagagagaaagtacagcgaccagcttattacgttagcgaagctctccacgacgcaaagacaagatacccacagatccaaaagctgctttacgcagtcatcatgacatcaaggaagctacgccactactttcaagcccatagagtcacagttgtctcctctttccctcttggcgaagttgtgagaaacaaagacattgtcggccgcattgcgaaatgggtagtcgagctgagccagtttgatgtccactttgtgccacgaacagccatcaagtcctaggtactcgctgacttcgttgccgattggactatgccagataacaaatcagacaaccaaggcgacaatgaaacatggacaatgtcgttcgatggcgcactcaacagccaaggagcaggggcaggatttatcttgacgtctccctccggagatcaattcaagcacgcaatccacctcaacttcagggcgaccaataacactgcagaatacgaaggactactcgccgggatacgagctgcagctacacttgaggccaagggactaatcgtcaaaggggactccgagctagtcgcgaaccaggagcacaaagattataaatgctctaactccgagttatccaagtatctcgcagaagtcaggaagctagagaaaaggttcgatgggatcaaggtccgacacgtctaccgcaaggacaacgtcgagccagacgacctagcacgacgtgcgtccagatgagaatcgctcgagcccggcacttttctcgacatcctgacgaagccatcggtgaaagaggttagcggcgaagtcagcccgaacacccccgacattatctcggaggtcaccgaggcagaacgcgccgttgccgacatcgaaacgacagacgactggcgcattccactaatcaaattcatcagcaacgaggagttgcccgaggacgatacagaggccgagaaaataacccgtaaatcaaagatctactgtatggtcggcaacaatctatacaagaaagcgccaaacggggtacttctcaaatgcgtatcgaccgatgacggcagacaccttcttcttgacatacatgaaggcatatgtgggtcacacgccgctggtcggacattggtcggcaaagctttttgacaagggtttttttggccaaccggccttaaagatgcatgcgacatggtccagcgatgtgaagcctgtcaattccacagtaaacacacaaagctacccgcgcaggcgctccagactatccctctgacttggccattcttgtgctgggggctagatttacttgggccattcccacaaggacaaggcggctacagattcctattcgtggcgatcgacaaattcaccaaatggatcgaagcagtacccacgggggaaatcaaggccgacaatgccatcaaattcatcaaagggatattttgcacgtacggactaccacaccgcatcataactgataacggctcccagttcatcagcgccgatttctagaactactgcatcgggctgggggtcaaaatatgcttcgcctcggtctctcaccctcaaagcaacggacaagtcgagagggcaaacggcatagtactacaagggatgaaaacccgcgtctacgacaggctcatgtcacacgacaaaaagtgggttgaagaactcccatcagtactatgggccgtacgcaccacaccgacaacgtctaataaggaaacacccttcttcttcgtgtacggctctgaggccatgctcccaggcgagctacaacatcagagtacatgagtacagaagtactccaacgagaaccaggatgagcagcgagatatcgatgtaaatcttctcgaggagcatcgggaacgagttgccgtccgagcaaccaactatcaacagaccctccgccgttatcacgagaagcgcatccgtgcacgcatactttcgatcggcgactatgtcctccgacgagttcaaagccaagcagggcgaaacaaactctcacctaaatgggaaggaccttacacgatcacacaagtcttgcggccaggcgcattcaaaatcacagacggcaacagtcgcgaattagcaaattcttggaacattgaccaactacgtaaattctatgtatgagtcaataccatccatacctataagcacccttacagtatcaataaagcctatttctaggcccatatcacaatcaacgtgtttcgcccgatgatccctcactctgatgacacctagcgttgcaacctgtccttatgtccctttacaccgtctcgacaaggcctccgaggaacctaagggatcttcggctagggacgcccagagccgataaggccttgtcagatcctgtagagacgaaagaccatgtaagatctggtcatgtaagagttctcgccgtgcgtattaaccaagccgtgaaatcggaaatcaactttccaacttcatggctgggggctaggatcagagcttattcaaccaaggcaggtcaaaggtccaagagccttatcctccgagaaaattcctccgatgacaaggctgggggctagggagagtgtacgactcaaacggctgactaaagtcgttaactgagaacgcactcttacacatgacatccagagtaagagacatttgtcaaagatagatttctttattcacaaaatactccttacagttttttcacaaatctttcgctacattacatcttttcctaagatatttgtcacagggtacgagtactaccaagaaggccaacgccagtccatagactagaagatcttctcggccaacgacgacattgactttgccagatggtctatctccgccggagtcctccgagaacgagcaaaaccctcacgaagatattcaaggtccaggcgcgggtgatgatctcgtaggcaagccaacacgtgccccccggcatatcggctcgatcgacgacactcctgcttcaaggcctcgtcgatacgtttgccgattccatcgagttgggcacaggccccattaagccacgagatgtacccggccgccaactcctcgggatctccgcggactactcgaagctccctgcatactctggccatggatgtgcagcaactcttcaagtacgagttaaaccacacctcacgacctcggagcgtttccacagcctgctctttcttcacggccagcatggttttctcgagctccgccacttcaaacttcgtcttccagtattggatatgacgatcttggctagcaagggcaccctcgagatctgctaaacgtgataaccactaagtcaagctatacatctctgtcgggaacatggctgacctagtcaggagggcattaaggggtgaagggactactaacctgaggaagtcgtcgccatccttccctctatatcaaggggttgatccacatggtcaggcgagacgtgtggttcaaactcgagtaccggaattactgccagtgactcgggctgcccgcgctgctggacatcctcgtcatcagtatctctacagaggacaaaagttcccgaggtcagcataccaaagtaagccgggatagtaatcgcacgcacgaaggcggtcagagttcgagttttacacattaaagggggagaacagactcccccagatcacctccttacgcatgtcgctggccgccccctggtccaagatctcgcgcagatcaagttcaggatgtgacagccttacacacgcgaggacatgacacgccccggtgtagatcccgtttgacgtctcctccgcaatcctggccgcatgcttggaggggatctcccccatcgccgtcgccagctccgcgagagaggaggttagcgaaaactcatcgggattcaccgggatcgtggacgtgacgccgcattccccagcgagctggtgaaggccagtgtaggtgaccctcaacgagccccggatctcggataggttgttcccgagttctgacattcggtcctcgagccccttccgttgtcgctcgttgccagccgccaactccctcatcttcataagctcttcacgggcttcagccaactcgcgcaccagtctgtcagcacgcgcgttcgccatcgccgcttccgacctcgcctccgcaagcaccagcttcgaggaggcgccctatctcgacttggagctcctcccaggagaggacagcagttggcagatcacgacctgccgcgcggtcgctgactggggcactgggcgtcgcctcccggctcccggctgcgggcacgacatccgtcgaggccacgacaggcgacgcactggaagcttctccggacttggctcgcgcagcctttgcccgcgcctccctacaggacgaccacgagtcagacaacaatcgaataagaagcgcggggattcaagaattcatctacttacttcttgccgatcgtcacaatgcgttgttgtcgtggacgtgggggagacgcgtccgaggcctgaaagataatcaacgcaaagtaaggaaaaatccttcatgctgcatgatttaacgacaaaataaattaccgagggggtcgacgccttgcgacgatgtctgcttacagacgagaatttcctcggctttgtcggaatattgccaccgctagtggtggcagcatcagacacctccttgacgaccttcacttttagagatgacgccacctgatggtccgcgagcggtccgatgatatcagtcaaaggaagggcctacgctcaatcaagtcaaaaagtgatttcgaaaggagaatgcgggatgcttatcgaatatacttacgttgatggcttcatcacgttccgccgcccccttttcacaaaggggcacagggatgtcactcgccgtggtcgggccactgatcatcacttggccgactcggcgctccacggtttcgccgctcagacctgttaatccagaaccaaccttcgataagtcaagaggaatgcgaacacaagcatgtcaagataaatgcgagaaagataccccgaggagaaacccgggtcgcgtcctctggcccggaatagttataagctggatgggcccgagcctgaagcggctggatccgcctaccaacgaagtatgcaacgacttcatatctcgacaaaccccgtgctcggaaatcgtcgatgatgtcgataaacgactgaagagagggggtcaaggggggctttgcggtccaagacggaatcttgtccggttgatcttcaggaaccacgaagacagggttcgagtccttgatctcaagataaaaccacctattccgccacttgctgcgagatgaagggcactggaagggaatgtaacgcgacttcaggccatcccgaagtcggaacccgacgcaaccagataccctgttggattccatccaacgcagttcgtagtaaaagcaaaaaagatcaagaaaaggctctaccccgatgtaggcctcgcaaagatgcacaaagatgctaaggaaggcgatggaattggggttcaaatggagaagagaaagaccattgaaattcaaaaccaggagaagaaattcggaaggtggagggagaaaaccgcagagaacataatcttcgatcgcaaccatgcgacccaagatgggctgaggattagtacatcctgcttccctctccatggttccacgaccaggaagagcgccatcctcctggggtttcttcaacgttgcactagtggaagccgattttccgaggtccattgctgatcgaaggtcgccggaaaacgagcctaggttgatgaactagggtttcttgcggcggcgaagaaggcaaagagtgcttgcaggtggtgtgtgtttaacaggtttggcggacttcaaaatggactcccaaaattccctttaaataggcgcactactgacggtgcgaattccagggaacagagagagatgcccgctgaaaatttctggtcccgttacgcgcggcggttttctggacttcagtttaaaattcgctcgtgaccgttgggcttcaaatggcgtgctcgactacggtctatctccgcggtcctcacaccgggaatgacaatagtctcgacacccgaagtcgcaaatggttgcacgagttcattttaagcagaagtcgggggctactgtcagggttacgggttaggcataccctttacccttcgatatacgttacatatcgatatggcatacccacgcgcatgcggatatttcctgtatattctaagaaaacctttcacggaatctacagacgggaagaatcctactcgggcagaactgggtcgttggcgtatcgtatagggtctgatacctccgagttctacgtgaagacctctagatctgcgatataaaagggaccccccgggagggtttaggacatcaaatctcagagccaacataacctacacagcctacgaagccggagcctacgaggagccaagtcgtcgagggctagtcgaaacaactcgactacaatctcgccggatccgacaagttcccttgttccctttgtaacctgtgttttctaccatataataccacatcaactggattagggttatttcctatcaaggggcctgaactagtataattcttgtcttttgtttgcttgatgtcgtactatgtagatccttgtaccaacgtaccccaataccctctatatccggtctacgggtatcacccgtcgacacatgtgagctcataaaatagcgattaaatttatcatgtttgtaggtggatatatatcataatatgggacagacggatggatacaactcttcccatatcctaacccatatttttttgcgaatttggatccgaactcggatagtaccagatatatcccattctctctcgcatattcttcctgggctgcgagcctcaagtcggtgtcgaaacattgcgaaccactgggtccagtaccagggggtaccgccccgggtggaccattcggtcaggatgatccgagcggtcgaacttgattgttgtctctgaccaccgaaggtattgaggcgtgccgggctggacgtcgttgatctccctgtcagtcagcttttgcttcctttttgactcataagcttgcggcccaccaaagatataattgagctctttgcgagaatcttgaaaaccagtcggaccgtcatcttcatcatccttcatctttgaggtgctctgatctccatctgtagccttctttgtttgctttgcgtattgctccgcaaactgcttgtagatgaaactatctttggctgcatggttagagtttggatgatgcgagcattaggcgttcatgatcttgtcgaaggtgttgatgcacgagcgctgtcaggaagatggcgatgcaagtgctacaaggtcttcaggcttacgcttgtgatccttatggttgttgcttccactccccccggtgactgccgtatctttcttggacttccaattgctacccggctgcttggaggcggtgacggcatcatcagctttggcatattcgttggctttttcgaacatttgcttgaccgtcctgggaggcttgcgtccaaattttctgactaagagttcgtgacggacacccttagtgaaagcggctatgatgacgttgtcggtgatgtcggagatcttgttacgttgcttagaaaaatgttggatataatcccaaagggattcactaggcttctggatcacattgtagaggtcgaagtgggtgtcgggacgtttgaaagtgccttgaaaattggcaatgaagtgctcacgaagctctgcccaagatccaattgtgccacggggtaacccatgaagctaggaccgagcagaatctgctagagctaccaacaagtagtttgccatagccttgttgtctcctccttctgcgcggattgcgaggccatagacggtgagccaagactcaagatttgttttgtcgtcatacttctcgattccagtcggcttgaagccagccggccaatccactcgacgcaggtcacttgtaaaagctgcaactccatcttcatcgtcaccgtagcggtctggtgatcggtgtgggacataacctctctctacacggcgtcgattgagtgtgtcgcgaagattgatgggctgcctgcgacatggagagcgaggctatttagcacggtgcactctgtgtctgtcggcaggcgagtgaacagaacgttcaacatgatctctgctcctgcgattagatcctgacgcggcaacgctgaggcttggttggtggtaatcttgagattgaagaggcggaacccgactgctagtcggcgtgcggacacttgctgagttaactgggaccgaggcggtgatcatgatcttcgtttggttaatgatgttgaggacgtggttgggcgcatcttcctgaagcaaagtatccagaagagtgattgtcgtgactgcgttctgctgtggggtgcgaaaaaccgtcgtctcctcaacgtcttactgtccaatgagttcacgtgctcatcacccggcttccagggtgcactgtcgttgatcctcagcctcctttgcggcccgctcgtgttcccgctgcaactggtctcgctcttgcgcttgtcgttcctccttcagtcggcgacgctcggcttcttgtcgtgtgcgctgttcttctgcttcacggagctgacgctgttctgcagtctcgttatcggccatgaaaacgccgaaaaagagaggcgtgtagttgtcttcataggcttcatcaaaatcgtcgaaatcgtcgaggttgctgaagtcgtagttgtagctgaagtcgtcatagtcgaggatctccattggccgtgagtcgacaccaggagagctgaggtagccgtccaattcttctattgaaaccgtcccgaggggccaacttccctgaagctagattggatcagggccgatgccagatcccgtctagacctacgggaagaagatgcccttgtggtgaaaacagcagccaaatcatcaggaagcttcattaggattgatggataggtcgcatcgccttgatctggtcgtgtcgaagtagatgagatctcatccgagtggcttgaggccgactcggacaagataatcttggggtagatctcggccgagttcgggagaccgaatggggcggagaccgcatctctttccgactggttcgaatctgagtcgaagagagagatcttgccaaagttatcggtgatgaactcgaggctgctgaatcggaacgcctgccctggagggaagacgaagtcgtcgattccggaaacgaatcccatcgcactaatcggcgaaaagcttgacgcaacccctacctggcgcaccaattgtcgaaacaagatttcggcaatacaaaaagggggtggctatcaagcaggaaaagtggatgggtttggagacaaggaattttatacaggttcaggccttctcaatgtgaagtaataccctactcctgtccggggattgattcgccgagtgtgttatagatagtatgatctgggagaaaagttatgccccaagaggcacccggacccctccttatatagtgggaggaatccgtattacaaggtacagcccatattcctaacggaataggcaaataaagataaaatacaatcgtaaccgactagaacctcatgtatttccttgatacacaagtaaggaatttaacccgagtcccttaaaggtattatatctgtatatggtacccctatacctagtcggatatacatgttgtgtgggtatgggtatccataatctccacagtcgagcacgtgcttgggaaatatccatctcactttcacccctagtgctaacgaaaaatttgaagttgaagaaaaacggggccttggtcatagaaaaatttagcccgacggttgtccaagatgatgtctctaacataaacactgaagtataaagtgggacatggctttgggccaagtgcacttcttgtgctagctgagccaacctagtcaagataaaagaagggaccgagagggtatacatgtgaaaggaataagtctattttacctccctcatctcttgctcgtaattgaaacgcttccttcaaacatcgatttgtacccatttcgaaaataagggagttgtagttgagggatgtgattgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagaatttcagtaattacccacatattaaattaatcattaaatggtctgtttttaatattgttaaatactttgggtgtccaagtatgttcaagatttttcttggaattatttgagcataggaagtatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctatttgcctccctcgacactgtttatcttctacctctagcagccgaactgagaccgatttggctcggtttttctcctccaaatctgacctttccccttgtgtttttctaaaattagttgaggggaaatattcctcttatcctcctctatctttatccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcatagcgccgccgccacgtgctccaccccgccgtcgtcgccggccgagctccatccgcgtcgcgccgccgcctccgtcgtcgtcgccggccgtcgtcgttcgtcgtttggttcgagggtgagtaccattgggttcgtctcgtcgtcctctacgtgttcttgtcctccaaagtcgcagccgaccatccaatctccggcgaggtcgccatcttggtccggccattgatgaggtcatcatcatgacgtcatcatcgttttttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttggttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattattttattcctggataccttgggttattataacttgactagttgggctttatatattggttcagctagatattagttatgattgcttagccatgcttagaaacattatcacataattgggataactaatgttacactatcacttatgattatatttaatggtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagtagtgttgtgcaaagggtattgtcacagcctctattcgggtactttccagtatcgcgacgcatggtagacatgatgatgaggctgtgtcttgtgggtacagtggtacacctctggccagagtaaaactattcgaatagccgtgcccgcggtcatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgtcatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgaaagtatgtaacactattattgatgattctgtatattaaattgtcagtttgtgtacctcggctgattcctggacgaggattttatgcataaataagttcggaaattactagtgaatttctgggcgtgacagtgatttaatcagaagcaagaaatgagagagaaaatatagacttattcccacatgtgatgtggaagaagagagagtgaaatatgggctgggttgctccaaagttcagcccaacattgatgtgttttttttggaataggttcacatcaggtccctaaaccaagttgtcgccgagtctaaaatttgtcctaaaccgcaataccaaatatgacacatccctcagctttcaaaaccagtgcaaataaggtgccaaggcggtttgggtggtggtttcagctgacatggcacctatgtggcattgatgtggcacttaagtaaaaaaatgtgggacccgcatgtaagtgactgttcggttaaaataaataaaatattacagtgggaccctgtcacaccctgaagttctcctcccaagcctaaaatttaatttataaatgaccctaagaaaatgccggtgtacatcaagagaaaaccctaagaaagtaatacaaataataatcgaatctggcatgtggaatttttcttgagttttacatgtcgaaattcactaacaggatttttagtggaattttcagagccctagaaataattttaaccaattaaaattgagcaagcaatattttaattccagggaaaatccttttcttcctttttctttttctttttccctcttttcttttcgagtgggccgccggcccattctccttcctcctctccactccgctgggccggccgaaggccaaggcccagctaggcgggcagcctccctcctccaacgggatgccgacaggtggcgcccacctgtcggcttcgtctcctacttcgcgcccgcacagcagtaccgcaacctgctgtcgcgccaaagccaccccctcctacgggccacgtcggtcacgcccgagcatgcgcggcacctcccgcgcccactcccctctctctaccgacagcgccagcgaccaagatgaccggaattcgatttttagaatcccgcctctctctcttctctcccactcccccacgttggccggcggaatctcgcccctaccggccacgtccgagccgagccgggtcgccgccgcccgtccgatcagccccgggggtgatctgggccgttggtcccgtggaccggcggtggaccacccgcgtggtcccggtccacggtggaccgcccccccttgagccgctgccgagtggggcccgcgtgccggcgccccttttccctctctcccgagccgctgaccggtggaccccgcatgtcggcgccgcactcccttgatgacgtcagccctgggaattattgcgcaataaattatttaaggtctttttgttatagtaataaacacagtgaatcttctaaaattcataactaattcatccgagctccgtttaagcccattcaagtctcagtaaatcaagaaaaatgcgtagaatccattaaaaatggttttttttctgtttcagtagttttgtagcctgtttgtattgtttgctttgtatgtcgcctagattccggttcttccgacgttccggtgtacttcgagatagtcgccgaggttcctccagctgcaaagcgttttataatgttattatgggatgtttacctattgttacagccatgctattttggtaccttgctcctttgttagcttgggttataacatgaatagacgttggactaggagttgcttagccatgcttagttcaactaggatacaatagggaaaatcttattaatgtttagactgttggttctaatggtattattggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagctgacgcatccaggcaagggtgggcgtgatggagtttggatgggccctgcgacggcctatgcggcttccggattcacctaggcacgagaggggactgcccgtcgcccgctggggacggtggtgaaacctgaggtgtggtgtgcttggctagagggggttatgcgaagggttctgtcacggcctctttccggtatgtcgtggtggcatgtcggcgcacggaaacgtgtcgtggggctgtgtcttgtgggtacagctgtacacctctgatcagagtaaaactattcgaatagccgtgcccgcagttatgggcggtcaaccagattcaccgtgattagtctcaccctagtttagtctaatgaaattggatagtataggtggatggttgggcctgttgcaacgtgggatagcgttggacagcggatgatcaatattaattaattattgcaaatgtttaattctttcaacttctgtttataaatgctcgctttatgcaaatgaaccactctagctctcctttgataattccctgcatcatacccctattccggtatgacttgctgagtacagtggatagtactcagtcttgctctattttttccccaaccccagagtgcgagtatgtgtccgatggcgggttctccgaggagtaggcttcgtccgtgccgtcgagggtgcctctggagtggtattcccgctgcagttcaagtccaggcttagccccagttatcttttgtttttccgctgcatttatgtaagacttttatgatgtttgtaagacatggatctgaatgtcaacattgtcgtttgtgtacccggccggtcctagacggggattttaatgcacattctgcttggaattctattcaggaatttctaggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgcttgtttaagtgagatttggcaaaacaagtcagtctagggttttagtaaaattatttggggtttattcgtcagtcagttgggatttgatgggtgaaatgcattaggtcctagctcaggaatatgggttgcaaggtatttgtacctttattgttattattagtatgtatctaatttccccattattttatcgttatgtaagtctgtcttatttattcgctctcatgcaaaattatctatgcataaaatttcgctcttattcgattctcttatttgagtcctttattgctttatttaaatttggatttaagcatgcattgatcctactcctttgtcttctctagatggccggccacccacccaaccaccgcggagaaggcatgatcgactttgtggcagagttagcacgtatgacgctggtggtgggctaccccaacgcgccagagtacacgactgttccaccactcagcggcgagcttcctcaccgtgtccgcctagaggtccatggctacgtcggtacctgcctagctaatatggtggttgaggcatccgaaggcacagcagatcacgcctgtcaggaggcagcatacctgatgatggccagactacgggagcgccacaactacatcttccacgacacggcataccgatttcaccctcgtcgagccagcggtgatgatgtcagtactttccgtccgacagccggcgagaatgacaccacctttggtcacatgtgcactgtgatgagggggatggacaggatgcactcggacctgcacaaggcgtccaaggccttgaatgatgggaagctcatgaggatcgtcgctctgaaggacgagatagcgcgcctgaagagggagaatgctctgttaaagggtcttcacgcgccaggaggagtccggatccgcactacaccccgcaagtcgacaacggcacccatgcgcatccagcttgcgcccaggaa

SEQ ID NO: 4811 - DNA, 6569 bp, Oryza sativa
cgcccgcagctccagcagttcctgcagctccagcaccagctccagctcccgttcccgtgtcagctcctgcatccgctctctccttcgcgcctacatcagccgtcagggtccctgccagtggcaatggaggttggttgccagctactcccagtggcagtcgcgacctcagcagcagcagctccagtggctcagagccgggcagcggcgagacttatccgccaggctccaggagtcgctcagagggacctggtgacgagcaggaggacgccttcgactccaccgaccgcaggagccgttccgagcattaggctcgttttccattagtttatcgactgtctagcatttatttgttagtttgtgtgtttaggttgcttgcttgtgggtcagtcgacggtcgatatcatgtgcctatgatatggttgtcttaataaggatttttgcttgctttttaagtgttttaattcagatcagaacaattgcagtttaaattcctatataataaagcttagttcttgagcatctgtttttcttcttttccccgtctgctcttcctccagatggtctacaccaggaatggtagccgtacaacaggcgagggcaccaacgacgaagagcgcactgatggtgtgcatcccaacagcgattccggcaatggtccgccaccacttcccgagaatccgacgctagcccaagtgatggcacatcagactcagatgatggcagccatgatgcagcagatgcagcaacagcaccagcagatgcaccagaggatgctgcagcacgccgaacagcagcaccagcagtttggtccccctccccctcagtccaagttgccagagtttctacgtgtcaggccacccactttctccagcaccaccaaccccatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccgccaggcactgaagtcacttgggcggagttctgtcgtagcttcaggaaggcgcaggtgccagacggggtcgtggcacaaaagaagaggaaattccgggcactccatcagggaaacaggacagtgaccgagtacctccatgagttcaatcgcctcgcgcgatatgcatcggaggatgtccgcactgacgccgagaagcaggaaaagttcatggcaggtctggatgacgagctgaccaaccaactgatatctggggactacgcggattttgaaaggctggtggacaaggcaatctgtcaggaggatcagcgaaataaaatggacaggaagagaaaggcggcacagttccggtccaaccaaggaaaccatcagcgaccgcgcttcgctcccgggcagcagggtggacctaccaccatgatcgtccgccagtaccgcccgttcaactctagcaacttccaccagggcgccagtggcagtcagaaccaccatggaggtcagcccaaccgcggtgcagctccacgcccaccagtggcaccggcacagtcaggcccgtccgcgcaagccaagaaggagactggaacaaaaccagggtcttgcttcaactgtggcgagcttggccactttgctgacaaatgcccgaagcccaggcgtgccgggccaaggtttgtccaggctcgtgtcaaccacgcgtctgcagaggaggcgcaagcagaaccaaaggtcgtactgggtacatttcctgttaactcaatccctgcaatagtactttttgattccggtgcaacgcattctttcatttcaaagaaatttgtggggatgcatgggttaaggaaagaagagcttaatacaccaatgagggttcataccccgggaaatagttcaacctcggtcagttttagcccttcagtgctaatagaaatccaaagatcaccatttctagccaacctcattcttcctgaatccaaagacctagatgtcattcttgggatggattggctgaccaagatcaagggagtcattgattgtgcgaatcgcacagtcaccttgaccaacgagaagggagaaaccgtagtgtacaaatcactagtctcaccaaagcaaggggtctccttgaatcagattgaggcggaaatcccagtggtcacgaaggagaagaatccgaggaaattggaagagattcccatagtttgcgagtacccagaagtctttcctgaagacctcactaccatgccacccaagcgagagattgaattccgaattgatttggcaccgggaaccgcgccaatttacaagagaccgtacaggatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaatgaggtcacaatcaagaacaaatatcctttgccatgaatcgatgatttgtttgatcaactgaaaggagctaaagtgttttctaagatagacctgcgatcaggctaccactagttgagaattcgggaagaggatattccaaagacggccttcatgaatccatcgaacggttatgtctttcggacttaccaacgtacccgcattcttcatgaatctgatgaacaaagtgttcatggaatttctggacaagtttgttgtcgttttcatcgacgacatacttatctattcaaagtctgaagaagaacatgagcagcatctccgtctggtactcgagaagttgaaggagcaccagctatacgccaagttcagcaagtgtgacttctggttgacggaagtcaaacttctgggccatgtcattacagctcagggtgtggcagttgatccatcaaacgtggagttagttaccaaatggaccccactgaagaccgtgtcgcagattcgaagttttcttggactcgcaggttattaccgccgattcatcgaaaacttctccaggatcgcccgacccatgactcagttgcttaagaaagatgagaagtttaaatggacagttgagtgcgacaagagttttgaggagctcaaaaagaaattagtatccgcaccagttttgattctgcctgaccagatgaaagacttccaagtctattgcgatgcatcccgccacggacttggatgtgtcctaatgcaagagggcagagtggttgcgtatgctcgcggcagttgcgtccacacgaagggaattatccaactcatgacctggaattggcagcagtggttcatgctttgaagatctggaggcactatctgattggcaaccgctgtgaagtatatacggatcacaagagtctgaaatacatattcacccaaccggacctaaatctccgacaacgaagatggttggaattaatcaaagactatgatatgagcattcactaccacccggggaaagccaatatggtggcagacacattaagcaggaagagttactgcactgccctatgcatcgagggcatgtgtgaggaattgcggcaggagtttgagcatctcaacgtgggaattgttgaacacgggttcgtagccactctggatgcacggcctacgctcgtggatcaagtcagagcagctcaagtaaatgatcctgaaatagcagagctgaaaaagaacatgagagtcggaaaagcccgggatttccatgaagatgaacacggcacaatctgattgggagaaagattgtgtgtacctgacggcaaggaactgaaggatctgatactcaccgaggctcatcagacccagtactccattcatccaggcagcaccaaaatgtatcaagacctcaaagaaaagttttggtgggtcagcatgaggagagaaatagctgaattcgtcgcactctgcgatgtttgccaacgagtgaaggcagagcaccaaagactagcaggtttactccaacctcttcaaatcccggaatggaaatgggaggagattggaatggactttataacaggactgccccggacatcatctggtcacgattcaatctgggtagtcgtggatcgactgactaaggtttctcacttcataccagtacataccacgtatacgggcaaaaggttggtggagctctacctctcgagaatcatgtgtctacatggagtacccaaaaagattgtaactgatcgagggagtcagttcacctcaaaattctggcagaagctgcaggaagaattggggacccgtttaaatttcagcacggcctatcacccgcaaactgatggtcagaccaagcgagtcaatcaaatcttggaagatatgttgagagctagcgctcttgattttggtggagcttgggacaaaagcttgccatatgcggaattctcgtacaacaacagctaccaggctagtctacagatggcaccgtttaaagctttatacgaccggaagtgccgcacacctctcttctgggatcagataggcgagcatcaactgttcgggacagaggtattagcggaagcagaagagaaagtcagaaccatcagggaaaggttgaggattgcccagtctcgacagaagagctacgcggataaccgccgaagggagctcacttttgaagcaggggattacgtgtatcttcgtgtcactccgctccggcgagtacaccgttttcagacgaaaggcaagttggcaccacgcttcgtgggaccatacaaaatcttggaacgaaggggggaagttgcttatcagctagaactttcatccaatatgatcggcatccatgacgtgttccacgtgtcccaattaaagaagtgcttaagagtacccaaagaacaagctgattcggagcatattgatatccaggaggacctgacatatgtggagaagccggttcatatacttgataccagcaaaagaagaaccagaaacaaggtcaccaggttttgccgagttcagtggagtcaccattcagaggaggaagcaacctgggaaagggaagatgagttgaaagctgcccatccgcacctcttcaccagctcctccgaatctcggggccgagattccgtttaagggggtaggttcgtcacaccctgaagttctcctcccaagcctaaaatttaatttataaatgaccctaagaaaatgccggtgcaaatcaagagaaaaccctaagaaagtaatacaaataataatcgaatctggcatgtggaatttttcttgagttctacatgtcgaaattcactaacaggatttttagtggaattttcagagccctagaaataattttaaccaattaaaattgagcaagcaatattttaattccagggaaaatccttttcttcctttttctttttctttttcccccttttcttttcgagtgggccgccagcccattctccttcctcctctcccctccgctgggccggccgaaggccaaggcccagctaggccggccgcctccctcctcccacccgggacgccgacaggtgggccccacctgtcgggcccgtctcctacctcgcgcctgcgccgccgtaaccgcaaccgccgccgcgcccacgcctccgccttctccaggccacgtcggtcacgcccgcgcatgcgccgcacctcccgcacccactcccctctctctcccaccctcggccgcgcccgagatggccgggattcgattttcgaatcccgcctctctctctcctctcccactcccccacattggccggcggaatctcgcccctaccggccacgtccgagactcccctaccctatttaagctccgccgtcgccctctctctctttttccccatttcaccgaactccctcgtgctccccatcgctcccgcgccgtgcacccacccgccgccgcctttcctaccgctctggccgccgctagccgccgctaggctcgccgccgcaccgcgccgtcgccgccgtcgggttcgcaaggacgaactccaccccgtccgcccttcctccgtcgggattcgtcgccggaattcgcatcccctcgcgctccggtgagttctacctctaccgccgccttcggccatggatgccggccgccgtggttcatctccctctctctaatctctctctccttcttccttagggcaccccgaagcccgtccgccggttgccgtcgtcctcccgtggcttgccgtcgtcgttcgccgtcgtcttcctccgcgccggccaccctcggtgaggcgccctctcccctatactcccctccctttccttcctagccgccggttagcgccgccgcctctgccgctggttgccgtcgccggcaacgtgtgcccgcgcgtcgtcgccatcaccgtggccggtcggccggccttgagccgagccgagccaggtcgccgccgcccgtccgatcagccccgggagcgatctgggccgttggtcccgtggaccggcggtggaccacccgcgtggtccggtccacggtggccgcccccccttgagccgctgccgagtggggcccgcgtgccggcgccccttttccctctttcccgagcccctgaccgg

SEQ ID NO: 4812 - DNA, 1762 bp, Oryza sativa
tgagtacagtggatagtactcagtcttgctctattttttccccaaccccagagtgcgagtatgtgtccgatggcgggttctccgaggagtaggcttcgtccgtgccgtcgagggtgcctctggagtggtattcccgctgcagttcaagtccaggcttagccccagttatcttttgtttttccgctgcatttatgtaagacttttatgatgtttgtaagacatggatctgaatgtcaacattgtcatttgtgtacccggccggtcctggacggggattttaatgcacattctgcttggaattctattcaggaatttctgggcatgacagacccacttctcctcctcctgctccccaatctccccgtctcctcatcctccccaatctagtgaaatagcggagggatccatgcggcccgcgtcggggctagcgttgccgttgaaagtcctttcggacatcgagcactcatcgatccaacgaaggtcccctcgccgccatcctccgagcactcatcaatcctggggaaaactctgcatgggatccttgtttgcccatgcccaccacccacctcggtccgccgtagcaacgaatggggcaacccagctattgagtgaaaacacggcggtctagaagatctgcttaactccaatgcaggtcctactcgagtgtgtcaagggcaggctaggccggctaatttgatcatgcaataagcaataaagataaaagcatagttagtcagccgataggccgatagagtatagttggtgatctcagctgatgtagtagaccaaataggctatggactggatagattagtgaataacaaaccctaaacatgcctcaccgacgataatactgcctattaggtttgataaagaagcataaagacaatattatgaaaatagccaatggaacaatatttagagcagaatctatagataacgataaagtactagctaataatttagtacgaacttatataaacaaatcaatctatataaacatttgaaatcatgatcagttactaattcaaatagcccagccgatactgatctagcttgatataattatataggatgatctgtctaaataagtggcaaatatacataaaaccagtaaagaagcatgtatattagggtggcgatgcgctgaagttgtattggattctctctcgtattacagtggtatggggttcatatttatactccgagtacagacttagtccattatggacacgattcaaacctttctaaagataaatacaaacaagaccatagacggcggtctcttgccaaatctaacacaaaccgactgaaatatcctaattaatagatacaattgtattattcgagctctatctctaattgataatgacgggtatcccgatctagacccaaaccgagcccaagttataccatatcggctgtatcggccatcaacttcatcaaccttgatcaacccatattctatttttagccgatacgatatctagccaatgcgtagtctgactccaaatccaactcgattcaacaccaaatccgcttcgatcttcttccttcttctccgaatctaatgcaaaattccgttgttaacaccagccaccggcagcatgtgtcgctcgctcacgcctcctaggactcgtatcacagaagctggaagctgggagcttgggactcgtagttccccttcgctcggatccaatagcggttgggaattgcggcaacgagagcgacgggctcaactggccgggcccctaccacgtac

SEQ ID NO: 4813 - DNA, 10516 bp, Oryza sativa
gggatccctctccttctcccctctcttctactctctcttccatatcccatctcttcccctctctcttccatatcccatctcttcccctttcttcccaatccagggtgctgggatgggcggcgggggccaagatccgagtcctgctttgtttgtatcggcagcgcgaagctggactccaccgaggcaacggggctctcgctctccacctccatggcggcggcggattcttccttccccttaggtgcatcggcgctaggagggaatcaacgcttgtgaagctgcgccaagtcctcatcgccagaacagtggtttgcggtttttactgtagcaacagtaacaaacagtgaagtacactgtgcaagagtagtgttactgtggtatactgtagcgatcgatctcgttcgttcactgtaaatcggacggctaagaataccctaaagtcacaatactatgcttctctgacttgatctcgttccaatcgcgtcccgctcgtacatgcgctactggagtttgacgatttcttctgcgagtccttccctggcagaggggagagacagaaagagtagaaggggacagagaggaggaagaagtggtagtcactaacatgtgggatccgcgtgggtctcatgttgactcagcttgtcacgtcagctaaaaccggatgtaatactacctaggatctcacataatctggttttgtaaattaagggacctattatatatagtatttcggtttatggaggaattttagactcggcgacaaattgaggaacctaaaaagtgaacttatttcttttttttctagtgatgaatccagcattgatgttgttggataaatgaatttggattcaataaacctagtccttttgcgtggattagtaaaattacattagttagaggtaataaagggacaaacatagaatccaacaatattattttgaacaattttactcttttcagagttttaaaatttctgaaatctcctctaaattttagaaaaaggaactttataggtttgagagaatccaatacaattcaagaaggcgagatggcttagatcagcaatgctatgcttacctcgttcagtttcgttgttacattgctcgtgattaggtttcaagaacggagtattgttttttttttttgaacttcatcgatgcctttttattcacccagcaggttcagtgatatcacgaaccacaaaggcatttataaattctgggagggggtcgacctaaacgatggattgacccgggtcccaactagcgcccattttagtaagatcatgggcaccactattacagcaacggggaatggataaaattcagctgaataaggagcttcacttcaccgaagatggcagtacctggggcctgatcatactctcaggatttcaaggccgacaccaggataagagaatcagtctcgatccccacctcagtgatgccctgcaccgaagcggcaagcaaggcagcctggcaagccctagcttccgcagagtcagcatcatgaacgaacgccagccgtccagcacccgcaagcagcccttggccttcactgttgcgtaagataaatccccaaccgccagttttttgcgtctcctgaaaagcaccatcaatattgagcttaagctgaccagcccgggaggcgaccatttcttccgcaccacattccttgttatctgctgctccccttccgttacagccatctcattcatcatgctactcgccctgtaaaggagtattgttggttgagcagcttacgagctttttctttgcatgagcgtgttcgctccagcttatcgatataaaagaaatctttcccaccaatcctagtaactatattattttctgaagggggcttgcttaactcttactttgatgaacttgtggtagcccatttttttctcctaccttgagtgtcttgtaagtgtcatgatttgaagacatcatcttgtcctatctcatatattaatttagaaattgattgtagtttatgtaattaaattccaacaaaatttttaaggtaataaaaaagctcatacaattacatcaacacaatagaattgtaccgagaacactctcagtagctctgtttggatctatgggttactttttagccctctctcaaatagcccctaaacagcctaaaagtttcaaacatatgagctatttcagggctctttggaaataacacacccaaaaatctgtaaaggagtgctaattggggctatttcgggtggggcccaccgaaaaatgtcttctctctccatagaaaagtgcattaaaggccaaatagctcttaaaataacccttgcatccaaataacttagggctatttctttatgctaaaaatagcactcaaaataactcttagctacttcttcaaacaaggccaatatatatacatgtaaccaaaacacacgcctgtagacaaaattttataatcaaagtacatataatgctaagtcctatcattccatagattagatcgtcactcgtgtccaatagtttttatttttgctagcataaacatgtaaaagtactcgtgtcaagatatttaggtgatatttattactccatagtaatatcacatggaaaatatgtagcatatcaatttaataaaagcaaatatcataaatcccaatttaatatgatcaaagttgcacaaaaactatagggattttggaatgtcgcatataaccctagatattataataccaaagtttcacaaaatcacactattgatcattttatttttgatctaccatactttcaagttctacaatcacatcttaaatttatgaggattttactatcatatagatgttgcatctttttttattttttttatataggagtatgtcaaaatggtcaacaatatagttttataaaactttaggactataatggttacgtgccacgtgccaaaatccctatagtttttacaatttgaaccacaataggtgtggttttatgaagtttactcatctatatctatactaatataaaaaggagcagttccctccgccaatcctacaggccaaatcactcgaatcgatctctaccgtctatctgcgtgcttgatttcgccaccgcacgatccatccatccacgccacgccgaatacttcgctcctcctcctccacccgcgaagacatcgctccacacgcgaagacttcgcttctcctcctcctcgctagctcctcctcctccccggatgttctgccgctgcgccgccgcatcctcgctggatatcctccccgcatggactgccgccgccagagcctctgattcttccccgccaccggagccggtgcttcttccccgcgtggactgccgccgcatccccgccgctggagccgctgcttcttccccgccgccggagccgccgcggccggctccgacctcggccccatccgccggcaccggcgccgaggtccaccgccgcgaccggagtcgacctcggccccatcctccgcgcgatgactccgcgacgctcctccttcccttgatccgcaactcctcactctagcgtgctccgcgcctccccgctgctgacacactccaccacggcctgctcccaacggagctgacttcgccgcgcgctcctcgctccgctcctccccaccactgccacacaccaccatgccatgccctcgccggcgccgtggatctgtatgtcatgaagcctgtctccgctgccgcacatagtcgactcccccgtgaatatgcctttcggctggtatcaccatcccgtcacggccctgtggtcctgccttccaacgacactctgccgcgcctccagtggtgccgccgttgtaagggttatagtctgcccacaccatgcactcggttctcacggacgtgtgccatcctctcttttgcaggtgagagtgcagagtgcttcagctgaaagtgagtcttccgattcccctcttcagcccaatagtcctctatgtggattacctgaatctgaatgtacatcattttctttcactatggcttgatttacactatttgatctagctatcagttcaagtggatacaatcctgttgacgtaaaacacgaggcctaggcgatctgcttaactccagtgcaggtccaaaactagccttcggatatgctagcgtgccagttgatttgatcctgcaatcaacaagaaataaagacaaagaaaccgtggttaaatccataaatgatagccgatcggctaagtgccgatgacatatcatttatcctcgagccaatgtcatatgtaaatcgatcggtggtcgtaaatagataatgaaaaactaaatctactcgatcggctgtagatattaacaatatataattcttatatcgatatatacttaaatcaagtgattgggatagatcggtcgccatgcggagacagtataaatcacttagatcgaaatatatattaatgacaggactatatatgtttatagcatagctgatcagatagatctagcatgtatcggctaatactccgatactactctatatcaagatattaaaacaagtacaatatatcaaacaaaagcctaatatacttaagtgtaataggatcttgacataaatggcggacttaacatgtcaatgaagcatatagagcaaatatagttaaatcagataagatcggctgaaactccgatactaccctaatcggcaaccagaaggcaggctagagattgatattctaagcacaacttaatagatcaaactcaactgatgcagcattaagtatgaaaagaagaacaatatctagacaatcaagccgctgaaagtttcatagggtggtagatatctcatataatccaagtcaacgtcggtgtctaacctaatcggctaccctctactgatagatattagccgattgtaggttagataaagatattgccagagattatgcaagatatatgatgtcacaccctaaaaattctaaatttataaattgttgtttaaatggaattataagaaatgattttaaaagcctagaagaaaagatccaattttaaataataaattccaatataaaaatgggctatataaaattttattaaatacttctcttgattctatagttcctagatttttctgggatttatttgagccaaggaagtatttttaataaatggaattgcatttcatgaataatttaaaaagaaaaaggttttaaaagtcctctgttggctttgggccgaaagtcggcccaagtcactctctctccttcggcctgctcgcgttcggcccaagtcggcccaccaagccgagccgctcgctctccctcctctcacccgctgacaggtggagcccacctatcagggttgtcgtctacctcccaccgcagccacgccctagccgcgcgcaagccgccgccaccccttccaaattcggttgcatctttcccgatccgatcaaattggtaaaggggaaatgatccccttgatctcctctatcttttcccctatagaaacttcatctaattttgttttgaaatcatcggattcgagcttgattcggatttgatttctctcctctaaccctaaaccttccatcgccgccgccggacgttgaaggtgtggaggattaggcgtagccctggtcaagctgcttgtgggatgaagtcgtctgcgctgtttattttattttccgctgcttagatctttattgtttgagaggaactatctacctctgtaatgaatttatattcgcctattaattagattaataattgcactctattatcaatttgttattgtgtgcctcggctgattcctggatgagggttttacacacatgtaagtgtttggagttttggatagaaattccgggcatgacatatgataactcgacgaattacataaacaagattaaagtgtcataaagatggaagcactaatcccgaaaacgcaagccgtcataacaagttttacctcttgttgaagatcgaaactgatgcagctcaacccgaaagtaagaactcgtcgaaataaaactaaagcaaaagggtggcgatgcgccaaaattgtattgaatgtgtgtgttaatttattacatggggttcggggtctatttatacccgaaaattacaaactatgtccatgtcggacacgactcttatccctaagaaactctaagataccataagtctttgcggcagacttttgccctaaacatatctctaaggaaattacataaaacatcctaattaatagatacaattgccttctcaggactctatccatgtgcggcaatcatcttgaaacatatcaactcaacctgatgttgtacaccaagtcatattgtcggaatcggctgtatcacttaacccagtctgactcagacttagccgatccaatcgtagccgatccagactccagccgattcttgctctgttctcgaatcgatctccgtcttcgactccacttcaatctaatcctcctttccgatgctgatattaccaaatttggtcgttaacaaatcctattgttatcctttcaccacaatcagtagttttctgagaagttaatttctttgcatacactgatgaactctgtagtaaattctctgcaggctctttcttgctcaattaattatcgctcactctataacagatcaactctggatttagacttctttggccaagcactatggctaaaatggcatgccaagcttggaacagaaaggtcaagcaatttttccaaccacggtgcagcacgtggctatagcactaacactaatttctatcatatgtaggcagatccaattgatgctggcacaggctttggtgaatcactgatgggtgagagacctacagagttccttgtccaacagagcaatggctgagttctttcagttgtgggatgaaatttagatggtgcagcttcaaccaggaatagccccgactccattcggtgctagctaacaggtgatggccagtttactttctcatcggcttacaacctcttcttcatggcaaagaccaaatgtttatatagtgaactgcataatttcgattcttgctattcatgatgatctgttggttgatctggaaagacggaacacttgggtatttgagcagaggtcttgacctacagagcaattatttggagacatcaaggagatcacgatttggaagtcggctagcattttttatcctgcagtgattatttattagtgttagttgtttattgtggtctgatgctttgcctcatacctttgttcgacatcatagtactttgtactttgtttctccctaaatcttaataaatttggtaggcctaatcctttggccaacctggtaaatcatttcagtagtaaaaaaatgtgttttcctggtcagattgatatatatatatatatatatatatatatatatatatatatatatatatatatatatatatatatatatgatttcttctaggctgaaactcttggcttggagaaactttgttgcatactgtagcaggaactgcaacagattgaaaattgatggtatcaaaggttcttaataatacaagcaataagttgtcaaagaatcattgtttgattttgtagtgccaaaattccaatcacacttagtggctaatctttttattttgactaaactaatgccacatgttagcagcagtagcagaatttttttattttggtttcaggttttagaactgatgttatttgttgctccaaataatccaccgatattgtcaggtgggagctatttgacttgtgtggctagaagtattcgagtcaatcatctgcttgccgtgtttcaaaaaaaaatcatctgcttgcctcggcctacttcaataaacaacggaggatgctctacatcataatcgtatgcaaatacagataatacacaccatatttcccttcatttgcaaagtcgtaataaactaaataagaacaggtaccacattcatatttgtctgatagatctcaaatccatatattgctaatggtctacttctcaaattggtttttacacctcaatgcatgttttgtattccgtttgtcacatattttatcaatcaattacagttctttgaaattggatcatgacttccaacttgtagcaggtaattgcattgtatcacacgttcattacaagatactcaaagcaaaaacggtaatatgttggttagctgcttgcacttgcaatgagagcatagaggttctgtacttacaatctgaggtcaggatcacgttccatatatttttacatagaacactattgcatgaattgcactatttgtagatgttctatagttaatcaactatgttaccttaaatatacatggtgtgttctagattctgaaatgtttagcaaacttagtcaatatgtagattaactatcacaattcatgtcactttttcatatctagcgaacttatctaacttttctttttaggttaaaaaaatgcaggaaaaacgtttaggctgtcgaagcaaatccatcaggaggacaccatggcatctgatgttgtctactatgcatcaaagagattactggttgtttctattccttctttttggttgagataatttgcgttaatataatgttttcatagaagtgagtcaatcttgatttgtttggttaacacgggttatgtgttgaacgtgtgatccaatagtatggctttgtcatgttttcttatcagctaattgtaagtccttagcaactggaatgctggatcatgactaacaagtgaaaaggatcaatgatagttttatgctggtgcagacatgcaatgccaaataaaacatggataattccttcttgtttgtgcaggcttcttagcactcagtaatttatcttttcgaaatttctatagttgttgctcatatacaagggataattttgttgctcagtctcacaaggacagctcactacctatccatctaaaatctgattacacatttgcccattaaatgctactatgcacaacaagaagcaacgaattctactatacacaacaaagaagccacgattgtactcttaattcaaatctgaatttgttaggacatattattgacatataaccacataaataaatccaaagtatatataatatttttgtttccccatttcaaggtctatatgattttacttatttggttttggtccgcatactggtagtatgcctgagagtggttatgttgatgactgttaagagaatgacaagtcaatatcttgctttgataccttttttttttgcatttttgatttagctaaaaataaccatgtactgataatggttatttttattgttacaaattccaattacatgaggatatgttttataaattttgggtaaataggttgtgcttcagaaggtgtagtttctaaaatttttagtgtaattatgtactcgggtgatatattttgtcaaaaacgtgcattgcacgtgcacgattactagtttagtaacaaaagcaacagaaaaggatgctttaacatatagaagttgaatctataggatgaagattaagggtgcacgtaaaacgagacaagtcattagcatatggttaatgaagttttaattattaaaaaaaataaaaaaatagatttatttgatttttttagagcaacttctatatagaaagttttcgcacgaaatatacttgttagtagtttgaaacgtgctaacggaaaccgagaaaaaatctgtatgttattggaggttagaacgggaccataataaagtgaattaactacaccaaccattgttttagagttgaaaacttctcttcaccggtttgccaaaaatggataatctcccatgactttcgatgttataggaaaaccagctcaaatcgataggtttatacaaatcaaccaccgatggactgaaaaaactgatcaattttgttagacatgaacttcacataataaactaaataatacaaccgatatagatcactactacaaccgatattggggagcttataattctgagaagcagctggtgaaaagctagctagtgagaatctagataagctgacaaaccttgcttctagcttctaatttattttctagattctacaattacaacatttcaaaatctaggtgaatatatgtactgtttggaggagcttctgacaacaggagatcataggagaagctgcaacggtcaaaagctccccaaacatgcccattaattagctgaacaatttatgatgccacatttttattaaaagaatattcaaaacattttagctgcaaataaaatttttgttagacacactatataagagaatatgataaaatagttgattatctacttaaaagagaagatagaatagattttagaaagatgttcattaaacagattaatttgggctataaacaccgtaaaacagagtgcagagtgtagactacgacaggaagggaaaggtgcgaatattagatcagcatctctccggcttcaccgaactggcaagtgggcccatccctccaatctcggcggatcactctcataccccatcggtccatccggcc

SEQ ID NO: 4814 - DNA, 15067 bp, Oryza sativa
ccacccccccccccccctaaaacccaccccgatccgcggccgctattaagccaaggccgcgcttccgccgctgcagccgatacgggagattggatcggaagcttctagaagtttccgtgggcgatggcgatccgcgcgaggtcctcctcctacgccgccgcggcggtcgcgctggcgctcgcgctggcgtccgtcgccgctgtcgccggcgaggtcttcttccaggagaagttcgaaggtgaatggctgacctgctcccgatcccgtctcgatcgatctgatccggttcgctgcgcgttgcgggtctcggctttggatgtagtggaggcgtcgcgtgggggtgtttggtggtgggtttgtttggatctctggggttttcgggatttctctggggtttatacgactaggaggcgtgctggttgttagggatctggagtgttaggcgctaaattgggtgctgatcgtggtttgtctcgccatttttggatggttgctgctgcggtatggtgggatctgattgatctgacgtgcatttgctcgtgggaatgggatctagttgcgtcgtctagtaagcgtgcgctgtgacgctgtgtcgatctgctttatgtgaattggttatggttttttgttagattgtgggaaaaaaaacgtggttgggttgattcggatcgaaaaatgttaggtttgtttggtatatgatccgcaggtttggatacttcattgtagggagtagttggtattctgctgtataatgtggtgaattttactttactttatactgcgaaatgggaaaatttagagcccagacttggtgatgttttgtgattgaaccttatgctttatgtatgttgtttaattctgatgtttcatatgtttaacctgaatatgaataaatgtttaagatctgcctatgctagtgctacatttgaagcatactagtgagaattggcagcttatgatggttgtcacctgtccgtgtccattagaatgtgatttgccacttatctgcatatgggatatggcattatgaaccaggtgcattttacacttcaggttttggcgtatagtttattagttctatacggtatgtctggagatccataattcgaatgtgttgatctgtattgctaatgtcgcctgttaaaattttgtctgtactactatttaaggaaatctccgggcagataatgaatttgcgtgatcatttgctggttctgcacatgatgcactgaacatggagttctgtgttatctaaatgtattctattgtgtgcacagatggatgggaaagtcggtgggtcaagtcagaatggaagaaggatgagaacatggctggtgaatggaaccacacatctgggaagtggaatggagatcctgaggacaaaggtaaattggaagatcaatacacctcattcagacactaacagatgatttttactgaattatttttcttgttgcaggtatccaaacctctgaggactacaggttctacgctatttcagcggagtacccagaattcagcaacaaggataaaaccctggtgctgcagttctctgtaaagcatgagcaaaagcttgactgtggtggtggatatgtcaagttgcttggtggtgatgttgaccagaagaaatttggtggggacacaccgtacaggtaatgattttcttctattgtagctctgattctcacttttctcaagattagtactagttatctaacttggtacttttgaatgcagcattatgtttggaccagacatctgtgggtacagcaccaagaaggtccatactatctttactaagaatgacaagaaccatttgatcaagaaggatgtcccctgcgagactgatcagctgtcccatgtgtacactttgatcatccatcctgatgctacatacaccatacttattgacaatgttgagaagcaatctggcagcatctacgagcactgggatattctgcctccgaagcaaatcaaggacccagaagctaagaaggtattttgcatattcctagctttcttggaatgccttgcttttgtgtctcttgaatgttaagatattaccttatgattacagccagaggactgggatgacaaggagtacattcctgaccctgaggacaagaagcctgaggtacttttcctttgttctgacttccgatatatcttgtaaaaatgactaacttcgtatcttgcatgaatgagaaacgggaaccttagctgacctgaattagaaaagttcacactatattgtactcttgtaatactatatgtcttaatagatttaaacgtgatgctagaaactaggaagaagctacatgtttttgttgtgtaatgacttgtggtatgctgtttccagggatacgatgatattcccaaggaaatccctgaccctgatgctaagaaggtacttaattgttataccattttatggtttatgttatatatgatgagcgtcattctaggttttaaaatttctttgatgtgatttctgtagcctgaggactgggatgatgaggaagatggtgagtggactgcaccaaccattcctaaccctgagtacaagggaccatggaagcaaaaggtgtgaatatctgtttactgatgcagatgcacttgaaacacttgcatatttctggtttctgacataaacatgtttctttttccagaaaatcaagaaccctaactaccaaggcaaatggaaggcaccgatgatcgacaacccaggtataattgcctttaattgaacaacttggtattacacatttttcagatgttgaactctgcattctgaactgtttcctttgtggttcacagacttcaaggatgatccatacatctatgcttttgacagcctgaagtacattggcattgagttgtggcaggttagttaagcaaagtacagtacgcctttagttctgatttattttgctgggtcaggaagacagacataaatagttatgaacttatcccttctctcttctatcaacaggtcaaatcaggtactctgtttgacaacttccttattactgacgaccctgagttggccaagacattcgcagaggagacatggggcaagcacaaggatgtatgtcgttcttcacctagcttttaccgtgtaatagtttcgttatcgacccaacattctctaacattagtgaatcttgtaggctgagaaggctgcttttgacgaggcagagaaaaagaaggaagaggaggtaaattccttcaccttacaatgttctaatatgaggatgatggatgtacaactgtccttgtcattgcatttcagtctgtgctccatttcactgtctttgctatacgttttgatttttgttggcatgaacaccagttccttgatgatcagtgggccattgcttccacttaattatactatggtgtgatcaaaaccttttaactcactggcatggttctgttatttgtagttttacgtattatcttctgattgttacaccagcatagctttaagcaactgaaatattctcctttgctgaactgccatcactcgtggttattgtggatgtaatttgcttaccattgattatcaatgtccttgttaacaggaagctgccaaggccggtgaggacgatgatgatttggatgtaagatttgcatccgttcttcctccatgttctatattttccttttgggcttgatctaaacctcaacaacatttatatttcacaggacgaggatgctgaggatgaggacaaggccgatgagaaggctgactctgatgcagaggatggcaaggattctgatgatgagaagcatgtatgtaacactcctgcgttttcttgataccttctggattctggtgatgcatttcctgttaacctccatgtgtcctgatcaccgtccttcctttccaggatgagctctaagatggtgaggatgaagaatggaggccgccttcgcgacgatgccaggatttgctagttctcccattgttatgaagttccctttttcgtgatcagaaacttgacaagaaagtactctgtagatgagcattgctgaggaactttaatttggtctttgtagctctctctgtagtgtcatttttcccaccacaagaaaaagaactgataacttattgaacaagagaaatcttttgcacaatcgctctgcatcctgctgtgattgtatatgtgcttgtgccatttcccattgttttgccatagggaaagcgtcttcagtcgttactcgttaggcacctggtcacctatggcatggagtcgaatcgatgagaaggccgagatagaaatgctgggcaagtttgcgttccaaacttccaatgccaagtctttctggttaatcaaagaaatccctcacattgcctgtttattgataccatcagaaatagtttgtttgcattccgctattgtggcaatattctcccacgaccgcaaataactaaatatgggttgatcaattgagcaagatccaaagcaatggtggaatatgcttgtccgaagagtggtattgctttttttgaaaaccaagggggttaaccacaaaattagccaaaacaacctaatggggatataaagttaactgatactccatccgtttcacaatgtaagtcattctagtattttccacatttatatattgatgctaatgaatctatccacatttatatattgatgctaatgaatctagacctttaaaatgtaagtcattctagtatttctcacattcatattgatgctaatgaatctaggtctagaatgacttacattgtgaaacgaagggagtaggagataagattagggcagacagcgcttggatcaggcttgtagttcgtcggtacatgatatcgctatatccgcatatatttagtccttaactagtgcatagtattttaattatatcaaaattattcgtatttactgagttttttatttagtgtttcttattatactaattatgattaaatagtaaatttaaaattattaatatgatataaatgagatataacaactagtgcttagtattttaattatatcaaaattattagtatttaatgagtttttttggttatttagtgtttattatttatactaatatatgataaaatagtagatttaaattattaatatgatatgagatatagctcgttgacgagattgctatctcgttaagataatgagcttaaacgagtcttagccttaacaacccgagctagctctttatccatctcggataagatacctactagttaggtcataacctcagtggcttagagtaagtgttagtagctataccttttttgactgataatacttatcattttgtactatgacgaggttaattttaaaatctttgactataaatattttctaaagtatttattctaaaaatatagagaccatattaataaattggtcttaaaaggtacttcaataaaataatatatttgttgatatttctatatattataaataaaaagtggtcaatgttgcttttgagaccgtgtaattgttcaaaacgataagtattatcatcctgaagagagtaagggtttaacttttcgatttggaagtgaaaacgctcatcaccggtttaccaaaatttaaccgaaaaccattaaaaactgatgactttcggtcaaagccgtacgaaaaccggctaaggctgtgtttggcagcccctcttcccaacccatctccctcgtttttcgcgcgcacgcttttcaaactgctaaacggtgtattttttgtaaaaagtttctatacgaaagttgcttaaaaaatcaaattaatccatttttcaaaaaaaagcaaataattaatcacccgctaatcgctgctccgttttccgtgcgggcacttactgttgggaaccaggggttccgaacacaccctaataccgaccggttttcataaaccgagatctagcagtttcaccacagcccaccaatttttgtgaaattccatcagttacgtgatccctgaagagagtactaagtagagcataaataatgatgtgatgtcagcatctcatagtaaatgccacgttagattttataatgggttcaggagagagaaataggttagaatgaccgttgtttgagtaaatgccacattggatttacaatgtgtcaaattttacaactttttacatcctactccctccgtcccaataaaccctccgtcccaataaaaaataaatctagagtgtatgttggtttttttatagaacggaggaagtatgttttattttggatcactctttaaccaggccgagccgacccatcagctggcctagcaggccgaggcaaactaacctcgccccgcgctctgcaactgcaaaggattattttctgctttcgtgttcactgaatttctgctggtctaatgaccaccactttatgcacatctcaaatgaaaattgaagctccttccaaatcagcatcaccatcgtataccctttttataaaaaagaaaaatcataaatgtttcagaactacgcttatgcactgcctcgagatttcgccttgacctcctcgtgctcggcaacacaagaacaaaacaccccacactgcacagcagctcttgagccatcaaggttgacaaaaacacgcatgctgcatactaaccacatcacgatgaaaatcagaggaacaccaaatcgttttccagtacatgataacacttgtaatagctgtgatgttcgacaatgatcaaaacaaagcccaaagatatacagaaacaaataggtacaacaatcagaaaagcgttgcattctaaatcacaacccatccaaagtagaaatgcagctgatgtaaagatactaagtactaaacaataggtgattgaatgttctgttggtttgcttgcaaaaaaaagaataggtatggcagaatcttatcaaaatgtgaatatgccaaaaaactgaagccgtcacacaatcttcctactgctcagccttcttcacctcttccgatgactcgggttttgttggctcaaccttcatcacctcttcccattgcccatctgatgcttgcttccacagagttatgttgttctcaccagcagctacagataatatgtttccagtcaaggaccaggaaaccctccaaacaggggacccgaagtcgtgcatgacctttccctcccacttatcaccaactttccctctactccaaatgacaaccttcccatcttgagaagcgctggcgatggtcgccttagctaagcccaacactggtgcccatgcaacatctctcacacagtctgtgtgaacatctgaaggaagagcactctccagtttccagccaccattgacaaatccccagaccttaacaactgagtcaaaaccaccagagacaagcttataaacaagctctcctgaaccagccagagaaccaagtgctgttgctggagcccaggagattgctgtcacaccaacagggtgagctcgctcaatccttgcagtgtcccatcccccatcagctcgcatagtcatgacagaaatggttccatcagaagacccacaggcgagacaaagaccaacctcatatggggcccaagcaatggagttgacagaggacttgtggtcagtaaatacatgggcttgagaccagtggcctccagcaccctccttccaaatgatcacacgcccatcatagctgcaggatgcgaggatagtaccatacttaggatgggcccatgcgacacgccacacagggccatagtgcccgctgagtgttgcaaggagctgggatggggcagatttgccgcctatgctggagatcttgacagtggagtctgaggaggcagttgcaaggcgcttgccatagtagtcgatagctgaatcatggaccatgtccttgtggtccaactctattttcttcgatgacatggttcaaagctgtagtgtgccacaacctctaagtcctccacaattctgcacatgattaaataaaagtttcagcaccaattcatgggcatagcagcctaaatttgcgaaactagataatagaatcccacccgaagtgccctaaacggttaacaaggaccaagaaatagtcacctcacaaacttaatattaacaatctaaacaccattttttgtcatactcccaaagagacagaagggggatgcaatagaacaatgctggtgtatcatcgcctcataaaatcaaccatggaattaaacacaacgagactgtaaataagtatgtagacgaggctcaagggtcaccattggcaaatggtactaattcacaaactttgttagacttgtggcaaaccactatagtaaatgttggtggcttcaaaataataacagaaccacttacatgctaacctcatgaatgagtataacaaggcattggattaattcgatgaattgacttaacaggatgtaacaatttcacagctcaaaacacgttcaaacatggatttgaattcctcaggcatgagaagaacagaagtttcgatagactataatctaaaaaatgaaaacaaaattaattatacccctcattatttcacagctcccaaatctatacaattctgattcttctctatcatgtcaaaaaataaaagaaagatagctgatctggtgtgacctacacccattccctcattccacgagatcttgcgccccccagagggcggatccaacttgggacatgggggttcagttgaacccccaaacttttgggtgaacaaagaaactgttacttgtattaaggttaaggctctgaaattaagagaagagctccttccagatctagaagagaagctagggtaaacgaacggaacgcaagcgaattccagacaaaagtagtcccggtgggagagagatgaatcagaaagaggatgtggatgctcaccaggatcccctcccctgccctgctctgctcgccggatggagatcggcgcccctcccctgttcagccgcgactcgtcttggcgcaaggagcggaggagacgggagattttcttttttgacgcctaagggaaggggaagatactcgagttaagacgtggcagttactgggaatatttaactattagccactttttagacgtggcaattaaggatttgacactaaaatactaaggctgagttcgtatgggggagatgggtacccaacttctgcgtacggaaaacggagcagtccattaacgcgtgattaattaagtattagctattttttttcaaaaagggattaatttgatttttttaagcaacttttgtatagaaactttttacaaaaaatgcaccgtttagcagtttgaaaagcgtgcacgcggaaaacgaggggaagaggatgggaaaaggtgcatgcgaacacagcctaagtgtgtgtttagttcagcgtaaattttgtattttggttaaaattagagatgatgtgactgaaaagttgtgtatgtatgacatattgatgtgatggaaaaggactaaagtttggatctaaacacagcataaacccatatatcgcagatagagaagggtatagactatgagtggtaaatagttaaatgctatattttaaaagtgacgaatagtcaaatatcctgaattagatggatgaaaacagttcggaaatggaaagcgtccgtccgaattttttcgaaaataaattcggaatttttttctcagaaacggaaacaaatatgatgatgctactatccgtcgaaaacgaatttgtggacttttcgaaaacaaattcagaattttcttttctcggaatcggaaacgaaatatttctcatatacagctgattatcttcagacttttctactccaaatatttagatttatactatgtgccatagtacttataattggagttatggatgaatatagttatttttctccaagaaattaaactgtataactagttgtgttattattaattgataaaaattagaaatattgatttattgttttacaaaagatattgaggtatatctcttcatcgatttgagaagtttagcttaaggggtttttatattctaataaatatcattaccgtattagcttcgattcgtattcgctccatttttatattcaataatattctattcctttttttttgtatctgtggttttcgatttcgaaaagaatatggaagcggaaactataaaagtggtttccgaaccgtttccatccaatcgagtactctacctttatatctttttcttactactttaaaactagctttatctttatgatgactagtggcccacagatcagcagtactcagagaaaaaagtacaacaaactccgttggggattgtgttgacagcaacctcatcagaccactagcaaccactagctgatgcttcacgaatgtcacaccctgaagttcttcccctaagcctaaatggaattaataattggtctcgagaaaatacctgtgtaaaagcaagagtgaaaccctaattaattaatgtaaataataatcggaattggcatgtggaatttttcttgagttctacatgtcgaaatatgctaacaagatttttagtggaattttcagaactctagggataattttaaccaattaaaaatgagcataagcattatttaaatccctggaaattcttttccctttttctttttccctttttcccctccttttttcctaatgggccgccggcccatttcctcctccctcccgtaccgtgctgagccggccgaaggccacggcccagctgagccgcgcctcctccctcctcccgtcgggtcgccgacaggtggggcccacctgtcgggcccgtccccaacctccggccacccgccgtccgcagccgccacctcgcaaccgcccgcgccagccttccccgcgccacgtcggccacgcccgcgtgtgcgcccgcctttcccgtgcccctcaactccctctcccgctcgcccgcgcccccgagatggccgggatccgcctctctctccacctccacctccccatgtcggccggcgaaatcgggccgctcccggccacgtccgagccccctctcccctatttaagcatcaccgctctcctctctctctttttctccatttcgccgagctcccccgtgccctccactgccctagcgccgttgccctcctctccgccgccgccgccgccgctccggtcgccgctagccgctgcgccaagccgcgccatcgccgccgtcgggttcacgagcccgggggccatgccgtccacccctccgccgccaatttcgacatcttggtacatcttggtacatttttctttgagatcttagtacatcttggtactgcctggatgaatggagtactgagtctgatgagcctcggtgagtatcagatctttcagctctttgtcatcaggtacgcacaatctttctcccaaccagattgtgccgtgctcatcttcaaggaaatcctgggattttccaaccctcatattctttttcagctctgctatttcaggatcatttacctgagctgctcggacttggtccacgagcgtaggccgtgcctctagggcagccatgtacccgtgttctacaattcccaagttgagatgttcaagttcctgctacaattctttacacatgtcttcggtgcacgaagcgttgcagtagcttttcctgcttaaggcatctgccaccacattggctttgcctggatggtagtgaatgctcatatcataatctttgattagctccaaccatcttcgctgacggagatttagatcaggttgggtgaagatatatttcaaactcttgtgatccgtatagacttcgcagcggttgccaatcagatagtgcctccagattttcaaagcgtgaaccaccgctgccaattccaggtcatgtgttggatagtttccttcatgtggacacaactgtcgcgaggcataagcgaccactctgccttcttgcattaagacacatccaagcccgtgacgggacgcgtcacaataaacctggaagtctttcgtctgatcgggcagaatcagaactggagcagacaccaatttcttcttgagctcctcaaaactcttatcatactcggctgtccatttgaatttctcatctttcttaagcaactgagtcataggtctggcgatcctggagaaattttcaatgaaccgacggtaataacccacaagtccaaggaaactccgaatctgtgacactgtcttaggtggggtccacttggtaaccgactccacattcgatggatcaactgccacaccctgagctgtaatgacgtggcccaagaatttaacctctgataaccaaaagtcgcatttgctaaacttggcataaagctagtgctcttgcaacttctcgagtaccagacgaagatgtcgttcatgctcttcttccgacttggaatagataagaatgtcgtcaatgaataccatgacaaacttatacagaaattccatgaacactttgttcatcaggttcatgaagaatgcaggtgcattggtgagtccaaaagacatatccgtgcactcatacaacccataccgagtggtgaaggctgtcttgggaatatcctcttcccgaattctcaactggtgatagcctgatcgcaggtctattttggaaaacaccttggctccttttggctgatcaaacagatcatcaatctgtggcaaaggatatttgttcttgatggtgacctcattgagtgcgcgataatcgacacacattctcttcgtcttgtccttcttctccacaaaaatgactggagcatcccaaggtgaagtactcggtcgaatgtaccctttctgcagctactcatcaacctgcttcttgacctctgctagctcgttggctgccatcttgtacggtctcttgtaaattggagcagttcccggtgccaaatcaatgcggaattcgatctctcccttgggtggcatggtagtgaggtcttcggggaacacttctggatactcgcagatgatgggaatatcttccaatttcctcgaactcttctcctcggtgaccaccggaatttccacctcaatctgattcaaggaaacccccagctttggtggggctggagatttgtacaccactgtttctcccttctcattgatcaaggtgaccgtgcggttcgcacaatcaatgacgcccttgaacttggtcaaccaatccatcccaagaatgacatctaggtctttggattcgagaaggatgaggttggctagaaatggtgatctttggatttctattgttacagaaggcctgaattgaaccgaggtggagctatttgtggggctgtgtcttgtgggtacagttgtacatctctgattagagtagaactattcgaatagccgtgcccgcggttatgggcggtcaaccagattcaccgtgattagtctcaccctagtttagtctaatggaattgattagttcaggtagatggttgggcctattgcaacgtggagtagcgttggacagtggatggttaacattgattaattattacaaatgttttactgctttcaactattgtttataactgctcgctttatgcaaatgtaccgctctacctatcctttggttatatcctgcatcataccccctgttccggtatgacttgctgagtacggtggttgtactcagtcttgctctacttttccccaaccccagagtttgagtatgcgtcagatggtggcttttctgaggagtaggcttcgtccgtgccgttaaggatgcctgtggagtggtgttcccgctgcagtcccagtcaaggattagctccagttatcttttattttccaatgcatttatgtaagacttttataatgtttgtaagacgtggatctgtatgtcaactttgtcgcttgtgtaccccggccggtcctggacaggggttttaatgcacattctgcttggaattctactcgggaatttctgggcgtgacaacgcaccgccaccactgctctttctctttgagccaccatcgttcctcatctccacctttgcatgcgcagccgcaccctctagtcactgacatgactttcctcctcccccgtcatcatgcacactattgtcgtggtcatcattgaggtcaggggtgttgggcttacagggattcagaggggcagccatgcaggagttgacccgacaaagagcagagacactagatccgagctcctccttggtggatctgacggtttcccaacggtcaaagggaaaaagaaaaaggagaaagggaattagtgtgcgaaatggctgtagagtcaccgaacttggagatggatagaatagggtggtctaaattgaaatgtaaagtttgatgttgtgtaaatgaaaagaatggttaattgatgatataatatgaaaacttttaaaaatacatagtacaaactacccgatagtctcgtgatatgctaagcccagtacagttttatcgtctctgcacattatggttgggttggtgtatttagctattactaataatctcataatatattgatacatgacgatacgaacttctactaacatgagttgattaattatggttagatagatctggctaaaaaaagataaaaataataccaacaattttgcccaatagtaaagcattcgattgtggtcttcttttctcattgcatgattgttgacggtcgttagcgactagtttcgaccatcaatactacccaaataaaggagaactagtcatgcttgcaatgcatatttatgttcaataataaaatattccactagcactaggattactaacctcttgcagagaatggccataaaatagaggataatcgacatcaaaacaggcgatcaatcaatcggacgatgttgagaatcagacttatcaatgaatgggccaagaaagcaaaaatgacacgaccaattggaccaaaatttacaagtctgcatttgggagcaaaagaggaggccacctgccgaaattgggccaggccggaccagcccatggttcggccaaatccaccgcagctccgttcgatccaggttttggttggacggctgggattgatccccaatgatggttggagggtactaccgacctttccaaccgtcattaccagcctatataaacccttcactctc

SEQ ID NO: 4815 - DNA, 587 bp, Oryza sativa
aatttttgctaccagtacgtctactggtctcttgacaagcgaattgaattaaattaaaatgggacaggaagccatgttgttcttggcaaatcaaattgttcttgacaagcgaattgaattaaattgaattgatgtagttttgacccaatgggccttctatcttaggccctgcatcatctatccaacccctatataatagcaaggaaaaggtccactttgactcccttaattgtacgccgaatctaattcgtacccctcaaccagaaaaccggatagaacgactccccgaactattgaaaccggtgcaatttgactccctcagcggtattggagggcggttttgctgacgtggcgctgacgtggcggtgttgacccggtcttagtcccacgtggcgcttaagtggcattagaattaaaaaaaatgtgggacccatatgtcattcacacacacaatatattgtgggatccattgacatgtggggggccacatgtcatcctttctctccaacccttcttcctcctccctctctctctcccttctttatcttttctctccctttttctcttccccatcggacggtagtacc

SEQ ID NO: 4816 - DNA, 233 bp, Oryza sativa
ctcctgcgggacctcacgatctcgacgaagatctcgccgagcctggcgcgcgcactgtctcgccggcggtgcgccgggatcgggaggtacgggaacacgatgggatgagacgcatgctgtcattgagctcgcggaggagcgtcgggacctcgccgagcatcttgaccggacctcgccgaacaggcacctagtggcgatgagcgttacgactatcatcactgctatgtgcagga

SEQ ID NO: 4817 - DNA, 702 bp, Oryza sativa
catggttatccggctagtcttagggaatagcttatatctatggaatatgtagcagatcatgacttgggtattacgtttccctgtatattatggaacggcctaaagtcctggtttgataagattgtaaagtagatttaggaaaccgataccgtgttggttaaggtttctatcttgtaatcctgccctccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaattcatgtttcgacaatttgttttcttctaaattaagatccaaattagaggtattatgaaaccatgtgcagtgtggtatagcgtggagtggaaacaagagggggccgggtcaattcttttccattgtatctatgccgtccttttccctcttacacgatccatctctcctcaactttacatttaattacacaagtaactaattaattaagggagagagaaaagacaccatgagtgcatgaccatgaggggtgccctttgtggaggggtaaggtatttacgtagttaaaggcagctttggaacatttagattt

SEQ ID NO: 4818 - DNA, 9881 bp, Oryza sativa
  unsure (1)..(9881): unsure at all n locations
agcagaagttgcatagaagaaacattaatgcgtggttaaattctcaggatatcaccttgtgctacttgacttaataactgaacttaattatattccgtacagagttgagagcatgcacgcgtgtataagaattttcaagagctttgcatattttctcatatacgtagatagaattaatccgacacaaattaaataagtacgaatacttttgaaattttgactatcgataatttctttgaaaatatttaaaaacgtttgagcattttatatttttttaagaaaaaaactatatcataatatcatatatacttattttcccaaaatatattagattttataaatttaatttaatataaaattgatcaaagttaacttaaaaaattaaaccagaattgtcttgaatactatttatgagtggaacgagtatattactaagtatggttctaacaaaagatatgaagctaggggcctgttcggcaagctgggctgctgcagcccctgctatcttgtggcttgccggactgttcaggtcctcggctgccgaacatgccctagagcaatggctgcaatgcagtagaggctgtaggttaacctaattaacgctgctgaaagtattgctacgtgcaggaatttatttttgaacgaaacgtgcaggaaaatcaaactgaagaaattgaaatgtgaacactaatactagttcaaaacgaccatatccatgcatgaacgcttgaataaataccagtagacaaaaaacaacgacgacattaataaaggcgggagacagaagtttgaatccagtcctgccatgcaaagagtggcagactgttaaaaaagcactgtatttttaatttattggtgtaatcatgtaaatacatatacacatatgcacataattatttgcaaaaccctattctcatgcacatatcggcatggactgcctagctagctagtcactcagtgctgcatgcattgcttatttttacgtatagtaccaattcaatcctgcagattaatttatttacccaaaaaataactaactagaaaaaaaatgaatgaatccatcccaagttaaatgttatttgttaaattgcccccggtttttcttagtctcgtcctctgaattgtacatggtgaagccgcgatgaaccattcannatacagcctggacatgatcatatgtcttccttgcgtgacctcatgcttgtctatgttctccaaaactcgggtagcccggatgtacgagctctgcaagatctctgtagaggcagatcaccattacaatgcgtcagttgcgatcaaacgagaagcttaccgagcttagctactaagtatgagaatataatggcgccaatggtgcagcattttaaacctaccctgtggctgtgtcgtaggtgaggccgactgtgttcttgacctcgcgtagcgcgaatttgaagcgttcaatgtcgcggggatggtgatcgacggactcgacgacggcctgcgggaggacgagatccgagggtttgatgttgtaaaacaccgggatgatctttttccgtgactcgacgaggagggcgagctcgcggaggcaatactcggagtcgcagtagtgcggcgagaagatggccaccgcgacgccgcactggctgatggcctcgctgatccgctcgtcgaggcgatcgccggggcgcattgactggttgtccaggaaggcgcggacgcccgcggcgacgaggcggtcgtagaaaagccgcgccaccgtcctcttggtgtccacgcccctgtggttgatgaaaacgtcgtagcgcgcctccccccgcgcatcctcctcgtcgtagtactccacccgtctcgccaccgccgccttctgcttctcccccctgctgctgctggtggccgcaaccgccgcctcagccgacgcgtttagccgcgacgcgatggtgcaccggcggccgcgggaaagcccggtggacgacatgatcaaacgaccgatatatagctagtgatatcgatcaagaaatgtctcctagaatactgcgagagcgcggagaaatccaagagtccaagacgttctctagttagctgatcgagctgccgcgatcccgatcaagttgatcttgatcgatcgaaacgtctctgaacaatttgagtggaagcagcaaaaactccaacaaaatagagatcgatcgctacgagttagtttgtgaattgtgatgcctgatatgtggatgaggggatgggccggcatgcatgcgtttataaaggattgggttcggggtggtcatggtcgcatcgcgcgcgcatgggaacattttaattatgacatgaaagtactgagtaagttatccgcgcacagtccccgggcggggaaatttgttattttaatagtcagatttcgctttgagtagtattatcaatccaaagatcagaccgtcgtcagtccaccgtcaatccaccccgtggcttatgctaagacggactatataattattatgttttctggtcccctatatatagtacaacaaacagatattctgcatgaattcagaccaaatattatacaatccaaagagcgattcgctacttttcaagctctcctctccaagcaaaagcatatacattactggattttcttcgctcgagcgtttcaaaagtttgaattttcctcgctcgagcgtgcacacacgcgttgcgttagacctgcagatctttgcagtattttggcgagactctgcgcagcgtgcagccaaaggcaaaaaacactccgtgcagaagattgaatagaaattttgtggaggtgagaaccattcaaatacttgaacgacggggctacgctgaactgcagcaatcaatgggacaggaatactactgcaacgatgtttggggtcgggaggaggatcggaggaggggggagccgtacgatcgccgggtgacgtgcgagagtgatgacgtcacacgttggactgtccccctctcatctcacgtgtctgccccacggtttgacttattgatgcgttcaaaagttccacgggctgctgggctggctgcgccaccggtacggtcgctgtaataaaatacggaattgctaaaccccagtcaatagaaaagctacctctaaatcttataaattttggttcactagatatgcttcgcgattcgtgctccaggtgcttcttcttcaaccccagcaaactcctcttcttcgccgacgcgggcgataacccaaactccgcgaaggggcggacgaattaggttcccggggtagggtggggttcgaggggtggtaagggagaaagaagggggagttccccgggcttagagggatggtcgtggacgacgtcggcccggaggtggcaggcgggtcgggtgggcgtcgaggcgccggcggcgctgccggacccgcagggctggaggaggacggtgggccagcgtcggtggtgggggcatctcgccgccgacagctcgaggaggaaggaggggaggagggaggagaaggagggggaggaggatggtaggggggagggagtctcgccggcgccgttgacgccctccagccagccggcgaggcgggcggcgacgcggtggggtggtggcggcgggggatcgggtggagctgcggaggagctcgcgagcgtgatgggagggaacgggaggaggagttgtagggttaatgtatcttcatgagtcatagagcacatccgatggttcaaaaattgaaagatgggaggtgggattttctgtcgtcagatgtatagatagtcccaatataataataataataataataataataataataatactaataataataataataatagtaataataataataataataataataataataataataataaagaaaaggtgaactttatccgcaccatcgtcgagttgaaatgaagtccgcgaagattaatttttgggggtttcgggtgtacttctaatttcgataatcgtttccttttgaatgtgaaattaatttgatatatagtcgaaggcacgcaatctgcttgataatgacttgtttggccagaaattaatatgaggaagagacaaagtgtaattaaagacttaggagtacgtgtgttcctagaaagtagacatatgtgtacgagtgtacaccatgtctattgatgtagttcaaaaaagccgacgttgaatactttatttgttcatgcaaatacattgttattgatatgttttaagggaatacttcaaaaatgtttgaatctcaatagccttttagtcgtattgaagatacttgaaattggtaaattgatggattatgtggtatttgtgatagctgtttgaggatataaacgattgaattaaatagcataaagttgaaaagttaggaaacatgcaaacgaaaatcccaaatccagaataagaaaagaacgtggctttaaaactagcattggattcatgagaaacttatttgtgtatttgtttagaaaataatattgttatattaccaagttaataaaataattatgttacggtaattccttcgttccaaaatttgactcagtcacgtaaccattttttaattttaagttcgaccaaatttatagaaaaagcataaaaacatttaggggttgtttatattgcagccaaaataaaccttaccaaattttggtaatgccaaaattttggtaatttggctattatgtatttactaaagtttgataataaactaaatgaacgcatatatttggcaactctatcaacaaatgttatgatttaaaatggcatcaatctgaacaagcccttaagcccttagaacatcaaacagattatatacatatatttagcggtggatttaataaaaccaacttggtattgtatatgttgctatattttctaaacttaaagatgtttgacttagcacaaaaccaaaacatgttatattttaaaaaggaaggagcagaaattagttgttaaaattatattttcaagactgtattgatacccaaaagacacatttctaaggatagatggagtaatacactaggtttacatataattagaataaccactaacacagtaagtttatatgtaattagaatatcaattaattaaatgagaacatgcactggcccaaaattctgtattagacttggactataatttaatatgacgtatattaatttacataaatatgattttccatctctgtataaattaagttggttattcattggttatataagttggttgtaaggatagtggtagagccgagctcttatcccagtccctgttcttaaacaaatactcctaggtaccatcagtccttaaaaaaacgttatcatcattaataggtaccatcagtttgtacctacatgacgactagtatatgaactgatcacatcctaactagctcataatcatcacctagaagtgcaggttttggcataacttcgttaacaaatatttcatctcgatattatcatcacttggattttctactatgttcttacttgtttcaactaccgagatttatatcaattcatagcttttataacacgtttctttactatcttcggtgttccttatttactgtactcttactttcaataggatttaatttacatactccctccgtactagtaaaggaagtcgtttaaaacagcgacacggtcttcaaaacataactttgactttgtgtttctataaaaatatttattgaaaagtgatatatgtatatttttatgaaattatttttcaagacaaatctattcatataatttttacattttcaaactcaataattttagaggtattcacgatttatatttccaagatttgatttaaacattgtcctaaacgacttcttttacgagtacggagggagtataaccgctacaatttgtaagttctaataatgccctggctttcacttttaacataaataaatccacttccaacttaagactgtgttgttcagtgtttattgggtacctactacctcatttttcgtaagcacatatttcaaaatgctaatgctcaactcaactaatcctatgctaataggtcttattgttttgtgtgctgtgaaaaagcctaaccattaagccatatgaaatgaatcatgattaagtggttatagttcttgttgagcagtgcaaatagtcattcctatatttttttatagaagatctattccctcttaaaaagtcaaatcctaaaaataaatttggatatataagattcatctcgaggattaaggttttttttacagagggagtatgttatacatctctactattataaaaattgaagatgttttgccagtattttggtacgttattcgtgtatgagtcggttttaagtttgtttgcttttggaaatacatatccgtatttcagttggtttttaagatagttcacttttggtaatacaaaaggaatcatataaaaaatctgtttaaaaaactcacatgttaacttgagacaatcggactcctatctgtagctcatgattttctaaaagaatatatatgcacgcaaacttccacagtaaatttcatcttaaataaaccatataacaataataagattaaaatagacttcacccgttacaacgcacgtgcattttttttctagtaccataaaaattctcagtcatccgagtaaacatatctaatttttactactactaaattggttgtactagatggttgaacgtcggggattttattggcttgaattcctgcacgcatacatttcctaagtttccgataattagttgacaacccattttccaggcaaacgttaaatcactagtgctggaatctgaggatacatttttggagaagtcaagggacatgtttgctacacgcgctgagtcaccgaccaatgggacccacccctagcccggcacgtcggaaggccactaccgcagtgtgcgccccaaaatcgccgccgtcccccgtctcactccccgccgttctcctcctcctccgccgccggcgccgtcccgcccgcccgtcggcaccgcccacatgtgggagcgcggcaggctaccccgcaagccgcgaccgtcccctatcctcgtgccgccggcgccggcgtccccgccggccccgccccgccttctcgccttcctcctccctagatccctcctctcgctcgccgcccgcgccatgccgtcgcgccgcccgtctcccctgctcctactcctcctcgcgctcgcgctcgccttccttttcctgctcctctacccatccgcgccctccggctaccacctcttcagatccctcgcctccgccgccgccgacgtttccactcccgcgtcctcccctcccgcccccgtcaagatctacatgtacgacctccccgccaagttcacctacggcgtcgtccgcagctacatggcggcgcgcgcccggcgggggcggcgggcgcggcatcgccgattcccgacgacgagctgcggtacccggggcaccagcactcggcggagtggtggctcttcaaggacctcaggcgccgcgggccactcgaccgccccgtcgcccgcgtcgacgacccggccgacgccgacctcttctacgtgccgttcttctcctccctcagcctcgtcgtcaacccgatccgcccatcggcggccgccgccaatgcgtccgacgcggcggagcccgcgtacagcgacgagtccacgcaggaggagctgctggtgtggctggagcggcagccgtactggcgacggcaccaggggagggatcacgtgttcatctgccaggatccgaacgcgctctacagggtggtggatcggatcagcaatgctgtgctcctgatctccgacttcgggcggttgcgtagtgagcaggcatctctcgtcaaggatgttatcctgccctacgcgcaccgaatcaactccttccaaggcgatgtgggagtcgaaagccggccttcattgctattcttcatgggcaaccggtatcgaaaggaggtgaaattcttaaatcttgggagaaatgtgatggcttgatcaattaatttgcattgtacctatcatagagcatctgcattttcagaagggatattgtatgctatagagtagagagtgaatttttttgccatatcctagataacattagcattgaattttattggtggttatatgattttccagagcactccaaaatcatgttaactttatgtcttaagttgatggttctgtctgagaatttttaggcaatcagaaaaaaaatgaagcttaatatgccattagctcattatatattttttgttaccatgtgcctttgatttagcttgtttagatgagttttcttacatatattataaataggaaactatcacaaatgtatcatgtgcaaacacattaattgatatgagatgattattaaaaaaggtgtgattgatttttcagtttttacatgcctccttctctagcgaacttttggttctggatatatctgttgactggtcaacaacctttcttttagaattcaagtcaaattgcatgatagcttccacattttgcaagccatattcacttagaaagttctagcctttcatgcacgttcttgctgattgattatttttggtgttctgttttggagagatcaactctcaacatgaactcgtccattcctatatttttctacttgtcctcataattttccttctttcacacatgcaaaactaagttggaaggcatgtctcatactattaatgactgaagatttctgcacatgccctggagcctgggcatatttattgattggtcaacacatttctttcataattcaaatatgattgtatgataggtttccacagctttgcaaaccataatatttagaacattctagcctttggtgcactttcttagctggcccatccattagtttttcttttaaaaatcaagtacgattccatgatatacttctacagttttgcgagccataatcttttagaaagttctagccttccgtgcacattcttgctgattgatccattagtcttctgttttggagagatgaactctgccaacatgaactcttttgttcctatttttgtatacctggtcctgataatcattcgtcttctgcacatgtaaaactttaatgtttgaaggcatgactcgcagcatcccattgctaaagctttctacatgtgtacctaattgtataaactatttgtctctctctgttccaatatagttgtttggaatgagtgcactcaatcttggtttggaacaacagagaagttaagaacagtatcatctgaagcagtaagctttggaaatgaccaattatggaaatgtaaaaatgtttgattcatttgcataattgttcatctttgtttccttgtgagttttaagattgttaggccctgtttaagattatacatatgattcatattcatccttccctttatttttgctgtattatttagagcactgctacatgcactaaaattttcttacaaagctcttactaacaaatttctcaaccatttgatttaactagatggaagttacaaaaaatctagatttacttacagcttgccacatcagagtttgtaagcattttgtaagaaaattttagtacgtatagacttttcctattatttatgttattgcctacagagtttactgtcagtctgtcattttcttttcttcctttcacactttgtttatgaaataacatcttatactaaggttgttaaccttctgataatttagggtgggaaggtgcgtgatacgctgtttcaagttcttgaaaatgaggcagatgtaatcataaaacatggagcccagtcaagggagagtaggcgtatggctacacgaggaatgcactcatccaaattctgcctccatcctgctggagatactccctcggcatgcagattgtttgatgcgct

SEQ ID NO: 4819 - DNA, 6948 bp, Oryza sativa
acatatgatattttggcacgttatagttttataggcatgttatacatatgatattttggcacgtttgtcttaactagtaaaacctgaaattttgtttcaggtaaaacattattttgagtatgaagatccaaacggaccagtgaatcagatatggcaccaagtttcttcaaaggcaccattgatcaagctgttgattaaccgcgataaacgcctagttgaaagaggtaccaatggaacagattgctcgtgcatctgttcgaccacgaaggaacttctacgtaaataagatggttctcatctcctggacgaacccaagttttgtggacgacccttctgattgagtacagtacctgaattttggctgacgctgagctctgtaactatgtgcagcgaggatcctaacaatttgttttgattgctaagcgcccatttcctgctgatttttcttcaattttcagtagatattagaatgttgtgaacaatataacaccactggtgcccctggctaaagcagaagtatatcattgttttcttttgtacgtgtgacttatatacatcctacattcctttttctcccaaggatgttaccctcaagtttacatgcctctgtgttacccaatcgaattgtgcaaggtacttgtatacatagaagcaacagagacagagggcctcatggaggctggagtgtgacggagagccacaaagccccatgagcagctgacactgctcggtgtgcttcggcgtgcgagaagccgtcgagcaccgagaactactccgaatgtgtgaagagaaattatggaaaagattaatatgattttttttaaaacaacttttctatagaaacattttagcatcgtttagcaggttagggagggtgaacgtggaaatcgaatactttctcttctgtcattcaaatgaacgcactcttagttattcataaaatatatgaataagataatttagttaacaccattcaataataattgtcagactaaaaacatgtaataattacaattttacaacttttagcacagagaaaatttagaaaaaaagcaagagttcaaataaaaatacaatttaaaagaactgcaatttgaaataaagaataaaataagaatacatctaatccaacataagattaactaaaattcagaataaaaaataaaataaattctgaacttagttttttcaacatgaatctatccaaaaatcagaatcaaaaggatcattaaaacttgaaacaaaaatatataataaaaataaactagtaaagacaacttaccaagaaatacaattctataaatatccaaaagtaagattaaatacaatttggaataaaaataaataaattccaaaactggatcagataaaaagaaaaataagagttcaattagaaatataatttgtatacaaatgcataagttatagatcatgcatgctcaaagtaattttagtgataaaacaacttaaagaaatgataattacataatttttttaataagtcgaatggcaaaacttatgtccaaaattaacagtgttatttattaaaaaaatggagatattatttaagagttttcccacctagaaactagcgacaattttttttagcaatttccttcgtgtaaactagccacctccgtggtagaacggtcacgtacgtaatgaaatgcgtgatgagccttggcgtgtggtgtattgtaccgtgtacatgtccgtcgcctcgttttttaaaagatatatatatatatacgatttaaatcttacaatttttggcgttccttccggtacgtcctccgcgccttgttattacaggctctgcctgtacatacgtacgtgttggtatggacatggccgcagccgctgccgtctggttctccgccatagccgccgtccttctggcggccagcaccatcgccgtggtggtggtggcgaagatgacggggaagagaaacggcggtgcggctgcagcggcggcggcggcggcggaggcggagctgccactcccgccggtggtgagcggcgtttccctgataattccggtgatcaccaggggccccatggctgtggccgacgagctgtacgtgaagctggggagcgtcttcacggtgagcttcctcggggtggtgaaggcgaccttcctcgtcgggccggaggtgcagggcggcttctactcgcggccggagtcggaggtccaccagggcggcacgtacaggatgacggtgcccatgtttgggagaggggtcatgtacgacgtcgacgtggccacgaggtcggagcagatcgccgtctgcttcgaggcgcttaggccgaccaagctcaggagcagcacggtgaccatggttcgtgaaaccgaggtgtgtacgtatacagtacctccgtttttcatttgatgatatcgttaacttttaggtatgtttgactattcgttttatttgaaaaaaatatgtaattattatttattttgctatgagttattttatcactaaaagtattttaagcactttttatgtcatacatttgcataaaattttaaataaaacaaatggtcaaatatgtatctaaatgtcaatgcgtcatctattaaaaatagagggattatgctttgccgctcctcttcgtatgacttttttgtgactttttgatgctggttattagaggggttagaccaaggttttaaatctctgtttataactatcgatatttcttcgatgataactgtttgagtaggatatagttatttgctcttatttatctcaccattagtcgtttgaaaggtcgagtgctcaatatcttaacccttttaccttttttgaaaaacactaggctagatagatgccatatcggattgaggggttattattggagatttggaggggcattttttttagttattttttttctaaattttttggatggtgaggctatatgaggtgctcttgaagatgctctccctttatgtccgagtgattgaattgtataatttgcaacacacaagcttgcttttacagaactcatggacttctttacttatatcgtataattcgcaggaatatttcgcgaaatggggagagcaaggcacggtggatctgaaacgcgagctcgacctcctcatcctgacgatcgcgagccgcgtcctcctcggcaaggaggttagggagaccatgttcgccgacgtcgtggcatccttccacgagctcatggacaacagcatgcacctcatcagcctctgcttccccaacctcccgatcccgcggcaccgccggcgcgacacggcgtccgctaggctcaaggagctcttctcccgtgccatccagcttcgccgcggctccggccgcgccgaggacgacgtgctccagcggttcttggagtccaggtacagggacggccgcgccatgtccgacaacgagatcaccggcatgctcatcgccctggtcgtcgccggccagcacatgagctccagcgcgagcacctggaccggggcgttcctcctccgcgaccccaagcacctggccgccgccgtcgacgagcagcggcggctcatcggtgacgaccgcgtcgactacgacgcgctgacgacggggatgagcacgctccaccgctgcatcaaggaggcgctccggatgcaccgggcggcgccggcgctcgtccgcaccgtgcgcaggggcttcgccgtgtggaccaggaaaggaaggagtacaggatgcgggcagggcacagcgtcgtgtcgtatgccgcgttcaaccaccgcctcggctacgtgtaccgcgaccccgacgagtacgacccggagcggttcggcccggagaggaaggaggacagggtcgccggcaagttctccttcacggcgttcgggggcgggaggcacgcgtgcctcggcgagcactacgcgttcctgaagatgaaggtaatatggagctatttgctgaggaattttgagcttgagctggtctcgcctttccccgaggttgaactcaacaacataatgctagggccgcgaggggaagtgatggttagatacaagagacggaagctgacaagcacctagtgcattaagtcgtaattacagtcaaaattatttgagagcagacgtactctttactactacctccgtctcaaataagtgcagccatggtattcgtatttaatatttgatcgttcgttttatctaaataaataaataaataaatataaaaaaatagtcacgcataaaatacaattcatgttttatcatctaagagtaacaacaataaaaatactaatcataaatattttaaaaataagacgaatagtcaaacgttgaatatgaacaacataaaactacatttattttgaacaacataaaactatatttattttggaacggagtgagtactttcagtcataaatactgtaactgagagtctcttccatgatggaacgtgttttgcagtgtgttttgcgtgcatatgtagtgtgatgtataagtaaatctttgagatagcaaataaaagaacaagcaagttctcacgacgaatttagtcagaacttcagagatggacagtgctgcacctcaatcagcaaaattgggatatatgcacctcggtggaggagtggtggtacctatactctcgcacaaactgccaaaccaaacaaaggccctagaatccttgataatcctcatctcttgggagctttggtgcgagcgcaatgtaagaatcagtagtaggccccagcagcagtgactgcaaagataaaataagaaataaccgcttgggtccatgtaggggtgtctagtctgcaagtgtttaccgttctaggagaagtcccataatatgctctcttttacggtcttcgtgttgcaaaggtcctatacatatttatttttcatatatcttctgctctattaatatataagagccaaaatttttgctctctttttttttttaaaggaacaagcgagaaaacatcgttactgtagttgcacagcgcgtgcgatttctccacaggaaggtgaccttcttggttggacctgaagaatcgagccatttcttcacagggttggattcagagatcagccaggacgaggtttcccggttcatcattccaacctttggctcatgagtggccttcgatgcgagcaggaccagccctaggggggtcaggccgtgcggccgcccgaggcccctaaaatctagggcccctatacacatatagtatatatatactatgtattgtataattttaattcatagaccataggcttatattaagttagacagctgaataacccaattcagaaaatgaattttagtctatcgccaggcatgtttcagcgaagccgaagcgatattcatctgactcccgtcgcttcgcctcgatcacatcacgccagtcgcgtcgcgccgccttgatcacatcacgctactcgctgctattgcgctcgcggcaacttctcggtcgcgtaaatggaaacggcaagtggacacagcaaatcgtagctcgccagtagccacactcatgtcaataaggacctccatataagtttttgccctgggccccaaaaccccaggaccagccctggatgcgggttatgccacgcagtaagagcagttccggttctttggtgatacaatgaagccgaccaagctgaggagttatgtaagtcacatggtttacgaagtggaggtatgcaaaaaaaaaaaaatcctactccgtttatcttaaaacgcagcaagttttagtctttgacacaggtattaaggagagggtcgagtaaaaaacatggttaccttctcggggtaggtaattagttgtggatataataaagccaaggaatagtaacagtagataaaaagagttacatattatgatagtttgtgaaataataaatctagtaacatcaattttacatgattgatctttttaattttttttgctattaatagttaaatttgaaaatagttgacttagcattattcaaagatacttttattttaggacgaaggacgaagggtttacgtcgtttctaaagttgtgaggagtacctttttatagttagtggaaagtcatatggctcaattatcaatcttgtttttttttttgaagaaggaaaatcgggcccgaaagccatacagctgcatggttaattgcaggaaaaccggttaaaacccaccgctacataactaataacgacggcggagcccaattgcaggttgtcgccaccaaactaaacacaaaagcaacacaacagcccccacatcgcagaagatgtgttatcgttgccgagttagccgcccaagcgacctagcagcaccgactccacaaccgcagcgatactgaagccacgaaagtcgccacagcgaaaagtagctccgacatccaataatggacatcagccaagctaccgaggagcaacttccttcacacggccaacaccagaactccttggaagagactgcaacatgtcatcgttgccgagcgttgccgcaccccatcagcgagtagcttcgacttcatcagtagaaacaaccgaagagcatgtcgcccaccacaagaaagaagcggacccaagaagacgaaggcctcgccgaacactaaggtatgaaagcttttgaaccgaaaaagaccatcgacagtcgtcgatgcgttggagcttcggacaatgcgtgcgacgcccccaaggagaacatgacgatcaatcttgcttgatcttatataacttatcataagtgtttaaataggctctagaaaatttatgaatcctgcgaaacaaatgcaacgtctatattcaggggcggatgcaggcctatgacagttatgatttgagccctagacttgtctccaaaagtaagcttatatttctcaaatcagcatgtaaattttaaaagagaatcttaacagtccattggttagaccagagcttagtcccaagtctttagtagtttctagctccgtcactatgtgcaggag

SEQ ID NO: 4820 - DNA, 3320 bp, Oryza sativa
catgctcgtatcggcgctcttcgcgggccagtacacgagctccagcaccagcacgtggaccggcgcgcgcgcctcctcacccaccccgagcacctccgcgccgccgtgcgggagcaggaggagctcgtactcgtgcggcaccggcacggcggcgacgtcgtcgaccacgatgccctgcagcggatgggccacctccaccgctgcgtcaaggagaccctgcgtctccacccgccgtcgctgatgctgctccgccacgcgcgccggagcttcgtcgtgagggccagggggagcggcgatgccgagtacgaggtcccagcagggcacacggtggcgagcccgatggtgatccacaacgcgctgccacacgtgtatgaggacgccgggtcgttcgacccgggcaggttcggccccgcgagggaagagtacagggcgtacgccgccgaccacgcgtacacggtatttggcggcggccggcacgcctgcgtcggcgaggcgttatcaaggtgatctggagccatctgctgaggaacttcgagttggagctcatgttgccgttcccggagacggactggaacgacgtcatgccagggcccaagggaaaggtgatggtactccctccgtcacataataagataataagcgtaatcgtgggttttagtgtccaactttgatcattcgtcttatttaaaatatttttataattaacatttttattgttattagatgattaaatatgaatagtactttgtgcgtgacttaacttttaaaatttttataaatttttcaaataagacggatggtcaaacgttaggcacggaaacttatagctgcacttataatgggacggacggagagtaagctacaagagaaggaagttgcagacaaaagaacgaacatttcatagaagctactacaccttatcattcaaaacatttgatataattgcctgtgcttgcctaagtgttcaaatcgttgggatatatagttaaccctttccttaggatgtcccgaacaaacaaatgctcgttcggtaatgaatatgccgagttagagagtacgataactacaaatggcgacacaggtggaatcaactggttaaacatctcaatttccaaatgcctctagttcttgagttgagtgtttccagtaagcaaatctgctgtcaaaaagtgacaatgggtagtcaggtcaacacaattgtacatgcctgtagcaccaacactgcagccctgttgaaaagaatatatatctacaatgccaccattttatccccccaactaatttttgggcaaaattcaacaatatactactagccatattgtcgcccattaaactcatgaatttcttctgtatatgtattctaacccaaaatgaagctcttcgtcagaacttcaacccgctacaaactataaaacatcaaggcaatgaagacagtaacggttaaggattctctcaacaagagagttgggttcaggaaccagcgaagaagtaatgctgttccagaggtggaaagtagtagagtcatttacaatcctagaaaacagagcatcatgttgggctctttcatccgtgctatctgcttctgagaagtacctgcagtacatggatatcataatgagagtgcatattgcaaatttgtagccacacatctaaagagtcaacaattacttgaacaacaaaaatatgtgaaaggttgacttttaagttacttgaacaacaaatatatgtaataggttgagttttaagagggctggggtgcatctggtttatctctagtactgtaaaagcggtgtagttgtcctccccaacaatcgcacctcccccacataaaaaaaaccaccccacccaaaaaactagtgttcccatgcgaaaattgacccatcagaaaaaccggatacaaaaaaccgaacccggtaaaaccattcagccatcttcctgagttccttcagatcaatggcatgacactaataggttgaacttggctagtgaatagagttcagtttttcttttaaaaatgctcatgcgctacgtcaacaatgtcgcaaaaggagcagagcatccagtgcagccactacggcttgatgtgggaagggagagcttgacccaccaacacaagcttcaaggctgcctgtgttgacctatgtacacaggaaatcaagttgcagttcattaaattgaattgacaatttgaacattctatgactattacagtttaattttggttagttcaaatcaatggttacattcaactcagttcaaggactgttgtaatgcaggtgaacgatcatagctctaggtaacactaactggcaaccagaacaagtgtcaaagcaaaacttccctggaattgagaggcactataatctggtgagaggtggctgtaatagaggtgtttgatggccacctcatagagtttggaaatggttgaagggggaaaaacagcatgttacaggcaagagctaatagcaatgacaagaggattagaaacaggtccaggtttggtttgtgcatctctcagtaaaactagttaacatgtgatagcatggtgacaaagtgcaaggggcttgcactgaatatcactgcaacaatgacaagctcgtgagccttgacctcccctctctgtgtctgcctcatagtgattttcttttagttatcttaaaatgaaacattgcagtcggaagagttcaccttgcggcttgggaagttgagatgggactttgatgtaccaacaaacaatcttaaaatttaatactgaatatcaatttcaaatagttaaattgaagcaaacaaattcagcataccttgtaatatctgttgagcttatgggataaaatgcaacagaaggttcaaactttatgtcaagatgcccactgttgtcatctgctttgtcggacatatttctgattactcttgtcataagttcagcaccattccactgcaagagttcatcatcatatgttgaatgaaattccttcaggcactccgctaagaaagggctgcaattaacataagttaggtgaaaaatacatgattgctatgattagttatgcataagcatatatatacgcctgcaaagttataatcaacaaaaagaaaccaagatgagatataaaccttgtgtacttgagacctagttatttatacccattatattttgtgatacttctagaatactgttcatgatccatatactaattcatagtacaactgtaacaaaagaaacaaaccaaaataatagcagcaacatgtttttttcccttttttttcctaaaattaaataaaacactaaaagatagtaatggactttatctgtctgttgg

SEQ ID NO: 4821 - DNA, 32127 bp, Oryza sativa
  unsure (1)..(32127): unsure at all n locations
cgagtacttttaccaaatctgaagactgtggagggctgaaaaatatagtcaggtgcatcgaatagatgcacctaataggtgtagcccccgactatgtggttaattgaaccaaccaaacatatagtcaaggaataaataatctaaccaaccgagtggttttgataattgtaatcaaccaagtgacttgatatcaatgtatagcatatgcggtgtgaatccccgaataatatgatccaagtgatataccgactgcttggcaaaatatgatgcgtacaacctaaagttgacaacatctttgaaagttcacatagcaaaacaactataaagaagcttgaatgctgtgaataaagaaattttcaaagtattgggcatacgccatgcgcacactgctttaacagatgtgcttaagtccataaaagacacattgtttcaccacacctggaaatatatggcacatgtggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgctccaaatcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcatcttgtcgtcgaatagttattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtagtaaaacttgcgaagtagcaacaatagagtttgccggtgccgaagataataaagatgaagtcgctccaccatgatgacaaagttgtattgccgtaatgaagtgaacacaaatcggcggcaacagaagcaaaccggtagtgaagacgcgcagttgtgaagataaaagcaccagtcggaggcggcataatcagtcggcgacggaagatgatgatgtccatcagtagtggtagctgtataaaccagacgtagaggtaagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcgacggcggtcgaggcggccggtcggtgaagacgtagacgcccaacaatgacggcataataagtcagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggtggcataataggccagccgtgcaggcgaaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatgtgtatttctcctcttgtcaattttgatttccccgagcagatgattcattacgtttaaacgctctgtccgactagtcatagcccccaagcaccgggagtcggcctaggcacttcccagacatgcatatgagtgacatgagttcgccattaatggaacaaagtttcacgaatcagaatttactactcgggtacttttgcaattattaagagcagaaaataaatttatctcatctctatgcttttgatttattctgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccctcggtgacagcaaaagtagccgatgtgggaacgaagcagtccatcgatggtgacaaaaacaccagtcggcgccagtggaaccaagccagtggtgtagatgatgaagcccattaacggcggcgaagtctgccaaccgtataggcaaaaacaccagtcggcggcggcgaaggccagccggtcggcgaagacgtggacgcccatgaacggtggtgtgaccaaccaaccgtataggcgaggacaccagtcggcggcgacggaggcaggccggcggtgaagtcgtagacgcccaacagcagcggcataataggctagccgtgtaggcagaaacaccagtcggcggcggcgaaggccagccggtcggcgaagacgtggacgcccatgaacggtggtgtgaccaaccaaccgtataggcgaggacaccagtcggcggcgacggaggcaggccggcggtgaagtcgtagacgcccaacagcggcggcataataggccaaccgtgtaggcggaggcaccagtcggcggcgacggaggcaggccggcggtgaagtcgtagacgcccaacagcggcggcataataggccagccgtgtaggcggaggcaccagtcggcggcgacggaggcaggccggcggtgaagtcatagacgcccaacagcggcggcataataggccagccgtgtaggcggaggcaccaatcggcggcgacggaggcaggccggcggtgaagacgtggacgcccatgaacggtggtgtgaccaaccaaccgtataggcggaggcaccactcggcggcgacggaggcaggccggcggtgaagacgtggacgcccaacagcggcggcataataggccaaccgtgtaggcggaggcaccactcggcggcgacggaggtaggccggcggtgaagtcgtagacgcccaacagcggcggcataataggccagccgtgcaggcggaaacaccagtcggcggcggcgaaggctagccggtcgatgaagacgttgacgcccatgaacggtggtgtgaccgaccaaccatataggcgaggacaccagtcagcggcgacggaggcagccggttggtgaagacaatgtcgccaccagcaatggtggcagagtacaccagccatgtacgcaaagaagccagccagcggcgacgacagcagccgacatacatgcataaacaataacagatcaaacaataattagtaatctgtgaattaatctaatttgcgaaagaatttaaaacgataaacctggcttgtaatccaagatttttaatgcatgtatgtcatcagcggtgtatggcttgcttgattgaatcagagactccagcaaaaaggtcgctgcgtgcatgtatctgtctaggtagatcatgcacctgcatgtatggcttggacagaagtggcttgatcgatgcccttgtgcgacaattgctccaatcagctgggttggagtccatatcgattccgaaattgaatctcgccaacaaattttgatgtcgacgaggaaagacgccgatgcttcagagctttgcatgcatgttttctgctgatgcttgatctgttgcttgacagcacatggcgacagatttgatctcattgcataaaatagaattgacaggaacaactacttatggaggctcataatagctgttggcttcaaatcttttgctgatcaagaacaaaactcggtgactgacgtccggtcttgccgatcaaagaaaagactcggcggcgacggtgattggatccatcgccgagattaatcttcccggctagattggatctgagttggagaagaaaagcttagggaattcgtcggcggcgaggaagttgcagctcccgaagtgaagacgaagccggcgactcgtaaagttgattccatcgcgcttcttgatagataactcgacgcaacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggagggcaggattacaagatagaaaccttaaccaacatggtatcggtttcctaaatctactttacaatcttatcaaaccaggactttaggccgttccataatatacagggaaacgtaatacccaagtcatgatctgttacatattccatagatataagctatcccctaagactagtcggataaccatgtcgtgtgggtatggggtacccataatctccacacaaatgtttcacatttttaaatccatacattctttagaccatggaattaagaccaatgctttgaatttcactggagaattcttgccctagttataagattagattttgttcgatgcataactatggtcaccctctaggtgctttaattttagaataaccgtgcaaagactgttgaatggcctgtattagatttggaatagtccacgcatgccctgaatggttgacactattccaacatttccgtttgcacttggcagtcaaagaatgggctatataccctatactaacagtcgcatgcatcatatggaagttatcttcagaaaaacactcctgtttaatttgtagtgcatataagtaacatgcatgcataagcttgtatttcaaattaatttgatagttttttattgcaacctgatttaagtttagtgtggatttttacatgtacggattcacctaaatgtattttaatttttatgaatgcctttgcacattagcttttttatatctatactagcttgtagatatttgccaaattacaatactttgttttaagttggaataactttttttctctttcacctggcaaagcatgagtgagtgctgctacacatcgatactttctatatagtcttctatatagtcggtacccactaacaattattaaaagttaaaactcaacatgcaagtatgccacatcatcacccactagcaattactattctagcccatttaaaatcctatacaagcatgcaacatcttcactcactagaaagtactattctagcctattttaaatctcatgtaagtataacacatcatcaacaagcatgtgtcaaatcatcttactcacattattttttcaacatttcaactttcatcatttcgacaatatttaatatatacttatccataaatctcgcagcaaagcgcggggtatcacctagataatatgttggttgacaaggcaatggcatatcatgtagataagaaaaaagtgagaaggtacccacctaaatatctttatgttgtcacttccaaaacggtaattccacatgagtgatgacggntcgagatgaaaaaaaggataggttaacactaatcggaaaggcgatgacgcatagataaggaaaaactcagtcactaaatattttttgtttttttactatgaaattacaatntcacataagtgacagtgatctgaaaaataggtacaaattaaaacactcagctactttatttcttaatgctttcactctgaaattctaacttccacatgagtgacgatgatcgaagattaaaaaaaaagtagaaacaataatctcttggtcgaaaaggcaacggtacatggctaaaaatatcagccacctagtttcttaatgtttccactttgaaactgcaacctccatacgaacgacggtgataactttgataagatagtatgttttttataatatttttttagtttattgaagtagaagtggctaaagtttactaaatataaatggcattccgagactagcaatggaaaatggaagcacgtaattaatgaagccgtcacggtttgcgactgtatatggccgcctgaaactgagagcaaagtggcaccagttgtcgatcacgcgcggggcggccttgacgctatattggcaaaggttggtgtcgcatactggcacaggcacagcaatgcatgaccctacgcgaagcgacaggaggtcacgcacggcgctgtccctgcggccttgtcgcggtccacgcgacgtgcaccgatcgatctccaactcaccgtggaacgcgacgtcttccccttcctcccgacctagcttgttgctgctgacagagcgacaacgatataacgttgaaacaagcacagaattcgtcgctacgaacaaatcaatatcaattctcgggccaagaccaacaaaaactgtaaaaaggaaaaaaaaacggattggagaataacattcctcggctcctcgatcgctgattcctcgtaccgtcgtacgaatatatacgaccgagtcgcggtcgagaatcccggatcagattccacttaaccaaatcccgttcgacgccctatccgccgcgtcatctcttccgcatgcatgtccgtgcgtttcaccgccaaggcagggctgaggcagctaccggggtgaacggtcggaatcggtaaaccatatttatcattcaaactaccctgtatcgatattaatacgatagaaaaaaatttaaaaaataaaatttaaaaatagcagaaaatggtacggttataaacaataccccttatgcagaaacggcgctcagtcgataggaatttctgtgaccgttttcacccgctacatacactgctcgaactgttctcttgtttggcgcgtgcgcgctagcgagagcagagtattagtcgaataccacgaactgctacgtaccgcgcgtttatctcgtgctagatacagagcattgacgccttctgccggtctgcccccccggccccgtgcacgcgtgcgccgccccggtcagcgtccatctctgagactctgacgacgacgacgccgccggcgacggcaccggcgccaccgatccatccatccatccgtgcatcctactgtatacttacctgtctctcgctgccctgcactgcatacgtccgcgcctagctcgatccccgcaggatttctctgtaggtgacagacgccggtttgtctggacaccccctcgcggcgcgccggtgcgtgcgtcggtgcgtgcgtgcgggccgtctgcttgacgttttgaccattattcctctctgtcgatcgtgtggtcagtgcgcatgatctaagattaactgaggaaggactcatcttgtgcgttgacagcgttgtccgaagcccccggacagaacgggtctaagtttgcactgttattttgggaagttgtaaagcagcttctgcatgcgccacaactcaagcttgtcagagttagtgacggtggctgctttgatcttgtactgctccgtacttgaggctcaagaggccggcgaagtaccgtttcctgtttgcatatggaaatagcagttgcagtaggaaagggtaaaatttaactgtgcttctaaaaggactttttgcatgtcacagtttttctgtcttccatgatctagtctacgaatgttcagaacttcctccgtttcacaatgtaagttattctagcatttcccacattcatattgatgatagatagatctatctagatttattaacatcaatataaatatgggaaatgctagaatgatttacattgtgaaacggatggagtaatatcttattgctgatcggctgcaggcgcgcttgtgtgaaatgtaactccgtctggtacgagaaaaaacgtgacagcaaaacaacttgactgacaaaggcaacataagacgcggtcctgacaaatgtagtggcatgatgaagttcagaagaatttacttgcaactaaagcctgcattgtcacgtccaccgaagtgcaagattttcttttttactgtgatgtatgcgacgagaacacacgccattgaaatttgtatgaacccattcacctgttccagtttaattccaagcatgctcgctctgacaattacaatctgatgtggctcagacaaagctcccgttcctccggcagtccagccacttgtacacggttattggctatctacacacaataatcaaactgagcagagcaaatcgaagaaagatataggaaacaggaaacaggaaactgttgcattaattaatatctgatataattaatccatacttcctccgttccaaaataagtgcagtttttcactatttatatttaatgtttgatcattcgttttatttaaaaaattgttatgattagtatttttattgctattagatgataaacatgaatattactttatatgtgattattttttaatttctttataaattgtttaaataaaacggacggtcaaatgttggacataaatatctacagctgcacttattttgggacagaggtagtacttgcttttattctacttctagttcccacttgtatactacgattccctgctcaatgggtaagtgtcgaatcctgaatttttctgaaatatcaaattatccgaattttctctgtaggttcagtccatctgttgtttctatttcccacggagcaacagaaatcgcaaagactggctgccgctgtctgaccctctgactaatccaatccagagagtgctagtactatctccttcaacattaattcgagtttaggatctgttcataggtcagacacggcgaacatttctattagccatggacaaaaaaaagaagcacgcagccatgttcaaggggaaattttgactaatctctcgacacaccatcaaattggccatcttattcttaattcgtgaggtccgtctcgatcaagaattgacaggatcaaaggtcaaccaaattaagggaagcatgcagcagttgctgaatcgctccaaacgcagccaagtcattaatgtgtgtacagcattctgcgttttttttttcatgatcagccaattattattcgttgcccgtgtaatagttgcaacgggcatcatcggcagtcaatttcaggtcacaaatctatgaattaatggggggtagctttgaatttccgattacgacggttcttgcatctagaactggtcttatccagcaatcagggactcatgacagtaatgttgcaataataattagtatcctacttagttaatttatttggaagaccaattaagcagaaatggacggaagaaattcaaaccttcaactcggcgacggcgagcaatttaggaataccaggaaagttttcatcagtttaattattttatatgcagatggatgaacttactctgaaacctgattttctgaaagggaaacagacaaaacagaagattaagaacgtacatatgtccagaaagcacacacattaaactactttgtgcatttgtcggtgtcgcttcgcaccgattagaccggagttcatcaatccgcaattatccgtgctcttactcctcctgcttatctagaaccaaaatccagaagcagcatttgtccgaaattcaaacccactcattacagtgtgtgaacctttagcatttggggtcatagttctattaaaccgtaccgtgtctcccgggtatatcgcagagatagaacattctattggtaatttggtatgcaaccagtcacagtaaaaaacaacggaagaaatgataataatcaaaggttacacgctgaattttcatgctaatcaacgtccaaaaggttgtgctttttctcagggaaaaaagttaccagtatacttttactcttcgactcgcggcccatggcctaaactgcttcgcgttgtccaaagcgagacagtgtcctaaacgggccaacacaaaaggaggcctagtaagccggtgcaaattgggccagaaaagacggtggaagaggttaccatacgctgggccgtgtgtagcccaggaaatgggtggacgttggcgcgcgaggggcgggcgggcgggtggcgaggtgatcgatcgacacgcggtgggggagcggcggccggcatacgtgtccagcggcgacgggcccgtggcggccgcgttcggtacaacggagccgtatttctcggggccaatgccttcggcgcctctccccacaccgcgcgccgcgcgcaccccccttgcctgccttgccactgccagcccgcacctcatccatcgcctcctcctcgatccctctcgctcgctagcttagcatcctgcatgcatgcagcgcagcggccgaaaccgcccaaaattcccagcgcagatcgctcgcctgccttgcctgcccgtccgcctaaccgacaccgcaacaaaccacagccacacagcttctctctgttgctcgctttactgtgcgtgctgtatatacacccggtggatgagggatctagctaactagcttagctagacagcgtgtgttggtggtggtggtggtgtgtgtgtgtgtgaggagggtgatcgatcgatcgagcgatggagagcccggactcgtcgtccggctcggcgccaccgcgagtactacggcggcaacagcagcagccgggctcggcgccggagctgccgccggggttccggttccacccgacggacgaggagctggtggtgcactacctcaagaagaaggccgcctccgttccgctccccgtcaccatcatcgccgaggtcgatctctacaagttcgatccctgggatctccccggtacgtaatttaatcacttacacccataccaatcataaattaagaatttattattacagcttatatatactattatcatgcatgtatattatctaaaaaaaatcagcccaaatctccatatgcatgtgagcatgctagcttggatgtgtagtgctcgatcgatcgatcgatcgatcgatctggtgtagtttacttgtttgtgcgatttatgcgtgcatgcatcggtttgtatcagagaaggcgaacttcggggagcaggagtggtatttcttcagcccgagggaccgcaagtacccgaacggggcgcggccgaaccgggcggcgacgtcggggtactggaaggccaccggcaccgacaagcccatcatgtcgtcggggagcacccgcgagaaggtcggcgtgaagaaggcgctcgtgttctaccggggcaagccacccaagggcgtcaagactaactggatcatgcacgagtaccgtctcacggacacgtctagctccgccgccgccgtcgctacgaccaggcggccgccgccgcccatcaccggcggtagcaagggcgccgtctctctcagggtacgtacgtatatacgtttgtgcgtgacagtctcgcttggagtcttggactgattgatctgatcaagttgattagtgtctcagctggatgactgggtgctgtgccgcatatacaagaagacgaacaaggccggtgcggggcagaggagcatggagtgcgaggactccgtggaggacgcggtggccgcgtacgcgccgtcgtcgcagcagcatgccacggctgctgctggcatggccggttcggacggcgccggaggagttgctgcagcgcacggcggcgactacagttcactgctccatcacgacagccacgaggacaccttcctcgtaaacggcctgctcaccgcggaggacgccgccggcctctcgaccggcgccagctctctcagccagctcgccgcggcggcgagggcggcggcgacaccgtgcgacgccaccaagcagcttcttgctccgtctccaaccccattcaactggttcgaggcattccttccacgggccaaggagtttcctagtgggctaagcaggagtagcagagacatcggcgacatgtcgctgtcatcgacggtggacaggagcctgtctgaggctggcgccgtggccattgacaccggcgacgccgccaatggcgcaaacactatgcctgcatttatcaatcctctcggcgtgcagggtgcaacctaccaacaacaccaagccatcatgggtgcctcgttgccatcggagtcagcagcagcagcagccgcctgcaatttccagcatccgttccaactctccagggtgaattgggattcctgaataaaaggtgccggcattatgcatacacatatatgcacatgcatacatgcatggcttttcaagtagtagcacaacattactagtaattaatcacactaatgtgtgtggcagtcgcattcagtgagcactgatcgagtagttgcatgaacacaacactaatgcatgcactacatatatatggccgcattgctcctagggcacgtacctgtacgaactaggtaagtgacctaaccagctagatcatgttcagaataaggagaagaagccgcatgcaaacacgtagatcatatggctttgccttcacatgcgtttgcatcatatatatcgcattcagaaagtagtgctgcagctaacacatagatatggtgttagcttcatgcgtttgtaccatatatagcggatgcagaaagtagctagttgcactgttcatcattatcccatgagatatgaactttatatacctttggggttgcccttctaaagtcatgcatctagagcccccctggtaatagcatgcattgatgtttcatgcgcacatatatataattgatatatatccttgtatatacgtaggagtaattcgctgatagaacggcacttacatagtacgctgtactgtacatgtaaacaaaaacttacatattataagaaaaaacgatattatagacacgctgcatagctagattaaccatctgggagaaataaagcatctatccacgatcactcaaaaacaaatgcatgatgcatgtgctagcaacagtatgtattatatatggattgaatcattgaagtgcatatatatatacgtagacgagtttttgtcaggctaaagctagactagttaccaagcccttgtcgatgccatgtgaccatgtcttcccccagcaacatggctgtaacaacagcactaatcctcccaacgatctccgtccaactcgtcgcgagaccttcccttttccgagcgtctaacagcgccacccccgtcgtccgcgcgacaaaccgcctcccagtttcgccgggacagccgtcgcggtcgcttactcgcctcgcgagcgatcgaaagctaaaggtgcatgtaagcgagcgcgtacacgtacgggcgatcggtcggtcgagacgtcggcacgcgcgcatgcatgcggctctcggcgcctttcggccttgtcgtctggctggttccccggttttggatggttgcggtgatggcacatgtagaagtagcgatcgatcgacgacgtggacgggacggggccgggcaaggctagcgagctaatcacatctcggctttggagcacgcacgataataaccccctgctggttcctagctataattcctaatcgatcttatctccagctgcagcgaattgaccgcctttaatcgcggggatagatggtaccgtcgtttttacgcggctcgagcgcgggtggctggctttggctcgtcgtcttgtgtacgcgcgtgacgccgggtgctacgcgtcgccccgcggttcgctggatcgcggagcggttttaacctccagcacgcggtttttgattggccgcgcgctacgtgttgcggcgtggtttgtgcgggggtaaatttgcatgtgcacctctgcgcagacggcgcgcgagattggccggtcaaggatgagtatgtgtatgtgtgataactgtggtaaagctttttattcacctaagacttaattaactcgacgttaaatcatttattgcatacaaactaaataattacaacaaaaaataaaaataaaaaatatattaatgtgtaaaaacatgtaaatctaaatccgactttaccaactgtaacaaaaaataataaattttatacgtgaatatttgttttatattataagttgtttgattttttctaagtgaaatttctttaagtttgatcacatatagaaaatatattaatattttcaatacaaaacaaacatattatcaaaatatatttaatgttatatttaataaaactaatttgttgttatcaatgtttttaattttttctataaatttgatcaaatctaaagaactttgactaataaaaaaatcaaacgactcatgatatgaaacggaaggagactcataatatgaaacggaaggagtataatttaatttgttgttttccttgtaaaagtcaaatttgaacatacatattttttatatttttaaactaatatattacatatcaatttatcttatcaattttctttattttttatagttatttagtctccccgttaagatgtctctatatatccgccgacaatgtgttttgctagcggcgtgtaccgagctcgatacatatggcagcagggactatggcggcgtacacaaagcagttgcccggcaaataaagggaattgatgccaattgtttttttttttaatcacaggatgctctaatctatccatcttttcgctccattttttaatagataacacgccgttaacttttagacacatgtttgatctttcgttttattaacttttttatgcaaatgcataagatataaattgtgtttaaaatacttttagtgataaaacaactcacagcaaaataaatgatagtaattagtaagtgtaggtgtagtatgtgggtgagggcacgagcgtctaatattgtactcaacagcctaagatagtttaacaaggaagatgtttttttttctcatttggtgcccccctcattcggttacattatggagtcattctatggttacattgtggtgccccctctctatttaagagatttgctaggttacaaagtccgattctaactctaaccctaaccatctattacaactccaaatccatccgtaactaaataggactaatatattcgacacatattataacaataaatttaatactgaattacacattctatttaaatttaaatttattattttatctttctaattgtataagttgaatttgaacctgcgtgtttatgaattgatatattaattatgttttagattataagtcattttgactttagttaaagttaaattactttgacaaattttgtagacaaatatattaatatatacaacaccaaattagtttcattaaatctatgattgaatatgtttttatagtatatttgtcttgtgttgaatatattactattctttcctacaaatttgattaaacttgaaacaatttaactttgatcaaagtcaaaacgattatagtctgaaagagagagtaccatatattgatatatcttttttttttcaaaatttcacagtaacattttggatgacatggacatgctataaaacgagaaaagtgtgtagtgcaaatcataaatatagtaaaagcctaaaaactatcatcattaagagtaaacaaatttattccaagtaaaacttttactcatgttgaatttggtagtaaaattttcatcctcggtgatgtgaataaaatattaggtgtccttttaatccaataatacttttcacgttttcactagatatatattgtgctacatattttcacataaaacgagaagacatgactaatatgtgcacattaattttccaacggagaggccttaagggcaggtttggttggtgactaaatttgccgcaccttataattaggcatgtcacagttttagtatgcggtgtttggttcatgccataaatctactttgcctaaccattagccttagttacgtggttcacatgtcatacattttattttgttgtctaacttggctataagcttagtttgttattttgtttgccataaaagtgggttttgctcatgccgtggctctttctgcgctccgtgcacctggcggtggcgaacggatcagcggaggcccaatgcaaaaactagctctgcacaagctcggacggccttgtctccttcctaataattctctgattcaggaatcactgaatcaggatacgatacttctccaagaaaaaaaagaatcagctacgataccgcgtgcactgacgtgaaccggacgatcgaggcgcgcgatcaccaaatcgtctttgacgctattaaacccgcggatcccagctaatcttatccccatctctcgcagtcgcagggcgctataaatcttatctccatcgaccgcgtgaaatgtagctaccggccaatcaacgtcgataaaagaagcgacaaaacaatttttactttgtacctctggtcgaaagcccgttctttttacatggatatcatacggtggatggtcaaagaatctaagccttttttccctgacaaaaattgtgactgatagataggaactgatccacctaaggttgcacctctccatccatgcactgcaactgatatgactggttggcattatctgtcttttgtttctgcttcacctgattcattgatgaggtttatgctccatatctaaaagctaatctcgagccaatggtatgtaaacatcaggggataaaattacactgttcgtaatcagcacaccagggcgggacaagaagggttacttcactgaagaatttgtcccgtatatggcacaatatcggaacgataactaattactctgtttgccttcgttttcagttttcaaatcgactgataaccttcctgcagaatcagggcattttagggcacatgacaagagatggcagattagagaggttgcaccgccggtctgccgaaaccgcaaaagcgagagcaaatcaactaatctctttttagcgcagctaatcagccaatgaagcacgcactagtatgctaatcgatcgattagtagcccactttgtcaagtgcaagtactgtttttcctgtaaaaagtactgttcgcaaagacttgacatgttttgtttggacattggagcaactgtatgggtctgaactctgaagaggattaattgttcagcacaattggtattttaagcttgaacatattttaaatctgcagttattctaataagtaaattacagctacggtgcacgaacttaggtgcaatagaaacaggtgtaacaacctatataaattgttcgcttcagacaacaatttgcttgcgtagtcacatgcaaaccaaagtcaaaatgatctatatacgcaatcaaaacatgcagccaaaatttactaccggatattctgatgttgtggttttagctttagacatgacaaaagttgatgcctagaaaagacactgtcaaaatatttatctccagttaaataggactataggttagaaatgcccctagctagccccaatgatcagactctcttcctcgatctcctttttctccctcttgcaagcgcacagcttggaagagggcaaacaacgcctcggtaccatactaggcaattcggctgtgatggtgtggtatcaatagttcctttattttatcggtgatatctattggtttgtttattcatatgcttatctgaatagattatgagcaaataaaaaatatttctaagtaaattttttatatatgcgtccttagcgataaaaaataaatgctataaaataaactacgatgaaaaactaaactttaaaattaaattcttaaatttaaattttgagttataagcataagcataaaagaaacaatgagccatacagtttgtacgttttgatgaaataatcatacgtgttatatataaaatttgggttctcacaatgataatgatttctgcatggcctctctctagctgccttcagtcattaaaaaataacaaagtttgctatacgggacacccgtaaaacatgtaattagttagggaccatctcactcacagtataattttatggattctctctctaattcctcaaaaataataaaattatcattttttacgatgcccctataacataaacaggttcttactgtatcgctcagctaatttcatgccttttgatatccttaagcaaatttttccttaaaaaagcggatcgcaacagtatttgagaagcttagttttttttaaaaaaaaaaactgagaagcttacttcacacggccataggaatacgctttgcatacacgagatgacgagaagactatttgtcacgttactcacgtactccttctgtaaaaataaaataaaaaaaaatcaacctaggagcgtagtctagattcgttcatctaggaggggtcagattcgttgttctaggaggatcacattacatccctttttaggttaagtttttttttttggacgaaaggagtatgacgtaagcttgccagtatctatgtaatttttttagagtacatctatgtatatatgtgtttttgaaatatcatatagtggtgttcttttcttttaatgatgaagattaagttttttacgcaaaacgatatagtattaacgtatgattgattgagttttaattattacaaacttaaaaaatagatcaatatgatattttaaagcaacttttatatagaaagttttcgcacgaaacacaccgtttagcagtttgaaaaacgtgccacgaaaatcttaatcttcatccaacttttgttggagaaaataacaggagtgctatgctagctgctcaaaggtccagctaacgtagcaagatcatatgactatgagactgttaagaagtaattttcaaaaagagagagagagagagagagactgttaagatgtgttgatacttgatgggcttttgaagtcggtccatacaaacaaggaataagtctattttgccaccctcaacacatgctcttggttaaatctcatccctcaaccgcaaaaccgggtataacccgtcctctaacttctaaaaccgctacaaatcagactcttaggatggttttggaggcggtttcgtcctacgtggtagttgacttgctgaatcatcaagcgggacccacttgtcagcggtctccacctcatctctcctcctctttctctttcatctttctcttctctcaccttctatcgacacagaggcatcgcgcagcaacaacgcattggggaggagctcgtcggctggccgcgttgcgccgcacgcgggggagcagcctggctcgagcacgcaaaggaggcgggagggcgtcggggcatcgtctgagaggggggaataggggggtcgtggaggatgaggcagccaactacgcatggggaggtggtcatcagccggccgtgcgcaaggaagagctcgtccaccgcccgcccgcagggaggatctcgtcggcctaccaagcgcggggaggggcacttcagcatggtggccacacagggaaattcgtcgatcttccacgtcggcccggctcgagcgcgcagagaagaagggtgggcgccggggcattgtccaagagggggaagaaaatggtcgtggagcacgaggcagagcccgcacaggcaaacccctccacgtcgacagcagcgacggtcggcgagcagggaaggcgtgaccctcgtgctccatcccgccgccgcctccgtcaacgccggtcggcgttatgcacctgagagcagagaaaagttatagagagaggagaaagggtaactaacgtgtgggccctgaacgtgcagagatgtagcctagagggggggtgaataggctttcctgaaattttctcaacaaacgcagcggttaaattgacagggtccgaaacctcctggtgatgaacaccggaacttcctggcagtgatgagtagcctgaaacttccgaagttcttgagccagaaactttcgggcaatagacaaaaacgaaatatgagaagtataacaggtcctaactagtgaaaatcaggcacagggttgcacaagatgaaaatcacaagataccagcagattcaaacactgatcaagcacaagagagacataggcgatttttttttccaaagttcagatcacacggatcctactctccgttgaggtgctccaaagagccaggtctcgattaaccccttgcctcacttatgcaaagatcctagaagaggtccacagccttcaacacaacacttctaggtcgttttctagaattgagtgaccaccaagatccaactcacaattccttctagaaaaggccacaagtgcaagttgctctacctaggacaacctctgaaaactcagcacaagaaacttcactcacttacctcgtttccttgcggaggtgaggaaaacctttacaaactttctcgggacatccacaagatctttggaagctcatgggcgacgcctaaccgtctaggagaagatctccaagagtaataagcccaagtgacagcccacaaggtatccaaagtgctcaatcaaacctaatcttcaagccatctccaaaacactcctacactctcgtctaatctctcaatctcacaagataggctctagatttgagtggaggaagcaaaggaagcttgggagtggctagaaaaccctagaacatgaatgaacagaagtggaatggccaaaaggtgacctggggacgaaattcatatatataacggctaggtgatatcatctagccgttactcacaagtttgaactagaaacctgccaggaggttccggacaaaagtgccaggaacttccgggcagcacttaggaaattttttgcaaataaacggtgcccggaagttccggccagaacctccgggtagccctctctgtctcggggagaaaatcatttttcaaaaatgattccaaaaaatcttttgactcatggatatgactaagagcactttgtataccctagaaccacacttgaaacccctcttaatagtacggtttttcctaaactcaatttcgaaagtgaaaaacctagtctaaccaccttcgatgatttttgcacttaggaacatttgaattggggggggggtctccttgcattcttagccatcccaactcgctttgggactaaactcctgtgaataaacttgataaacacgttagtcccctttaaccaccttgtcattaatcaccaaaacccactagggggtttaagtgcatgttcaatctccccctttttggtgattgatgacaacatggttaaagcacacaaaaagataatagaatttaaattttgaatgatgagagaagtgtgaagctcctcctaaagatatgcatataatgaaatgagatgaatacaatatgcataaaaacaaaggaaagctcaaaagaaacttcacactaccctcaatcaaataagatgcagaagtgagtgcttgaatgatgagtgatatgcaagaagaaagactagatgacatggcaatcactcaaaaagatgaaaagaacacatcatcacatcaaaatgcaacatccatatggtctaacttactgataaaaaggataataaagcatctaacagtcattacatccaaccataatagaatacgattacatgtccatatagagagagataaaagagaggaaatctgcctggccggaacctccggatcacaggccccagaacttccggccaaatgaccagacaacagtcaaggcagcaaaaaggatttaaatgacccccttcaattcacaatttctccccctttggcatcaaggcaccaaaaaggcgagaaactatgaagagaagaagaggatcactcatctccatcagagggaacaatctcggtatcgccggagagatgagactcatcggactgagcagcggtgtcaccctcatcaacatcaatgggggcatcctcagcagctgcctcggtgtcaccctcatcaccatcatcatcatcatcatcatcatcatcatcatcatcagaatgggaagattcttcattgaagaaggtggatggaccttcaccggcaacgttgcgggctgcctcataagcctcaaatggatcaacatagacctcatcctcagaatcatctgacacttctttcctagcctctcttctatcttccttctgacgcctttcgatcttcttcactttcttggcagtcttagcacacatacagaaaattgcctgaagtgccttcttgatgggagaaaaactcgaggaacttggtgggccactagtagaaggaccagctgaagtagaaggaacagatcgagggaccactggagaagagaaaggtggagcacgagggcgaaaaggattatggtgcccatctttgatgtagaataccccggtgactgtctcaatcatcttcataatgaaaggagcatagatgcaaccccgcttaggctcaagaatggtgttggcgatctcataccaaatcaatttcatcacattgaagggaggctgattgtagcgcatgcgactgagaagatgagcatgcttggatggcaaagcagtagcatctccaacctttggaagcaaagaccaatgaaagatggagtacaacaccttgtagttgggatgcaatccatgagtagatcccatgcaagtcctaggagcatcctttgcatacatgaacttggtcttgatcatggggagagatgcttcactatgaatgttgggcctattgagatcctcatcatctaaccccaacatctcagcaaactatgccatggaaatcttgtgcctaacaccctcagtcaaccacttcacataaggggttcccttccttgtagtaccaaagaatgctgtcgcatagaactgtgcaatgacctcctcattccaatcatactccaaggcaagaatatctccaagattcttgttgtggcacacttgcatcacttggttgaacacttcattgttcttcttcctcatgtaagcccaatcaatccacttcatctcaaccactggattttctctagccataatcactgaattataccaatccaattgagtgaaagtcctgaaacgaggatcctatgactccttaggctgagtctctggatcaatcaaacggtcccttctgcacttggcaagctgatgaaggtagttggacttgggtcttccaatgtggtgcataagagtggtgtcaaatccaagagtcttgtagagccgaacgggattctcatgagatccaacaggaaaatcatgagatgcccttccagccccagaattgcgaccaccacctctcccacgacctcttgtattagaaacatcacttccttgaccactatcaacatcccgaatctgaactggacggttgttggattacctggtaaacctaggacaagtacgagtactgctaccactgccgcatcaaccactttctctttacccaaacgaccacgaggaaaacgaataggaggactcttatcaccggacacatcctgagaggctttctgtcttttctcacgaggcatagtgcttactgcaacaggaatcaacaaattggagtgcagtagttaggcaaaatttgagagaatcaagaatggcaggctggctggacagcgcccggaggttccgggtgcaagaacaccggaacttccggccggcaaaaaagaggaacagaggtttcaaaaatagccagtgcatgtgaacaaatcctatagatcggtgatctacaaggtagcagaaacaagactatccaagtggttttctccctaggttcacagatttagagatcggggcaaaaacatgatgaaccaaaagagaagatcaaaagtgctaccttgagagaggaaactgcgaatcgatcacggaaagaacctcccagccatcaatgtagatgaatccacggagaataatcgaatttgattggagggaaaagaaaatcaccactcggggcactgtagtggcggctagggctggcgtcggggagggagaagaatgaggagagagactagggtttctaactccccctaagaatatatactccccgacacccggaggtttcggacagggaggcccggaacttccggcctgacagataaagggcagtcaggcccaaaaccatggtagagacaaggaatcaaaaggaggaatagatgtatataactagccaacaagcaatcaatacaaaactatggtcgatatacatcacaaggagaagataaaaaccaaattttcgcaataaaaggcacacaaaggaatttcgcaaagattttcaaaaaggtttttggataaaaagagggaatgtttgagctttattcctagtatcaagaccatcttctacacaagaagtgatctcaagacacaaaagctcatttttttttaatttacattttagtgacatatgtttggctataaattagcaaaccacccatcacctaatgttgcgagaatctaagatattgagctcactcctaagctcgcaaaatcttttctcatctaaaggtttggtgaaaatgtcggctaattggctctcggttctcacatgggtaaggcatatgtctcctttggtttcatgatctctcaagaagtggtggcgaatatctatgtgcttggttcttgagtgttgaacgggattgttggctattttgatggtactctcattatcacataggagtgggatcttggtgaagttgtagccaaaatcttttagggtttgtttcatccaaaggagttgggcacaacaagaaccggcggcgacatattcggcttcggcggtggatagggcaatggaattttgcttcttggaggaccaagaaacaagggaccgcccaaggaattgacaagtcccggttgtgctttttctatcaaccttacactcggcataatccgaatcggaatagcccaaaagctcaaagtcacaacccttaggataccacaagccaatattaggagtatgaactaaatatcttagaattctcttgacggcaatcaaatggcactctttaggctccgcttgaaagtgagcacacatgcaaacactaagcatgatatcgggacacacattgagcgatataccttttggagcgatataccttttggtccacacatttaccattgtcgtcgaggtctaggtggccattagtaggcataggagtcttgatgggtttggcatcttccatcccaaacttcttgagaatgtccttcacgtacttggtttgagagatgaaagtgccctcttgtgcttgcttcacttgtagcccgaggaagaaggtcaactcacccatcatagacatctcgaaccttttagtcatgatactactaaattcttcacaaaaagaggcattagtagaaccaaatattatgtcatcgacataaatttggcatatgaataaatcactcttaaatttttttagtgaagagagtagtatccgcctttccaatttcaaaaccatttttcaaaagaaaatctcggagacattcataccaagctctaggggcttgtttgagcccgtagagcgccttgtggagcttgtacacatggtttggcaactttggatcctcgaaccccggtggttgctccacatagaccaactccgagataggtctattgagaaaggcactcttgacatccatttggaataacctgaaatcatggtgagcggcataggctaaaaggattcggattgactcaaggcgagcaacaggtgcgaaggtttcaccaaaatcgagaccctcgacttgggtgaacccttgcgcaactaaccggactttgttccttacaaccactctatgttcatcttgcttgttgcggaagatccacttggtgccgatgatattttggtcaggtctctccaacaacgtccatacttggttgcgagtgaagttattcaactcctcttgcatagccatcacccaatccgtatcaccaagtgcatcttcaaccctggttggttccaaagaagagacaaacgaatagtgttgacaaaagttagcgacacgagaacgagtagttatcccctttcttatgtcaccaagtatgttgtcgacgggatgatctctttggacagtgtgatgtattcttggatggtgcaccgaggggacctgagcctgatcaggatgctctacagtgccctcggcatcaatcccatccacaggcacgccttgactgtcctctgcccggaacttcctggcagatggacccggaacttcctggcttggggaggtccggaggatccgatcatctggtcccggaacttccgggtcaactgactcttgactcgatgtagggctattggatgtcgatgacgaaggttgatccctatcttcttggtcatcctgcgtctcgactggtcgtatgtctccaatagccttagtacctatagcttgacttggatccacatcacctacaacatgtacaacaacttgctctccttgggagccattagattcgtcaaatgtcacatcccttataacttcaacaataccgaaggttttattgaagacacggtaggcatgtgcatttgactcatagccaagtaagaatccctcgtccaccttaggtgagaacttagatgaacgaggcctcttactcaaaataaagcatctactcccaaagacacgaaaataggaaacatttggtttcttaccactcaagagctcatatgaagttttctttagaattttgtggaggtacaggcaattgatggcatggcatgcggtgctcacggcctccgcccaaaagatatccgaagtcttgtacttatcaagcattgctcttgcggcttcaataagagttcggttcttcctctcaacaatgccatttttaggaggatcataaggggcggagaactcgtgcttgattcccacttcatcaaggaattcctccacttgtgtgttcttgaattctcctccattgtcacttcgtaccctcttgatggtgagatcatagaggttttgggcttgcttggcgaagcgcttgaagacatcttgagcctcactcttgtcatagagaaaatacacccaagtgaagcgggaaaaatcatcaacaatgacaaaaccatacttattacctccaatacttatgtaagccacgggcccaaataaatccatatgtaaaagctcaagaggacgtgttgtagttgatgttcttgataggatgtggattcccaacttgtttcccggcttggcaagcactacacacacgatctttctcaaatgtgacattagtgagcccgaggatgtgttccccctttagaagagttgccaaattccgcattccaacatgggctagtctacgatgccatagccaacccatggaggatttagcaatcaaacaagtttccggattcactctatccacatcgaaatcgacaagatagagatcaccctttaacttgcctttgaatgctacggaggagtcatcccttctaaagacggtcacatcctcatcggtaaacaagcaattgtaacccaacttacataattgagaaacagataataaattgtagcttaatgaattgacaagaagaatattagagagagattgattattggagatggcaattttacctagaccaattacctttcctttaccatcatctccaaacacaatattctcacgagttccgttctccttatcaagacttgtaaacatactcctctctccagtcatatgattggtgcaaccactgtccacaacccaacttgaaccaccggaggagtatgcctacaaaagaaatcaagcttgggatttaggaacccaaacctgtctaagtttgggtcccttgatgttagttaccaaagcctttggcacccacacacaagtgcggtactcatcattgtaattcacattaaaataagcaaccactttgccctctgaatttttggaaattacatatgaatcatagtaaagaccatctggctggaacctcctggcattatgcccggaacttccggtcatgtcttgtgcacggccattggcccgaaacttcctggcaaaccggccggaacttcccggtgggaatttttgagagacagagactcccacccagaggtttcgcccggtttgtccggatgttccgggtccctggcagctcacaagaccagtcacctcacttgcttgtggagctttaccttctcgcacaaacatcaagcattctttcccatttaccatcacacgcttaggcacaggacttccacccgaaaacccgagctcgtgtccatccttgttaggatgagcggtgatggtcttgtaaaggacatcttttgaatggtatgtcttcatgcatccatatttcaccaaagtgctcaacctttcattctctttcttaagagcttgcatagcgtcaatattagtagcataagagttcaaatcaatatcgtaacacctagcacaaccattgctagtaaaagggttagaagaattagaaaccacatttggttgagaggtgctattccaaagagtgtcaaattgaacttcaagatctttatgacttttgtctaaattagcaaatttttcttgaagagtttcattgacatccctaaggctagctaaagaaccattagccaaattaagctcattagcaagttgtttatttttagcacattctttagctaagctctcctctaaggcaagatttcttttcttctcaagaataagcaattcttcttgcctttcgagtgattgttctttactatccaaagctctcattaacttagccaaatgttgcatagcgggtttgctaaagctcttaagcacatcatctaattaattatcactttcctcatcactagaatcaacatcaagagaagtttgagagggcttttgagtcatcaccttgcggccttgggccatgaagcaagagtagtggtaggagtcgtcgtcatcatcactcaagttgttgaagagacactccttgcttgaagaggatgacttgaaggcgacggtagcaacaccaccttctccttcaaccttgtcttttgacttgggcttgggcttgacctcgggatcttcttcatctccggagtgccacacttccgccatgtgtgcctccgccacatgagcacgctccggcttcttcttgcctcccttagccttagcttcatttgacttgggacaatcggcaatgaagtggccatattcgccacaattgaagcacgctctctttgattgcctctttcccttgtcatcatccttcctccctttgtcatagccactcttgcgaagaaagtgcttgaatctcttgacaataaaagccatttcttcatcttcactttcttcacaacttgactcttcttcttgttttgccttcaaagcaacttcttgattttttatcatggcggcattattcaccatttgtctcacttcacgagcttcctcttcttgcatctcatgagacacaattcttccaagaatgtcacttggggtgagtctcttgaagtgtttcctttcccgtatcattgataaaaaagagtgggatttcttggaccaaatgcacgcagaagtctcttgaccacaaagtgatttgtcatgtcctcactcccaagtcctttaatcttgttgacaagaatcatcatcctatcatacatttcttgtggtgtctccttgacatccatcacaaatcttccaagccttccttccaataattcaatcttggcctcacgaacggcgggtgatccctcatgagccaattgcaaagtatcccatatctccttagcctcctctagtccatcaaccttgttgaactcctccggactcaaggcggagagaattgcattagaagcttgagcattgcggtggatgaattgttcttgccccgaagtgagctccatgtcatcatggggtatatcaatacctgtacaaacaactttccaaatacttggatgcaaagagattagatgcaacttcaccttgtgcttccaagcgtcataatatgtcccatcaaattgaggagtatgcccggaaggcatggagacgaagtagtgagagggaatagtaagtttgctgtaatcaaaaggtatagtagctcccttgggtggtggagttcccttgctgcttgcttcatcttcatttccattttccccattctttccccctaagtccaacatcgtggatcactcaaagcggtgaagcttgaatcaagagcacctcgctctgataccaattgaacgtgcagagatgtagcctagagggggggatgaataggctttcctgaaattttctcaacaaacgcagcggttaaattgacagggtccggaacctcctggtgatgaacatcggaacttcctggcagtgatgagtagcctggaacttccgaagttcttgagccaggaacttccgggcaatagagaaaaatgaaatatgagaagtataacaggtcctagctagtgaaaatcaggcacagggttgcacaagatgaaaatcacaagataccagcagattcaaacactgatcaagcacaagagagacaaaggcgattttttttccgaagttcgga

SEQ ID NO: 4822 - DNA, 45370 bp, Oryza sativa
ggggtctccttgcattgtaagccatcacaactcgctttggactaaactcctgtgaataaacttgataaacacgttagtcccctttaaccaccttgtcattaatcaccaaaaccccctagggggtttaagtgcatctcaagggccgatatgtatttttagtgttttattcactgacaggtgggtcccgtttatgtttgttttatttgagtaccatgtaagcgccacgttgatgccacataggatgaagaccaagtcaactcgccacgtaagtgccaccgtagaacaaaatcgcctccaaaaccgctcgaggagttgatttgcaactgtttcgggagttagggaacgtgttatacatgattttgtggttgaggggtgtgattcaaccgggtcatgagttgagggaggcaaaatggacttattcctaaaaaatacaaggcctgagcccatgcggaattatctatgattgccacttcaagttgggacctactagtatgcaacagccagaaaaagagaaagaagataattagataaacatgacgttgacagatggattcaaatagttttttctttgctgattcagcactgatattgctgatgtgacaccgtgttatgttagcatacgacttgcagagtttgcaatactccaaaaaccagtttagcatcaataggattattagttgcaaggatttaatctggcttttacggccgaaatagacatttgaggtttagttcgggaaactgagctcgcacagtatcatcctccaaataatacagcaaggtacagcgaacggcttggtgcagtgatgctgtcagtcttgcgtgtgctgcgccgtgcgagcatgggctgcctgaggttgcaaacgcgagccaggcagtcagcacagcaccatcagccgcgtcactccagctacagaaaaatatcgtactccgtcagaatcttggcccgctgcgttattatttataatctgctaattaagaaacaagtggtactaaccattcaaaccccatcatccattgttgcccccctaatgatcccatccacgcccatcatccaagcgtgcaagccagaaacggtaggcagcagttgggccaatgcattaaacaaaggagccatccgctgtggacgtgatcatgccgtggatcatcctagcaccagcaagcaaacgccttttttttctagattctccttggaatgaaggccggaatccgagccgtccatccctcgatccaacggcgcaaaatcgatggctaccaacaaacagctcacgttagctgcctcccctgggaacccccctgggaatgggatcgatccggcgacccggaaaaggcgccgattctgacgccgaaaggcgggcggccctgcagctgagccgaaacgaggctcggctacgccgtgcgccgcctcgccgccgtcgccgcgagcggaatttctttccggtcgatcgcgtttgggatttggggatctctttacgcgaagtcttgtggtaggctcatcggcggttgattggagctggagtcgccgagcccttttgggtccaatccagatatatatacttgcctttctgaaaaggcacgggccgtgaccaatgcggttgtgtggatgtttctttacctcctggggccgggcagattgatcgatcgatgttctctcacgtccggaccacaggttttgcgatggaaaatggtcactctctcggtgctttacttcgctacttcaagggtttttaattggtagtgatggtggttggtttacgtatgtttcatgtgatggtcttgtacagttgtgcataccttcaacactatctttatatactttgagcacacatcaacgctcactccttatagcaatatgtataatatgtatgtactttctaacggaccatactgatataattaagaattgagtggatgaattgaagataaagtattgattcctatcacgattacttacagcggacgccggacgaactcctacacatggcgaaaaggggatataaagaggatgactacgcttttaagtacatagtgcctgttttgatcccctgataaaattttacattctgtcacatcgaatgtttggacacatgtatggagtattaaatataaaaaaaataactaattacacagtttgtgtgtaaattgcgagacgaatcttttaagcctaattgcgctatgatttgacaatgcagtgctacattaaactaccttgtgggaacattttcgcactgcatggtaagaagtcgcgaacagtgggaaagcaacaggatggaagggattgagagccctcggacacccctacaagtcgagaacgacaaatatgaagaaggaaactttaaatttttaatataaaaggtgatctgttggagctgatttttaaccatttatccaaaaatcttgtacatgtattatcttattgggaaaaaaaggtaatacagtttagcataagaagaagaaattaggaatgattatagtgttgccaggtagggcaatggataataacaagagggagaaaagtatagaagcttactccctccggttttattttaattgacgttttggacaatgacacggtctacaaaatatacctttgacattatttttctattataatatacacaagaaataaatgcatgtttatttttattatagtgttttgaaagacaaatctatatatgttgttctagtttctttaaactaaatatttttgaagttattgatggtcatagttattgaagtttgactttaactttatccaaaacgttaattattatagaaccggagggagtaggttttactccctctgtcccatagtataagggattttggaggatgtgatatttctgtccggatttatagttctatggaatatcacatccctttaaaatctcttatattataaaacggagagagtaggagggatcaaaattgcagcagaccagcactattacatagagtctctctaacaacagtacaattaagtccgctacaaactaatgaacgatagttactgtgaagctccttttgaactgtcatatgttactgtagcaatatagtccgaataattagagtcgagagcttttgccacctctcgcatccgactgttctccgttgcattttcatgtagaagatctcattccggtttaggaagaaaaaaaagccatagttggaaaaaagtgcattttagatccgggtcatagatttgttctttcttttttatagaatagtaagggcatgtttggattgatgccctacaaaaattttggtagtgctaaatcttggacaagttttggtactactaaaatttttggtagggtagagttgaaaatgtttatttggattgaagtcaaaatttacccataagagataagtttataggcaaagccaaatttatagcataggtagagttttagcagaggtgtttggtttgcaatcctaccaaaattttgataggacaaattttggtagggtagcaatttaaattggccctaactctcggcgacagctacaaagaggccatatacaaattttcgagatacgcaatacggcgattttccattgcaagggggcgcaactctagcataatccggacgaacacttgcctccacacagagcgaaccaaatgcacgggttaagtagtaccagtacgacgtgtccatcccgttcaacacttgccccccgctctgaccgccgctgccggcaaggcgacccggtcggcggtctcccctgctcgccgcttgtttattcctcgcagtccgcgcttccttctcccggtaaacaaacgactcctgcagcctgcaggctactcctaccgctacatcaaccgaggaaaaacgtctgtcgcatgtggtgtgtgtgcattaataaaaaaaaatactatttataatattcgtaagtaaattgtactccctccgtctcaaaataagtacagttttacactattcatgttcaacgtttgaccgtccatcttatttgaaaatttttatgattagtatttttattgctattagataataaaacatgaatagtactttatgtgtgactaaatgtttttaattttttcacaaattttttaaataagacggacggtcaaacgttgaacgtgaatagtgcaaaactgcacttattataggacggaggtagtaacataaatttattaaacctaattaattttttattagcacatgtttactatagcatcatattgtcaaatcatggagcaattatgattaaaatatttctcgtaaattagtcgcaatctatgtaattggagtagttacttccttcatcccacaatacttgtctttctagcattcaaaagttgtcccaaaatattatcacttgaaagtagtacttgccacattaaccacttctaattcaaatttcttctcattatactcccaaccaccatcttacatccaactatactccctccgtcttttaaaaaaaagtaaactctggctatgcttttttttacggagggagcacattagttactaaaggatattatagtctttttctcttaatcttagtatatgctaaacaacctagaattatatgtattttgctacggagggggtatattttttaacttatgggtgtatttagttcacgccaaaattgtaagtttgattgaaatttgaacgatgtgacgggaaagttggaaggtgtgtgtaggaaagttttgatgtgatggaaaagttggaagtttaaaaaaaaagtttggaactaaactcagcctatatttaatactccctctgtcccataatataagggactttgagttttttttcattgtttgaccactcgtcttattcaaaaatttgtgcaaatataaaaaacgaaaagttgtgcttaagtgctttggataataaagtaagtcaaaaaaaataattctaaatttttttgaataagacgagtggtcaaacagcaccagcaaaaacttaaaatcccttgtattatgaaacggagggagtactttggtatatgtgttcagacgttcgatgtgacgggatgtaaaattttaacgtggatctaaacagacgatcaaacaacatcgacgaggagtaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgatttagcttttatttatgtaattagttttgtaagtagtctatatttaatactctaaattagtgtttaaagacagggagacagggactagtccctgatgtaaacaccacctgaaacaacgaccgctacgctaggtccatggtcgtggcaacggcagcgcgtcgggagacgagctgagcaagcgagacacgagaccatcggcggccacgctcttacacgccatcaaccgcgagacacgactcacacgagactccccacccatcctcctccgtgcgcgctggaggaggtggaggtggaggtggtggtgtccgctgccccccgcaataaataagcctacctccatgttcccacccccctctctctctcttctccgtctcgcctcgtcacctcacctcggcatcacccaggtgggagggggtccgccttgacttttcgtgttcgggtttgggtttgagtgccgcatctgcaagcttgtgcgaggggggaatctctcttccttgctgtggtggcggcgggcgggagggcggcgttgatttcgttggggtttgcgttgcgtgcggaggacggggttgtgtttgtgtgtgtgtttgtgctgatttgggcattggtgttggtggtggaggaggatggggaactgcgtggcgaggagcgggacggcggtggatgcgggtggtgatggaggggaggatgggaagaggcggaggaggaggtggaaggcgccgcgggaagatcagctcgggatggtgcccggccggatcttctccaacgacggccgcagccggacggcgacggtgtacacgcagcaagggcgcaaggggatcaaccaggacgccatgctcgtctgggatgtaagtggaaggtttctcggctctctctctctatctctctccccctatctaattcccgcttttctcggcgcgattggctgacttctcgtttgattgatcgtgaatggcaggggttcggcggcgaggacgacggcgtgctgtgcggggtgttcgacgggcacgggccgcacgggcacgtggtggcgcggagggtccgcgactcgctgccgctgaggctcatgtccgcggcgcgcgacagcggggcggacatgccggccgccgcatggaggaaggccttcgcgcgcgcctacaaggccatggacaaggacctccggtcgcacccttccctcgattgcttctgcagcggaagcactgccgtcaccgtcctcaagctcgtacgtgccgtggacaccggacatgacacgcatctcctgtccatcacccccccgtcctctcaaaaatgtcaaatcgaatctgcctactatgcgtctacgcacggcggctcacggggcgatttctgcatgcagggctcggatctctacatggccaacattggggactcgcgcgccgtgctcggctccagggaggccaccggcggcggcatggtcgccgtgcagctcaccgttgatctcaagccggatgtccccagtatgccactcccctgcttccactcacccgctaatcgtgttaggaggtcgtgctcttgcgcttatggtgctggttgtgatttcaggcgaagcggagaggatcaagaagtgcaggggcagggtgttcgcgctgcaggacgagccggaggtgccaagggtctggctgccgttcgacgacgcgccgggcctcgcgatggcgcgagcgttcggggacttctgcctgaaagattacggggtcatctcggtgccggaattcttccactggtctctcacagaaaaggaccagttcgtcattcttgcatcggatggggtaatttgctcgaacctatcacttgaacagataattcattgttctctgtttggttgttggatatttgcccgtgcagcgaatgagtatctctgtccctgcaaaatcctactttctttccgctggaattagattagttgcgatgtagtgtcaatctgtcacactttcgcattccacatgttgttagttgcacatggcgggcctagcgtatccatgacatctcgtgcatttctttagaagctaaaagagacgtgattaacatatccacgaatggtttaggcttttgacttcaaaccgctgtatctttcaggatttatttctaaaactatcatgattgcaggtgaaataatttaagtatcctccatttgtgccttttgtgactgcggcataaataatgattagccagcttaacagtcttctttgctgcatgcctgcatcgtcacccactttttgttatcagctgtactcaaactgttaaatcttatccttattcaacttgactcggttgattgatttaattgttgttgatgagatcatgtgcacctttcaactgtagcagttagaagtgagcacattaagctaatggcatatggagtagccaataaaattaggaagtcctaatggtcaataacttgttttcctgtcaatagtctacccatctgaataatgtgggtattctaccagacaaacccaaactactttgggggaaattacacgatagatcccagttcacttcaattccacgaaaatgtcataatacctagaatataccacactgttgactttcacttaactccatcatcttcacctctcctcttgttcatccacatgttgtcatctttcttcatcgatgcatcatgtgcctgctgactggtccacaccgcctcaccctgcggataaaacgtgacccaaccagtaatgctcctttccttatcgtgatcgcatactagtacctcgtgtcaccaatcatgactgcgctagggcattgacaggccacaccgctgtgaccatgactgttcacaatattgccaacacctttgtctagtgtctacgtgcagccacctgcatccacaacaatcttttgctacagttcaagaaaaaagtgcactgaaaatgcagcgtgttggaagatggggttttttttggggggggggggggggggtggggcgcagagcagcaacataaaaggggagcatgggcgatgcagggctggcagtgctcattttgtttagtggttgtggtagcgtcattgctaagaacagatgagatgataacatagggtgctggtcagcaacaatagtaatggagggtggacacaattagctgctatccattaaattcagcaccaatagtaatggagtatcttttttttctggtattaaaatgaactgggttttttttttgtgatatataccaaaactgaatcattcagtggtatagtaggacatcctacttttgcttaaatgtttcaccaattaatttctgccactttgtaatggagtggctttaagcttgtcatttgtcaatcacttgaagtggatggttttcctttcttttttgagcattaggtgggaatcacgtatgttcaatttttttactattagggggattgaatttggtgacactcaataggtagtaccaaattaaggcctatatgtattgactttataaactagcggtgtcatgcatgatcatatagcatgaagactggttagtgtatcttaaaggtcactgctatagagtggcaatctgtcagtatgaaagagctgtgcagactattgcattgtggtttaatatagtttaggtagtccatatctaatcaaacagagccttattctgttacacatattactttacttcagctgcaacttcttggtcttttccctcctagtctcctgggctgacaacttctattgacaagtgaatgtgtgcactgtgcaaatcaactttccttttcatttttatgtcaattttaatactgttgttatgtgtgttatgtacttgtcaaggttatattctgagaaaacttataattagtaaccatctatcaaaagtttctatccttgaatgtactatctaatgtatactgccaaaaagtgatgtttgaactttttaacctattatgaaatggttgcaattggcgaggaaagatgtccattttacccatgtaataatggtatctagtatcacgcaaaatgattttataagaagaaaatagttaggtcgatgtcaatcactgtctaccaagttgatattgcagctgtgccagaggagagcaagcttctttagttcctttttgtattgaatgtagtttgaaaagtcgaaagactttagtttggaatctggaaaagaacagataagttacttggtctgcttattcatgccatagaagctctcaatttgtcattgtcttttcatgtatgtcatatatcccttgtttgcatgtatagttcttactgaagttacacaagctatgcacatacttggctgcctttgtagagtttgcactaacaaaaatcttgcaggtatgggatgtcctcagcaatcaagaggctgttgatatagtgtccgcgtccccaagcagatcaaaggctgcaaaatcccttgttgaggcagccactcgtgaatggaaaaccaaatatccaacatccaaaatcgatgattgcgcggttgtttgcttatatttggatggaaaaatggaccatgagcgtgactcaactgcctcattggacaacatcagtattgaagagggttcagttgcagatcctaatgaacctcaggagcaggagcccaccttaactcggaatttcacagttaggacagttgcaggcagcacgcaagagaagaccttagcaggggtggatgcgaggattgctggtgtagcgaacgaccaaaattggtcaggtctcgatggagtgacacgggtaaactcacttgttcagcttcctaggttttctgaagagagggcaattggctgagctgcccatcttatatttacccccgttattttcacctattgttctgaattttagcgtagttgttctagagaaaggtagatgtgggacgatcttgtgatttggtgcggtacttggcaagcgtttcagccactatgcatagaagtcgagttgcacgttttagcccaacaaaactgcacattgcataggacagaggctctcttttcacccatcttgaggcatgtcaactccatacctcgaagatgaagcacaaaagagcaggccattgctccaaatctgcaattttgctgggttaaaactaacaaaagacgacgccaaacacagtggctaaacgcacgccaggccccagtcacccctgggatgatattgtcgggtgacctgtaaattctccaccggcgcttgctttgcttttgtagagaggtgatgtccagaccattttctccgctgcatgcttagcttttgttgacacagggcggtgcgctctgtcgatgtcggattgccaatctttgccccctttgttttgttcgcggtctgtgcccttgcttttactctcctggagccatcatgccaccgagaaaaatggcagtctcaatacttttaggccccctttgattccaagggaattcataaattttagatgattttatttctataggaattttttctacaaagccctttaaatgaaagaaatgaaccctatggaatcctatgaaattcctatggaatgtctcttcctatacaagtttttcctatacaagttttgggggaattttaacaagaggtagaacctcatggaaaaaattctttgagtctttatctcttcttaaattcctgtgttttttctgtggtccaatcaaacgatcattcctacgtttttcctatgttttgcaattctctgttttacacttacattcctatcagaatcatatgtttttcctattcctacgattcaaagaggcccttagccttaatggtggtgaactggtgactgatggtgcatccgtacaccaccgtacatggcacacgctgcatcttgtctgaaatggcatgtgaccggccgagcgttgctgcgctgtaggcgtgcgctggtgagcaaaatttgtccggcgacggtggccggccgacgcacgggcgggtgcaccgtgcaagagagatgcagggggagacaggcatccggcagaccggcaccgtaccactaccgacgggctgcacgggcacctatcacgtgaagtagatttgccgtccatcctgtggctgaccatttaacgaatcttacagcttttattgggctttcacacgcacattcacgcgcacagtctcacgcacgcgcgcgctgttcatacgtggctcgttgctgttgcctgtctcggtgcgccagccatgggtggacgcgaagtgaccgctcggtgactgggcggtagcgtgaggcaaaacccaaaaaagatgaggtgatcgaaggaataagatttttcaccacaaccgtagtttcagcggtcgagcggccgcgcacgcaacaaggtaccttcggtccttcaccgatcactggccgctgagcactatttgcatgacgcggttgtggtttgagatcagaggtgcaattgtaataaggagttgcggttcgactgaggtcctgtttagtttcaaagtttttttttccaaacttccaactttccattgcatcaaacatttcatacacacacaacttttctatcacatcgtactaatttcaaccaaacttccaaacttcagtgtgaactaaacacagcctgattgatacaaaacgaacggctcagatagctagaaaacactattcacgaattacatgtgaagaatctatactgtagtgattattgtagagtgttagaggtacaagagggtagcagagcaaatctgagactctattgtagcgattactgtagagtgtcaaaggtgtaacatggtaccagagcaaatctgagcccttggctttatcgatccaacggtcaaaacgtgttgtgactgctaaagtagtagtagtagtaacgactgcatcggatctcaattccgcggttataggggatcgtgaacgtttgtggtctgcgaaagcaaaatgaaagctcacccctcccccagcaagtgacacggcgaggagagaagacgtggacgagcagccgtcgttcgatgacgaacttccttcagctagccccttcctctgactgagaagagaagatgtagtcgagccccttctttctccggttagcttcccttaacaagatcgatccgggaaccaggccagctcttttttccaccccccccccaacacacacaccacaccctgccccgaaaccctaacaaaagaattcaggcgcacattcaaaaaataggattttcagttggcggaaccagccattgaagcccacgaaatcctagcaagtggcagcaaaaacgtgcctgccaccaccatcgccagggagtggcatcatgttcgagctccgctagtccatcttcagtcttcccttgaggacaagactacagcggcggtgcaacaacagtagcagttggaggtaagcatcacaaggtgttcctcactgtgtttatgcaagaaacctaatcgaattcatacgttgtgcaggggcatgctaatcttctctgtatcgttccaattgtatcggctgttataaaaaaaaaagaattcatacgttgcttgctgcacggtcaaatcaaatgcatgctttgcttgctgcttattgtaattgtgctatgctactacctggtcttggtgcatccatattacccaagtttcacaagcagcaagcatatgctgaatagttgcgattgttgtacccaatactagcaggaagatggaccgacggagtttgagaactgcgcccaaggtggcagcgaggaagcaacgtttctcggcggcgcatcctagcggacgagctccgggtcattccccgccgccgacgatggcggcggggtgaacgcatgtcatcaaactctggagatgtgtttgctatcactagtgagcttgagctttcatgggttggttctattagccagtactctcttcatctcaaaatataaggaattttaaacgaatggaaatgtaacacttcctagtactataaatttggatatggagcctgtttagactcgtagtactagaaaatatcccatccattcaaaatcacttatattttaggatggaggtagtattattaagggcacacgtcatgtgagagatgttatatggtttggacagtggatgagtactgattgcacgctcgtttcagtcacccccatgaaggcagacaatcctggttccaacgggagacatataagagatgagggaggctcgagagtgtgggagcatctcactggagttataggaggacgattgacttcaaacataaaacaatttggcagttggagaagtggtagggaggagatggctagtagggttcaccaggaacagtggtgacgctatggatgcaggggtgacagaatgaagagggtgggatagcggcgatgcacaactagtgagaacaatactactactaggactctaggagacaaggaggacgagtgtgattgagggataaggtgtcttgcacaaatcttaaagagatttcatccattgaaaatcggttgattttccccatgaaacaattcaatgataggtagacggtctctataatttagtgcttttcacaaacaaacttgtagctcagtgctatgtcgaagttaatcattttccgcatcaactcgaaatttggcactgtggaagcgatactacactagacattgaaatggcaagaagttggtgccaatctctttggtgcacacctccaaacaaagtcacatttcccctctatccctcttcatatatgggcttgttcattttgctacaactttcaactctaccaattttatttggcaataaactggacaagtcgcatctttatttggcacaccttcattgaaaaattgacaaaccaggatatgatgttagattttccaagtttttttcaatcttataattaatttatgatattgggatttaagtgtggtagagaggggacaaactctcttttctgctccatcccgctcttcaaacaatggtgtggtgagttggtattagactttcaagggaattgataaagcagggtacactgattcacttctcataatatatttttacttttataatgccaatttggttgacggtcagtttgccgcatttaatattaagcaagaccaatttatacaactatttggttgaagccacagttgtgataatattctcttccaacaaattaggtctgatgcatcaataacttagaaaaatgtgccaaaattcttttagacttattaaggtttggtaaagattttgagcatctaaccttagagaagtttgacaactactattgacaaacgatggcgacttgtaaggctctgactagcaactaaacaaacactaattcttgagattgagatgagggtgcgggaggtcaacgctaacgagggtggtgccaaccttcgacaacccaagagaatgggcagcaaccccattcatgacactagttgtaatggactctataccataagtaccacggagttatatggctgtgctgtaaattgtagctggacaacccataatcgttaacactaagatgtttatcctccatgtctagaactctatagttaaattctaggtttaattttcgaaaaatggctaggaagtaaaaggcccaaatttgtaagatttaacaaaaattaaccaatctcgaaagaaattagatgctcgtacaaaccaaagctgatcaagggagctccaaaatctgaggatattcgacgaaattcgagcggaaaggtgaactcgtacttgttcactgtccatgtaacattgcgtgaaggaagacagctggagtattattgtactaccatccaaccagcagccggaagaccgatcatttttaacggaccaattgcgagaatacgccacaagttagcgtggtcaaatctcaggaaaagcactgcaagtgcgagacagagcagagaacagttcagcattttcaggctgctagctagcaggtgcagtcttccaaatggagcaaaaaaaaaaaagagaaaaaaatgccagttgcgcccagctgtccggagcacgtctccacgtgagaatcgccgaacgacccgccaccgacactgacatgcgggcccaatcccccgtacgcactcgctgtcctgtcacccaaacctcttcttcccgaagcctctctgaccgcgttgcattcttgcggctcacgagtcacgaccacccaacccaacccacccacgaagacgtcaacacgaacgcgaacgcgcgcgcgacggcgcgagccgtatgtaaggttcgctgcggcttcttcttccgctcgcccgcgcgctcatggccgcactccgccacgcgacgcggcgcgcgtaggaggcaggcggctcgtgcgtataagaggcgacgagacgagacgacgacaagaagacgccggaagcagaggcaggtagcgtagcggcggcagtgaagcgagggacgactagcgacgatgagttctcgctcggcggcgcgaggaggggtgccgcggccgaggaggccgagcagcggcggcggcggcggcggcagtaacacgccgaggccgggcggtgggggtggcgtgttccccgggcgagcggaggggttcaactggtggggcgcgggcgggcgagcggcggcggcggcatcgacggcgccgttggcgaggcggcaggcgtgcggcagggcaggcagggcgtcggcgatggctcgggtgccgacggggaacccggaggtggtgcggtgggcgctgtcgccgcccgccacgcgcagccgcggcgccggcgcgctgaggaggtggagcttccggtcggcgccgagccggctccgcaacgcgtcgtcgtcgccgtcctcccttgcctcgccacggtcgccgtgatttttctcctctgccgccatggcggcggttctgaccggattttggcattcttccgttggtgacttggggtaggcaccggagattactgtcctttgtaattaggagtagtagtttgtaacgtttaatttttagatgatgatcctctgtaattagtagttccagattaattcttttgacatgatacacgtacactgggaaaatgaattttgagaattacacagtacaatgcatatactcacaacgcacgcgcactcacccctatgagcatttttgaagaggcgcctcgctgtcgacgggtacatcgcatgccactgaagaacccagtacctcagatgctactgaggctcttgtaaccattaggctacaggtcctttcacactgagaaaatgaattttgatcaggttaagttacacttgcgctgtgtgtagttccaaaataattcttcaaacttctaactttttcatcacatcaaaattttcctacacacaaacttctaactttttcgtcacattgttccaattttagagtgaactaaacacataaacaaagccttgatgaaaaatgcactgttgtataggcgagaaatttcagtatatgccattcaagcggccgaagcatctccccgtaagctcaagctccgccgttgccaccttcactgtggattcgccgttggagtataaaaagatcggtagatcaccgagaaacaccatagccgccggactcgatcgatggcgtcgctgactccaccactgtgctactcgattcataacacttttcagaacttgttgccgagggcacgaagtgttgcattccgtgccatccgatccatccagtacaaaaacggttttccaaacagccaataatcattttcccggacgaggggaaggcctgcctacacgcataagcctgtgaaaatgaggcgccatagctacccacctgcgaaaatattttgggcgaaaaaaaaaatcaccacaccccccctacccaatccagccacgccgccgccgcaatcctcgcaccttcggccagatctagggttaaggttttggggggagagggagagggagagggagaggaggtgaggggaggttgttgcaggggcgacgccgccacccttccctccccccttcagccagatctgggagggagggagggtaaccgtcgccaccgcctggagccgcgtcgacgctgccaggagggagggaggggagggaaggaaagccgccaccgccgccctgtcccctccggccagatttaggagagaagccgccgccacccccctcccccttccctccggccagagctgggaggaaggaggggagtcaccggccaacacgccctcccccatgcccccttcagccggatctgggaagggaggggaggggaggggatccgggctgagggtggtgcgacgccgcctccgcttagagccgttggcgccgtcgccatcgcctatcccctccctctggccgaatctgggaggagggacggaagccgccgtcgccgccctctctcctccccccttcggctggatctgggagggagggaaggggagccgccaccgccaccgccgctagccactgctgtcgccgaggagagagggaagaagaggtgggagggaaggggaggggagcaccggggagagaggcaaggagaggtgggaggggagggagagggacttaggatttttgactgcatgtgacagtttttatgatgcttaaggtattttcgtaggcagatctattaagagatcccaggtagacgacgaactcacccacggttgtcatttttttaggtggtcatttaactccgagaggcctactcgtctggaaaaacatgccatcgtctagaaaaatggttttcctggtagtgatcgggaagtcacgtcgtacgattattagcattgcctgtcgtagtcgttgtagccacggaggtcgggcacgatggcatggaatccctggcccttctcatcaccatcggttagcttctcctcgtgttgctactctactctcccactccaacacactttttgaatagaaaacagcactatagtgccttttcattgaatagagcagcagaaaatacaacccctagagacaaaatgaaacaagtagaaacactatagctatacattatacagagtgcgggattaactcacgcaaccgtttagcccctactaaagcgcaaaggctagcctcttttttaatttttgatagaaaaaaactcgttgtcacctctttgtggttaaagatccgccgattcctctcctttcagcacactgggaggaccttaattagtggcaagcggcacataaggaatagctcgtcgacggaggcccgatgcgtgtgccggtaagaccttggtggctaacggcgtgagcgaggagctcgccaatggtgcccggatgcgcgcgccgggatgaccttgctggctggctggcagcgtgtgccgaaaggaccttggcggttgacggcgtgcacgaggacgagctcgtcgtgcttggacctcagcggctggcgacgcttgacagtggccagatgcacgcgaggaggacatcgacagccgacggcatgtgcgaggaggagctcgccgacggcgatcagatccattactaaattttggtaagttgtggtaagttttgaaagtgccgttaattgagtggcattactaaattttttccgttatatgcatattatacctacttgtacacctgggctgtgtttagttcacacttggttgaaattgaaagtttggttgaaattggaacgatgtgacggaaaagttagaagtttacgtgagtagaaaagtttgatgtgatggaaaaggttggaagtttgaagaaaaaattgggatctatacacggtgcaatttcagtactacctccgtcaaaaaagagtatagttttgcattgtttatgtccaacgttcgactgttcatactatttttttaaaaaaatatgattagtattattattattattagatcataaaacatgaatagtactttatgtgtgactatttttttatattttctcataaattttgaaacaagacgtacgatcaaacgttgaacacggaaacccacaactacatttaaattgggacggaggtagtatcaaacatcaaaattgagttgaaaaggcaaccttctctctctcactggtcgtggcagggcgacctcagactatagatggccaaaaggcccgcccggcacggcccggcccaggcacggcccaccagccatcgggccggcacggcccgatcggcacttcgtgccgggccgtgccggcccatgggttgcgcctcccgcccagacacggcccaccagctgtcgggccatgccgggccggcccgaagacgcgggtggcccaccgtgccttttttaaataagtctagttttcgtccctcgtctttgggctgtgacataatatagcgaaaataagtctattttccatccctctactttgggctatgacatatatatatatagtgaaaataagtctatttttcgtccctcctctttgggctgacatatatataggtaaaataagtctattttacgtccctattctttcgaccgtggcatataatatgtctatttttactccctattgtttatgtgtcgggcttagcatgcggcccatcgtgccgtgccggcggagaggcccaggcacggcccggtggtcgggccgggccggcacgggcccgacccttgacgggccgggccgtgcttgggctgggccaaaacgccgtgccgtgggccgggccgtcgggcctcgagccttttggccatctatacctcagacgcccctccagatcccctccttggctagggctgtggtctttgctccatgttcccaacccctctccctcgtattccgcgcgcactctttttaaattgataaacggtgtgttttttgcaaaaattttctatacaaaaattgcttaaaaaaattaaattaatccattttttttaaaaaattgttaatacttaattagtcacgcgctaatgggctgctccgtttttcgtgcggggagatgggttccaaaccatgtgttaacagtgaaatttggtaatcggcaaagacgtcatcagcttagaatcattattggctgcagcatctcggaatcagccgatgggagttatcaagtcgccaatagtcggattcctgctatattcagttaaggaaatcaatctactaaaggaagcttatccctaagtgaccgagtttaaagaggatgcggcatggcagtttatctattaattaggaatagtttgttagtttccttttatctttaggaaagtgtgtttagtgtccaataaggactttatattttccttttatctttaggttagtttctttcttgtccgacaaggaattgtatcaacccatgggtataaatatgtacacccggggtctatgtaatctatcctcacgatcaatacaattcggcgcatcgccaccttttaccttttctatttaattttatcgttcggcgggacttggcacccgacgcggggctgcatcggtgttcgatctccggcgaaggggtaagtccaatgttctgccggcccgggcaattgtctcatctacatcggcgtcgttcaaggctgcatcaagacattcgacctcttggattactctggtttggatgatatatttgcctacctatttatcatatgtctctgttaatctagtcttagcatatcaatttagctctattggctgcttctcgttttagggtttctgccggtatcggctaaatcgtgttgctagattagattagcttagacatctaccaccctgaaaactcaatcaacgacttgattgtctagatattatgtttcttttcatacttagtgccgcatcagttaagtttgatctaataagtcatgcttagaaccataatctctagcctgcttcttgattgccaataagggtttcatcggggtttcaaccggtgagttatctggacgttgcatcggctcataaggattgcatatacatataagtttgatttagccgatgacaacaaaggtttcactgtttaatctaatctgtggatttattgacatcggtcttccagccgatgtgtgcttgaaccttcggatcaatgtttattctatcatattattgttagccgattgatttatactggattatattgctatattatattatcatcagccgattgccttcatatcattatctacattggacatatagccgattgcttacaccctatcgctatcggctggtatcagcatcggctattatcggctatcggctggaactactccatcggcttgttagccgatcggctgttttgatctactatttgcatatcttgtcagttgcaggatcaaactaactggcacgcccgcatctcatcaatctttggacctgcactggagctaagcagatctcccaggccggtgtgttcgatttttttcgtcaacaccatgacatgcgaacacaccctaggtttaagaaaaccggtcggttatcatgaaactgtcgatggtcgttttctggtattggatcaattttcgtgcaacgttggttgaaagtcattgattttacaggttatcgatcggttttcgataaaccggtgagaagcggttttaaattccaaaataaaaggttaaaccatttccacgctgtcgacgggggatacccgtagaccggatatagagggtattggggtacgctggtatgaggatctacataatacgacatcaagtaggcagaaaacaaagaatatactggttcaggccccttgataggtaatagccctaatccagttaatatgggattatatgatggaaaccacatgttacaaagggaatagcggaactcgatgagatcgtagtcgagttgattcgactagatcacccggcgacttggctcctgtaggctccggcttcgtaggctgtggtggatgtgttggcggtaagattcgatgccttaggtcctcccgggggggtcccttttataccgtaggtcaactggtctccaagtaggacccggagacatcggacccggtacgatacaatgacgacccagttctatccgagtaggactctttccgtctgtgaactccataatgaatttccttaacgtatgctgaaaacgtccgtatgcacgcaagtataccatatcgatatgtaacgtatatcgaagggtagagggtataccttacccgtaaccctgacagtagcccccgatttctgtttaaatgaactcgtgaaaccgatcgcgacttccgatgtcgaggttgtcgtcgttctcagtgtgaggactgacagacaaggagtgatcgacaacaccaggtgaagctcaacggtcatgagtgaatttaaattgatgtccgaaaaactgccgcgcataacggacccagaaattttcggcggccatctctctcctttccttggaattctcaacatcggaagtgcgtctatttaagagagttttggggatccaatttgaagtccgcctattgtgaaaaaactctccagcctccaagcgtccctcgtcttctccgctcccgcaaaaaccctagctagctcatctcggtcctttctctggcgatctccggcggcaatggatctcgacaagtctacctgcaccagcgcgtcgctgaagaagctgcaggaggatggcgcccttcctagtcacgggaccatggagagagaagcaggaggtactgaaccccaacctgtcctgggtcgcatggttgcgatcgaggattatattctctgtggctttcttcctccgccttctgaatttcttctcttggtcttgaatttctacggcctttccttgctctatttgagccccaattccatcgccttcctgagtatcttttcgcatctttgtgaggcctacattggggtagagccgtttcttgacctcttctgcttttactatgagttgtgctggatggaacccaaaaaggtgtccggatgtgtcggtttttgacttcgggatggcctgaagtcacgatacatccccttccagtgcccctcatcttgcaacaaatggtgggggaggtggttctatcttcatatatcatcttggaccgccagacccgccttgaccccatccttccaatctttcatcgatatcattgatgacctccgagtacgggggttgtcggggtatgaaatcgctgccgacttcattggtaggcggatccagccactccaggcttgagcccacccagcctttgattattctaggccggaggacgcgacccaggtttctcctcggggtatttttctttttagttaaattgactcccttatgtgcgtgttcttcccgacttattgaattctggtcttgatctataggcttggacagcgcaaccgtggagcgccgcgtcggccaactgatgatcagtggcccgacaacggcgagcaacgtccccgtccccctttgcgagaaaggggcagccgagcgcgaagctgccatcaatgtaagtgtactcagcggtccttttgcattattcttccgggatcgcattatgatttcatgaagcgtaagctctccctctgactgatatcatcgggccactcgtggaccatcaggtggcggcgtcgctgaaggagaaagtcgccaaggaggcgtctgacgctgctgccgctgctaccacaacgagtggcgacaacgttccgaaaaaggagaggaaattctcctctgtgatcggacatcgttggaagacgcccaccccctcggtaagctctcctggtccttcatcacgtagtcaagaaacttccacctcacctcatatacgttatactccaggcctcggatgcgtctcccccgcttccgcgacggtagcggcttgtgacgctcggcgagaagtaagtgaatgaatttgaggtttcgtgacttcgtcaaactcttgcagtctgtctcaattgcagcctttcgcagggcggcgcgggcgaaggcggcgcaggacgggtctggggggacctccagcgcgtctcctgttgtggcctcgacggatgtcgtggtcgtgcccaagagccgcgaggcgacacctagcggcccagccagcgatctcgtggctggtcgtggtccgccggctgtcgtcctcacctgggagcagctccaggttgagatggggtgccttctcaaggctggtactcgcggcattagccgcgagatcacggaggcgagggcggtggcggcgtcgtcggcgaatgagcgtgccgaccggctggcgcgcgatatggaggttcgcgaggacctccagaagatgagggaactggtggccggcaacgagcgacaacggtagggactagagcaccgcatgtcggagctcgagaacaacttgtcggaaatctgtggctcgttgcgggtcacctatattggtctgcaccagctcgccggggagtgcggtatcaagtctaccatcccggcgaatcccgatgaattctcgctgacgtcttttcttgcggagctggcgacggcgatggaggagatcccctccaagcacgcggccaggatcggagaggagacgtccaacgggatctataccggggcgtgccatgtccttgcgtgtgtgaggctggcgcaccctgaactcgatctgcggaagatcttggatcagggggtggctagcgacgcgcacaaggatgtgatggaagaagtcggcgatctgggggagtctgttttcccactttttgtagagtaggattttgactctcttgtactctttagtcatgctttgtaaaactttcattggttccaaccgcctttgtgtgtgtagtcatcgccttagctttctttagcattttgatcttgagtactttgttgtcattcgtagagatgttgatgtcgaggatgtccagcagcgcgggcagcctgagttgccagtggtcgttccgttgcttgcgttcgagccacatgttccggagggcgatgtagctcaaaattcgcatgtggaaacgggcatggcgacgactcccttaggttggttatctctgttttcatctcctttactcttccgtctggatcgatttgatttgttgtattctcgggagagaagagcagtttgacttagtcgtttccatgctgagcagacctcgagagtgcgcttgctgaccaggatcgtcgcatccagtattggaggacgaagtttgaggtcgcggaactcgagaggactatgctagaagtgaagaacgaccaagccgtggagacactccggggtcgcgaggtgtggttcaactcgtatctgaagagttgctgcacctccatgtcaagggtctgtagagagctccgagtaccccgtggggataccgaggaatcggcggctggatacatctcgtggctaaatggggactgcgcccagctcgagggcatcggccagcgtatcgacgaagccccgaagcaggagtgtcgtcgatcgagccgatatgctgggggggcatgtattggcttgtatacgagatcatcgtccgcaactgcacctcgagttcctccacgaagggttttctcgttctcggagaactcctacggagatagatggcctggcgaagtcgatggcgccgctggcggaaaaggtcttccagtctatggactggcgttggccttcctggtagtctccgtgtcctgtgacaaatgtcttaggggaaaagtgtaatataattttggatttttatagaattgtaagaagtacttgtgaaatagaaaagaaatctatctaactaagctttcttactctggatgtagcgtgtatgagtgtcttctcacttcgcgacttcgatcagtcgtttgagttatacactctccctagcccccagccttgtcatcggagaattcttctcgggagataaggctcttgtacctttgacctgcctcgattgaacaagcactaatcctagcccccagctgtgaagttggaaagtttatttttgattacacggcttggttaatacgcacggcgagaactcttacacgaccagatcttacatggtctttcgtctctacaggatccgacaaggccttatcggctctgggcatccccagccgaagttcccttaggttcctcggaggccttgtcaagacggcgtaaagggacatgaggataggtttcaacgctaggtgtcatctgggtaagggatcatcgggaaggaacactttgattgtagtctgtacctaaaaataggctttattgaagctgtaagatgtcttacaagcatggatactattaacttatacatagaatttacgtaattgatcaatgttccaggaatttgacaactcgcgaccatcgccgtctgcaattttgaatgcgcctggccgcagaacttgtgtgatcgtgtacggtccttcccatttgggtgagagcttgtttcgccctgcttgactttgaacccgtcggaggacgtagtcgccgatcgaaagtgtgcatgctcggatgcacttctcatggtaacggcgatgggcctgttggtagctggctgctcgaacggcaactcgttcgcgatgttcctctagtagattcacatcatcgtttcgttgctcctcctgatcctcatcggaatacttctgtactcgtgtactttaatgccgtagcttggtggggagcatggcctctgagccgtacacgaggaagaagggtgtctccttattggacgttgtcggtgtggtacgcacggcccatagtactgatggaagttcttcgacccacttcttgtcatgtgacatgaacctgtcgtagacgcgggtcttgattccttatagtactatgccgtttgccctctcgacttgtccattgctctgagggtgagaaaccgaggcgaagcagatcttgactcccagcctgatgcagtaatcctggaaatcagcactaatgaactgggagctgttgtccgttatgatacggtggggcaatccgaacctacagaatatccctttgatgaatttgatggcgttgtcggccttgatttccctcatgggtgtcgcttcaatccacttcgtgaatttgtcgatcgccacgaataggaacctgtagccgccctgtcctcgtgggaatggcccgagtatatctagcccccaacacgagaacggccaagtgagagggatagtctggagtgcttgcgctggtagccttgtgtgtttactgtggaattgacaggcttcacactgctgaaccatgtcataggcgtctttgagggcggttggccagaagaacccttgtcgaaaagcttttccgactaatgtccgaccggcggcatgtgacccacagatcccttcatgtatgttgaggaggaggtgtctgccgtttggtgccttcttgtatagatcgttgccgatcatacagtagacttttgctttacggaatattttctcggcttctgcgtcgtcctcgggcaactcttcactgcctatgaatttaatgagtggggtgcgccagtcgtctgtggtcccgatatcggcaacggcgcgctctgcctctgtagcccccgagctgatgttgagggcgaccgggctaccttcgccgcttgcctctttcactgatggcctggtcaggacgtccagaaaggtgccaggttcaagtggctctcgtctggatgcacgccgtgctagatcatccggttcgatgttgtctttgcggtatacatgttggacctcgatcccatcgaaccttttttccagcttcctgacttctgcgagatacttggataactcggggctagagcacttgtaatctttatgcacctggttcgcgactagttcggaatcccctttcacgatcagtagcctgactccgagtgcagctgcagcacttatcccggcgattagtccttcgtactctgctgtgttattagtcgccctgaagttgaggtgaattgcatgcttgaattgatctcccagaggtgatgtcaagatgaatcttgcccctgctccttggctgttgagtgcgccgtcgaacgctattgtccacgttttgttgtcgatttggttgtctgacctgttatcaggcatagtccaatcggctacgaagtcggcaagtacctgggacttgatggttgttcgtggcacaaatcggacatcaaactggcttagctcgactacccatttcgcaatgcggccgacaacgtctatgtttctcactacttcaccgagagggaaggaggatacaactgtgaccctgtgggcttgaaagtagtggcgtagctttcttgatgtcatgattaccgcgtaaagcagtttttggatctgtggatatcttgtctttgcgtcgtggagagcttcgctgacatagtagactggtcgttgcaccttctctctctcgacaacaatgacagtgctaacggaatatggcgtggcggcaatatagagaaataattcttcattaggttgggggcaacaagtacaggtggatttgataggtagcgcttgagtgcaatgaatgcctcttcggcttcctgtgtccatacaaatttgtcttgctttttcagtagaacgaagaaaggttgtcctcgctctcccatcctagcgacgaacctgcttagtgccgccatgcatccggttagcttctgtacttccttgagtcttgtaggcgacttcatgttctcgattgccttgatcttctcgggatttgcttctattcctctgccagagacggggaagccgagtagcttgcccgatggtactccgaacgtgcacttcattggattgagcatgaggcgatatcatcggaggttgtcaaacgtttcccgcagatcgtcaattaatgagtcgcttgtcttggtcttgacaacaatgttgtcgacgtaggcctcgacattgtttccgagttggtcgctaagtgcgccctggaccgtgcgctggaaagtgtttcctgcggttattagtccgaacggcatcttaacgtagcagaataccccgaacggcgtgatgaatgttgtcttctcctcgtcctcttttgccatgctgatttggtggtagccggagtaagcgttgaggaagctcaacaactcacaaccggctgttgagtccaccagttggtctatccgaggaagagggaagtgattcttgggacacgccttgttgaggtcggtgaaatcgacacacattctccatttcccgttggccttccgcaccatgactgggttggctagccactctggatggagtacctctttgatgaaaccagctttgagaagcttgtcgagctcttctcgtatggcttgttttcgatctggtgcaaatctccgcagtttttgctttactggcttggcgtcgggtcgcaccatgagtttgtgctcaatcacctccctgggtacccccggcatgtcggacggctgccaagcgaacacgtcagcattgtcgcggaggaaggtgatgagcgcgagttcctatttctcgcctagtgatgccccaatcttgacggtcttgtcagggttggcactggagagtggaacgatcttgattgcgccgtccggtttcggcgtcttgtttgttttgctcagtttcttgggtggctcggctgtgtcgggtgggctgggcgtgtgctcgaccatgtcgacgctccgcttgtcgcattgcactaccagcttagcattcccttgaatagtgattgttcccttcggtcccagcatcttgagcacttgatacgcgtagtgagatgcggccattaacttcgcgagtgcagttctcccaatgatggcattgtatgctgtatcgaattcagcgacatcaaaggtgatctgttccgttcggaagttatttgcttggccaaaagtcacaggcaacgtaattttgcccaatggtttagacgatgactgaggagtgattccatagaagggttgatcggtgggtatcaactcgctttgtgggatccccatcgcgtccaaggtgctagcgaagagaaggttgattgagctaccgccgtcgatcagaactcgtgcgaccttgatattccgaaaagtgggttcgaccacgatcggatatcgccctgggatgacagcagtcttggggtggtcctcttctgagaattctatcttctgctcagaccacttcatcttgggcgcagccccctgccacgtcgaacagacttcacgttccaccttcttgtattctcgctttgagtatgccgcggaacctccgaagatgtgcgagacatggagatctgagtttgggtatgctgagtccgattcctgagtagccgcctcagcgtccttctcgaccacacgtactcgcttgcctttttccaatgccatgtgttttgcgagcgactttttgaagacgaggcaatcttctagagagtgtatgtctgacttgtgtatagggcaccatgttttcttcatgtcgctgccttgtgggtctgggcgcttgggagagtccgcgtattctgttgcgagaacatccgcttgagctttccttttcccactcttgcgatttttcttcttgctcgactcaggtgcgtctttgactggtttcttctctcctccggtcttcgaattgtcgttcttgtgtctcagtgcgtcgtccacgtgagcgcatcgatcgacaatttcgaataatctccgagtagtcgtgatgcgcctcgttgccaatgcctgggtagtatagcgatctctgacaccggacttgaaggcgcggattacataagcgtcggtgatctcggggattgtattcctgcactcattaaagcgccgaacataatccctcaaggattcatccgggttctgtgtcaacgcatgtaggtcgtcttcgatcgcgtggcgcttgtaagttccttggaagttggcgacgaactgctgtcacaggtttgcccacgaagaaatcgagtaggggggagatgcatcagccatgaacgcgcagagcctttcaatgcggttggcaaataattcgccaacacgttgtcgtccgctccggcagcgtagagtaccgtggagtaaacctgaaggaattcttctgggtcagtactcccattgtatttctctattgctcctggtcggaatctttcaggccatcggacatctcgaagtgaacgaccgaaagctctacacctagcgttgggggcggtgggttgtcggcgatcgtacgtccttcgtggatgtctatctgatgatgaggatgaggaagatgacgacgatgacgatgggtcgcttggttccggcatacgattacgaggacgtcggccgggttctcgagaatcctgtcgtcgtctcccgttgttatctcggcgtcgatctccatcatcatcgtcattatggcgacgtcctagaccagtatcgcccggcacccgccgttcgcgatcgtcgtgatcgtggcggttgtggcggttatcacggtctcggtcttcgctcgaacggcctcctcgttcttcgttatcgtgacgccgtgaagagacgcgatgtcgggaacggttctcattgtctcgtgtgtgtcgcgcctctcggcggccattcgggtgatcgcggagatcgccggtgccacgaggtggaggggtggctcgatgaggcgattcccgctgttcagggttttcaccatttgcatcgccagttggtggctgttccgggtgcgctgcagcagcggcctcttcgaacgcgttgctgaggttggtcactgattcctgtaaccgttctgtccatcgtgcgagatcgtcgttcagaacgggatcgtagggggtttccctcagtattgcgttgacggccctgatgtgctgggtcggtgtagtcacttgattctccgcttccgcattggcgcacgctgacgtgccggtctcgtcgatagccagtacctcgcacggcgtactcgttgacgatgagccatagtcttcgagcaggtgcaagactgatggttcgtgaggatcgatgtcgattaccccaacaaatcgatctgaaatcggcgtcgctccttgttccttgtcctcatccctgagggggatgtgtgactgctggaccttaggaggtgacgttttcatggcgctgagaaaggccttgcagcttgagaggtcgtgattctttgtcttgtgaataggacaatagacatcacgagttggagaagtacgctgaattccacgctctttgcagtcacgaatttcagcgtggatgttgagaaaaacccagcaggcttgcaaggtatgttttttagttttgtggataggacaccaggaccttgtcacctcggaagtcatcctcgtcggctcgtgattcttgtcgaaaagacaaggtttggccgcactaggatccttctcgggctcggatgtcgtcgacgttccgatctccgcttcggcgggaggatccttcgacatggagtcgtcctgggttgcagccactgcgttctcgtttccagccattgatagaccagccgagattggcaccgtggtataaaccgggaagactatttcgccgacttgtgtccacaccagcattgttgaagtaggaactccttggttaaggttggtgttggcgctgttgtcgacgaagttggatgacatagtagtagaaccttgagcaccaagtccccctacctggcgcgccactgtcgacaggggatacccgtagaccggatatagagggtattggggtacgctggtacgaggatctacgtaatacgacatcgagttggtagaaaacaaagattatactggttcaggccccttgataggtaatagccctaatccagttgatatgggattatatgatggaaaccacatgttacaaagggaatagcggaactcgacgataccgacgagatcgtagtcgagttgattcgactagatcacccggcgacttggctcctgtaggctccggcttcgtaggttgtggtggatgtgttggcggtaagattcgatgccttaggtcctcccggggggtcccttttataccgcaggtcaactggtctccaagtaggacccggagacatcggacccagtacgatacaatgacgacccaattctatccgagtaggactccttccgtctgtgaactccataatgaatttccttaacgtatgccgaaaacgtccgtatacacgcaagtataccatatcgatatgtaacgtatatcgaagggtggagggtataccttacccgtaaccctgacacacgcccttgccacttgaataaagatttttcgatttatttgttgaattatttttttccttctagctttcgagaggggattgtctacagttttttcctacctctttgaaaaaaaattgggtttacttttttttatatatttcatgaaaaagttgactctaaaaaaatctaatccagtttgaatttttttaaatgattttaaaaccgagcggcttgtgtcctccagccagtccgaaagaccgagaattttttttttcgattttgtaaaccctggtcatagctacttcaaggacgtgtctacaacgagaccgttctttgtatggtcataaccagctatctcaatctcatatctaattgctactagtatactcaaaagtgcatgtatttttttcttcttatggaattttctcttagattacccatccgatttacgatccgattacactattgtgttcataacaattaaatctttataacaagatctcacatcactatatttttatgaaaaaatagaaatcaattttataatatatctaaattacttttagattccattaaattacttcttagtcataaaagtaatttaataaagcttgatagtaatttacctatattatagaagtaacttaaaacaaaagtgaagtaacttgttacggcattaaaagaaatcttacattcatgttgtgagttgtttattttataatcatgtttagtcaatgatgtaatttgtgctgattaaatttaatttttatatagactcatgtttttacctccataacggatttacttttaatgtcgtgataaggttactttctttttgttctaagttacttctataatatatgtaaattacttttaggctttattgaatttacttttatgggtctaagaagtaatttagtgaaatctaaaagtaatttagatatattataaaagtaatttctaatttttcatcaaaatataatcatgtgagatcttgttataaagattcaattcttacgaacacaccggtgtaatcggatcgtagatcggatgattagtttaagataaaatcatttttcaagccggcgtagcgtagagcatcacatggcttccaatttggattcctctggatgatgccacgtccgtgaatcaccaggccatgtacagacgcaccagcgcttgtgggatcagacagccgatgagcgtgtcgcgtgataaggcaaaacagagagcgtgcgcgaattagatttcgccctacttcaatcatgtgatctttgatgaagttatagggattcttgtttgccgggttgtcaatgattcaattgatagcacctacttacagcgcggatcgtcaattttattattgtgccggcttgtatatttgtcaaaaggagcaaagatggtatccgatgctcgttcaaatagttttgtgcgtgtggggagctcagtattgtggttgtgctcgcctgctcacaaaaataaagtatctttgttcttggttgacatgtttaacgttctttctgcaacaataagattgtatgggtctcttaactctccgttggttatacccaacaacggtatttgtagagtattattatcgttagtaccagggtatatgtgatgagataaaagagccagtggacaaagatttatcttttatacagcttcgagtctcctatttacgaataatagctccactcctatactgaaaccggtgttgccattatatactaccaccgtttcatattataaatttttttgacttttttattgattaaactttttaggtttgactaagtttataaaaaatattataaaactatattaaatattagttttaatgaaactaattcagtgttgtagatattgctaatttttttctacaaatttgataaaacttacagaagtttgacttaaaaaatcaaaactacttataatataaaacggagggagtatcaacatcacactagtacaatatacaggatgggctaatctagtctctatcagcctagagacgcaaagctctcatatttggttgacagctagaggttaaggtagtcaactttcttgaataagaactcagtgatattggaagtagctctagattccttttatcggtttttatgactccgtattgaggttatatagttttgtgttgatctgtattgggttgccttggattgtcccctctttttctttgtgtcttgtatttttatcttcggatgttcccttgtccaaatataactagggaaccatgtatggatacgattcgagtaaccttgtagtgtctaagttagactctgtttctctttacttatccggaacgattttattccatataagatttggtatatggtgagttccaccaatgttaatacataaatatttccaatatcctatatccatgacactagcatgcgtttggtttaagggttgggatgggttgggttgggatgaacgtatatttcggtgtgtttggtttgagcacaggccagatagatggtccctaacagaaaatattcccataggatctatattgggatagtccataaaaaaactggctgaccaatccaacccacttttttctatcgctgtctcgctgatctgtgagttattcctttaaaagtaggatcatctgatcccttatgctaaatagatagatcggatcatcccatcctaaaaacacggatgagtccaaaccatatcaccttgtttccaaaccaaacacatgctaacagtaaacagtctcttatatagttatatttaatattatcatccatgtttctaaaaaaataatgccaagcaatacataggccggaaatatactcgatctgcaatcaaggaacaaaattggctctaatctctctcgccattttactacgagaaatggttgctacatgtaacatgtaccgggtaaaacggcggggacaaattaaacatctcccgttacagagtcctgtgtgggactagttccaaaggacgactacaacgaggacaaatcacaaaaccaacgaaatccaacaagtagtctacaaggattggtccctagctcgcactaaattccgcaccgccgggaaggtaacccacagtcatacaccgccgtgagactgtgccgtactggtccagaagatcacaaaacttcacatgcacttcgatctatctgctacagggaattgcagcttgtagcattgcgattttcaagctgatcttgtactgatgtactgaactctagctctgaatttttctagtctttcctccagttctccacccgattcggggaggcatatggcacgggccagcgagcagcgcaattacggtacagaaacccacctccattgatcatgacatggccgcgtttcttgttgcacatctcgttttctagttacgtcctcgtcaaaatgatggaaatgagcaactggtcgtggctgtctctccgttacggtgtacttaaatatataattaccgttcaatcaatcacttgtaattatagctgcaccatatcgtcctgtgcattgcgtgtttgtgttcacagcgtggccatcatcaatcatcataattaattcatgagtaagagaatgatggtgccagcgaaaatagttttctttaaacaaccctcataaaaattatactataactgtaagcttatagctaaaaaaacaaaaagacaaccacacgacacatctatgattagaaccctctactgaaaacagagggacacgacatctcaaagagaatggatctctacataacgtcttcaagaagaatatgacacttgagattatcgttgctgctcaccccgagacctaggacatggttttcactctaagaaatccatcagggagggtaggaaaaatcaaacaacaacaccccaagagaaaacgatgcccacaagcgtggccgttgccacacaaagaagtcgggttttcgcctgttatttttctgccaacccttaccgaggtctcctcctggaaaaagaagccatcaccaactgtaaacctttcaacaagtagccccgcgctagcgcctccccaccagtcgcccatcaagtaggagttctaacatctgacgcgctccaaaaccatccatgtagttgagctaaacgagagggtgagagataagaacggatcccctctacccaacactagcccgccaacgtgtccatcttgtggcggcaaggcgccaccgcaagacgactagtgtgtagatcggagcccatggcaggactacacgcccacatcagggcaccatcgttgccgccacctcggctggactgcccactctcaatccacccgtctgcattgctatcgccttatcaagttgctccttgtcgccgccaacactgcctgccacgagccgtgacctctttttcccccggtcgcgccttgccgctccgatcccaccactatcaccatgttggagtcacatcacatctgcttgcgccgtgccagcctcctgccatcatcggctgtgccagccctcccgcgccacgctgtcgtttgccccgtagtgttaattgcagcccccgctaaattcgacgtctgtgagaggggggaatccagttgcgggggactagatccggtggagttagcgtcgaatccgttgccgcgctcaccgaggtgtgtagccgctgccggtttcgctcttttcccccacgccggagaccgagcctagctgggttttggccccaccatcgccttctcagcatgtcactcggcttttctagtagtgtgctccgacggcgacgtggcggagagggaaggagcgggcggcagctaggatttcgcccagtgttgcctgcacgtggacgatgcgggaagtgctcacaccaacgaaaataattgagtagatttcacaaaactatagatgttttgatccaactactataaaattacatatttaaaatattgtattgtaaaactacatgtttgatagtagatttgatgcatgctaattttttatacatcgatttagatttttaattttgtagcaaattactcaaagtatatatagttttaaaacttttataatccaacagtgcgcttaattagcatcgaatcgaacaggccatgattgttctaaaggaaaacccagcagtccattatgcgtgccagatcaagattgaggtagtgcaagtgtagaatatgcatgtgagtatctgtatacatgttaactagtggtctaacaattgaaaaagacgtatgtgtaccaattaaatggggggcaagatcgatcatgcataattaagctctctccggcatggattaatcaatggcacaatcattagtggcatgtcctagtaccaagccaccaaaattagttggaagctgcgtctagactactctagtgtttagcttgtttcatgtccaaccggccaaaagggacaatttggagccaacatatcatagtaccttaataagttttttcttttccgacaaataaattggcccaaattaatttgttgatcaatcaacatctctgttgtgaagaactagcactagtgtctatatcaaattatcaattcatgcggattttgatggaacaattaatagtgcaggctttttgaaaaaaaacaattcttttttatagtagcctaatattcctaggattgttttttaagagccgggttacccatggtgagctgtttcgtagttagtgaccaaaatcagaccaggaacatatatagccgagaaaacaaatgcagacctatcacttatactattattttgccttttccaaacctcaacggttgcaagtagcgatttaagtcatatgaaattgcagcttcttacaaaatcttctgttaccttaaatagtttagatttttcacctaaaattctgagtatacgtaattgtggaatctagaaaataaataagaaatcagaaggtaagaaacccagttttttcaaattatcagtatctactaattataagttgttccttagaatcttaattaagttcccaaaatggccttgattctgttttgcatcatcccgattccgatccattcaacgttcaacgggaaaacatttagtacgtttcgtgtgacagcgtgtcaagtaaacaccagccttgttagagcaagtctaataagtagacgattagccagcagatgatgtctcgagctgacgtggaagagaaaaagcgatgtgagagaaggaagccggcgcttctgcagccgcccgctaggcacgagcgcctagacgtgctgacagtttggacccatatcaagagaaagaaggtatttgacatgtcggtcccaccaaacatataaaaatacttatttatttgtagtagagtatgtgtacagagcatgctattatatgcactggctataacatcttgcataagcccatagcaggctcctctattatccctgctcttatactacagtactaattaatcagctagcagtagatgacagtagctagacaggattcgcaagtaagagatctatctcgagacaatggagcctcgaggaaataattggccgctccatgccatgatcgcggccggccggcgccggcgctataacgcgcatgccagggtagttggaagaaccccctggccggcataactgccagctgaataacttggcagcgcgcgatcgagggcccctcccaaatctcccatggttccatccatccccatcgagtgggtaaccggcctagctatacgtagtaggagtcagtagtaccccgacgacgacaaccacacgcgcgacgcatgcacgcacgctcccccgccttgtcagtgagacgtcgcgcgcggtggtaacaaaccgcgccaagccgaggggtatcgtgttgtcgcgcacggcagctcgcgcaccgtgcgatccaggaattaaacgcgccgccttttccctctcggtttctctccccggccgatcgaatcaccgaactgccccgtcccgtacgtacgtgcatgcgcgttgcgttgacgtggtctatataaggtcgccgcggcgtcaccaacttcccacacacatcagcatccatcgcagcgagcgaccgtcggcatcacaagccatctccctctctcttgtcttgtgatctagctcccgtcgcgatcattgtgatataggcatggccaggtcatcgtcgtcgctgctcgtcctcacggtcctggtggtggccgcggcggcgtgctccactacggcggcggcgcgcagcgtcccggcggaggagaagaagacggctgcgccggtggcggcggcggacgtgaagcagccggagacgttccacgaggggacggtgttgatccctgggctcgggcggttcgagctcggcagcacctacgtgccggacatcaccggagtcgaccacagcgtcccggcagccgagcacgggcagttcctccccggcgccgacgacacatgggtccccaaccccggcttcgaggtgcccaaccccttccagcccggctcgtcttctccctgaatcacccgccggctcgccgtcgtcgccgagctagctagctaggcggcggtttgccggagtaataatgtgtgtgatcccacgtgtccccgtcggtgcacggctgccgtagtggagtcgtttagtttttcaattgtgtgtggatgcgtaggatgcattcagatgtttggcttgatcgatcgcgtgcttttgttagctttgaactcgtaataatgtattaattggtgagtgattatgcaagagctcggtaaagtaattactgttcacgtactaaattaagatgcaattggaagctatacgtctgtgtgtattcatcgtgcaggcaggacggtatatccaaaacactgtgcaagtgtgcattggaggcaggaccatgcaagtacagaatgaaggcagctaggctacgtaccgcatactccatgttgtactcatcggacggtccgtcatcggatcggacgccttttcaccggcttaatttcttcgcaattttgctatatatttgtcgacaaattttcccctaaaaatttgacagatgtaattacagtacaaccgtaatgtaattacactgtaatttgcatgtaattacactgtaactataatataacttgtatgtaactttcaaaaaatctctccataacatattattttggtaaaataaaggttgtgggaacaattttttttcagatatgtgtgtactgtgattttttttcttcctcaccaaaacaaatctttataatagatctaataatttaaaattacgtgaaacttacataaaagttacactgtagttacatgcaagttacagtgtaattacatacaagttacagtgtaattacattacgattatactgtaattacatctgtcaaatttttaggagaaaatttgtcgacaaatgtataggtggtccccttcttcgagttgaaaaggagtaaagagagtagatggcccatgagagctgaggcccatgacagcaggattcgccggtacaaacaaaagggttggtatgtgggccatacggctcaggttttcggtaaacttagcggtccaaagaatgactctggtgaaaagtgatattttgataggatggcaatattaccaaaattttaatatgatttattatgtgtttatcaaagtttagcaaaaaaacctaaatgaaggcacatttttagcaactttgaaaaaaaaatggtatggttgaaaatatcatcaatctgaacagcccctaaattttggttccaaatttgttttgaaaaaaagttaaattggctccaattcaaaccaagacccctatattggaagtttataagcagctcatcttagagcctccagctctcctcatacagcctacattcttattcagattttaaggattgtattatatatttatatatatttatatatatatattctcccaacttctattctctcgtttttcatgcacatattatttataatgtgtattttacaaataattttataggaaaattgctttaaaaatcatattaatgtatttttcaatttttttactataaattcttactaacactaattcgtcgtgctatgagtatctagattttttttataactttcatctatctaaatcaaacagttgagaagatttgtcagtaaaagtttagtttgaaaattttagtccgtgtaacagtgctctcttttcagaaagcccaacattgtcgataatttcgctatcgcattaacgggcctgttagaccggaggcacgagcagttccacccaaccccaaaaccgaaacgccgaacgaaacgaatcgtaaactcccctgctgctacgcaacgactccccaactctccggccaccaccaccaccacctgttccccatccgcacgccacgcaccggcccaaccgattccccaccatgccggacggcgagcggcatgaggaggccccggatgtgaacttctggggcgagcagccggcgacggaggctgagtactacgcggcgcacggcgcggatggcgagtcgtcctacttcaccccgccgggcgggcgccgcctcttcacgcgggcgtggcggccccgtggcgacggcgcgccgcgggcgctcgtgttcatggtgcacggctacggcaacgacatcagctggacgttccagtccacggccgtcttcctcgcccgctccggcttcgcctgcttcgccgccgacctccccggccatggcggctcccacggcctccgcgcgttcgtccccgacctcgattccgccatcgccgacctgctcgccttcttccgctccgtccggcggcgggaggagcacgccgggctgccgtgcttcctgttcggggagtccatgggcggggccatctgcctcctcatccacctccgcacgccgccggaggagtgggccggcgccgtgctggtggcgcccatgtgcaagatctccgaccggatccgcccgccatggccgctgccgcagatcctcaccttcgtcgcccgcttcgcgcccacgctcgccatcgtccccaccgccgacctcatcgagaagtccgtcaaggtgccggccaagcgcctcatcgccgcgcgcaaccccatgcgctatagcggccggccgaggctcggcaccgtcgtcgagctgctgcgcgccaccgacgagctcggcgcccgcctcggcgaagtcaccgtcccgttcctcgtcgtgcacggcagcgccgacgaggtgaccgacccggacatcagccgcgcgctgtacgacgccgccgccagcaaggacaagaccatcaagatatacgacgggatgatgcactccatgctcttcggggagcctgacgagaacatcgagcgcgtccgcgctgacattctcgcgtggctcaacgagagatgcacgccgagggaggagggcagcttcctgacaatacaagattagtatccaggattcactccactctattcagattattgtgaagtagcaaatgcacaaaaagaatgattaaatgtgcaaatttgcagtgattctatatataaatttgatgaacatttgcagtgattctatatataaatttgatgaactgctcagtcaggtttacatgatttatggtataaaatatgctaagtctcctgaccaatgaaagaatgtttccagtttgcgaagcttgccgttgtatcagctctctgccggcgcttctggaggcagtacaaggcgctctctaccttgtacaagcttggcagaacgaattatatctccagttttaatctgcgacagaacttctcttccatctgtggtatacctgcagatgtttgatcgacacagttctctgttgttaatccacaaaataaaccaagtttgctgtctagtggtcacagttctgtaatggcaatcactacttacccgaatactgagaattgcccttcatcaaaagatattcctcctaaaccagactgcacaagataaaggaaaataatcacaaattaaaatatttacgcaattagttcttatacatagggcacgctatgggtctagaaaagcagaagcattcagaaatatggttcacaacacaagaggtagacgggtgcactgttgaggtacatgcacttatgcaatctgaatttaaaatactgtgctagcgaatatgtctagttctaaagatatatccatttactcacatttctcttgtcatacagatagaagaagaattggcttggtgacgagtattcatcagaatccacactatgggccatagcaacggcaccatatacagacatcggaaggactggcaattctccatcctgtattggatcaagtaacaaaggaactgggttatgacttacgaaagacggtaactctcagatttcactggcatttacagggtagtccagatgagtgggctttctttaatatcctttttacatacacttccagtttgaactaaatcgtaaggattttgattgatgatttagatccaaataccccttcagaacagacctaacagtgtggaatactgacctgaatacttagcggagttctgtataacggttcaaactgcccagcaggcatgacctctaatggaacagtgtaacctttctttccattctcgttgtctgcaataattgcctgacttgcacatttcagttttatcccatcatatgccccatccaacacctgaagaaaagttcatttcattggatcagatgatgtaacctaactactgaaaagaaaatcaagagctagtaaaggaaatttttttagcacatcgcagaaacatgaaatcttaaattgatgttctcgaagatgttatgtcgatgaacacaatcatttcgatgatctttatcatatatgtcagaaggcagagctattggcaggaaataatcaatagtgagatgaggttggagttaagctaccttaccaatttcgcaaagtttccagcagtcagtggggcagaatatccatcaatcactacctggaaattagtaaagaaatcaatagctgacacgtggaattttataactgcaactgtatacagaaccatactcttgcacaccatggtatgacaaaagataacaaccaaggataaggttcttatttctcaatgtcaaaagactgcagtttatgataccagacaattacacagccattcaaagccacctgaattgtagcaacactttttggttcaccaccagcagttggaaagaatgttgaaccatcacctttctccactgagaattaacaactcctcttcctgctagcctattaaaagcgagctgtttaaattaaatgtacatatgaacatttcgttacagactggaggaatgattgcatgcttaatataagtgccacagggatggaatgttcaaagcaccattacacttagggcctgtttgggatgggagggacttatt

SEQ ID NO: 4823 - DNA, 4221 bp, Oryza sativa
gaccccaaagacccaaaacagaagaaaaacaggggacctaaaggacgactaagtaaactaaaaacatgcgctcaaatttaccgacattgctgctgaagcgatcagccaatcagaacccaagaaaaattcaccattcctcagagttcgaaaagaaaaatgcttgtgaggttttcttgccaccctgtaccaatctggccttaatgattttataatactatgtgatgatatatgttataaataaaaataagttcccacttggaattaactagaaagtactttttattcgacagtttctactccatgaaatatatgaagggtgacaccagcaataaatagtgagtttgcaaatatgataaaatggcaagtttgtcaaaaccaattaatttgcaacaatggaaaaactggtaagttttctattgaattcattttgaaaacctactaatagcggcagctttgattattaccatcaagaacttgggggcagagacctggttatcttaaaacttatactgacatagagcttatacttgtttgcaggacatagaaccatgcatgtcagtaactcagtataatcaaatgtcaccttcaatcttcggacctatctctgcccttccctcacaataattctagagacaaagaaacatttagattttaagctttggagagatcaacaaaagttaccttggatattccaaatattgttgtggtaagaggaaggataaacctggagcctgttgaaagaaatttccccctttaagtaatccgatcatcgccggagtataatcatcctcctttaaacataatgaaacttctattcagtttagtacagttacctgtaacagctccaattcagcaacagtatcaagagaagaagcaagtgcaaccgaaagtctgtcaggatcattttcctttatatatttcaagagagtttgcaaaccaccctgcagttgattccaaagtagctcaggtataatttataaataagtacaagtgaaaaccagaatttgatctgtttcataaactgcaattcaccatgagcacatcctagaacctactgaccttctcttcaagcaaggaggtatataacttcgagcccttttccttgagttctacaggtatacttgccaagatcgcatccttgttgtccattgctatctgcatccagagcgcatttgttctatatatcagcattcaggacaacagctcagcaagttcaataagaagttcacaatgcatagaagaagcaaaacattgttgctagaaaaatgcttatgaagaagacacagagtcaacttattaccttcatggccttttttacgtctccttccatggagccatacggcttcctctgcggtatcctcagcaaatacgaaatgtcctccagcgattcctggcaaatgggctcgcacaatctaagaacaacgcccagccaaccgtactaagcgatatgcatcgccgccgattctgatgcagtttacctgtatggtcttcatgtttgggttcgcggggatggccctcctcagcgccagctcccccgtcctcggcacgttcgtgtccggcgagtagaggatcgcgtccgccgggagcgacacggaaatctgggcgatgacggcgagcgccgcgaccgcgcccttgagcagctccaccactcctccctcctgcaccaaaccagacaaccacacgattaaactgaagcgaacgctacagctttggaagccatttggatgaggagagaccagcaaccagcgcgtgctcacctcagccgcgcaggagggatggtccgagcgacggtgggaggagcaggagaccctcccgcgaatgccgccgtcgcagcacctggcgccggctgcgaccaggggacggccgggaaacacaggaagggcaccggcgagcaccatcgcggccgccgctcgcgacgccatggcgtgcggtggattggtgcgggagcgcgggtgcttttgaatggatttccggtgggttgagacgcggggaggggaggaaccggagatgggggtggtggtggggatgccgttgctgccgtcgccgtcgtcgtcgtcatcgtcatcgtcgtggtcgccgtctcgtctatccccagccagtgagctgtgatccggttccgaaccgcctagttttgggccagcggtgaacggcccagggacgatacaagagcccaaagcccaatactgtcccgtaaagagacaaggctgaaatgccttttgcggccctgttacgtcaacgaggcctgagatggtaataggactgcattaatcacaggttttcagactctatcccaaaagaaagcacacacacatatactgccatacccagattcagtgtactttccactaaaaaatcgaagtgtattttttctcttaaaaaagactcacggtgtaaatgcttaatgatcggcaggtgatgtagtcacaatcatccctctcttaaataatattactgctaggtgctgtagctaaattaaagactgaaataactcagaccacggaagtagctggagagatctattgacatgcacgcatgtcatgatcaccgcacgagcgtacagccgcaacccgcagacatgccatcatcccgcaatcctattccaaccagcatccgagcagcccacccggcaccgcacgctcacgtacgcgacacggtcacgttcgcgccacgctggacgccgtcgccggcccgccgccacattcccgagccccagaccaagtgccaacaccttacaccgtttcgttcccgcaccggacgggcccaaagaaaccgtttccatcaaaccgccttgcggttgcagctgccacctcgccttgccggcttgccccacccgcccttctgtccaccgcgccgtctcggcgaggttgctcacgtagcgcgcgctttgtagtactagtatcgaccataacttgcgtaaaatccaggacggtttcatcagtcacactaccacccacggaccacagtagtattcggcgcacgctagctatgacctcgcgcgcattgacagcgtcgtcgttggggtatgctgcgtgtgttaggtgctctcgacagcgcgggattcatggagcggtggcgctgatcggggcacgaggggtgctccccgtcctgcatgccgcctcccttaaactactagtactactactgctcgatcggcacgagcggtttttttcattcggatgatgacgacgacttcagtttcttctcgttgataggttaagttagatcaacgcgacctgattattgttttggccgcgcagcgctataagaatggtggtggcaccgtaccactcgagggaagttagcttgcacgcaaagatacgtttaagatggcacgaagctagcgtactagtagtgactgtagtagtacttactgtttcaataattgttttggataagtactaatgtagtggtagctcgtatgtgaatagtttagtagcaagattagtacgctgtgattgcgttcggtgaacgaggacggccaatgcaaagggcactaacatttgtcttgacaacgaataggtggcccatcattgattgctttgttgacctcgatcatccggaaccgtgctatgtcgtgacggtaacaagcagaaacggacaaaagctcttagctgatatgctacctagcttcctcgagccctgcctccgtccgagctccagctgttacgacttgcgagtactccgaacaaggcatgtgtttgttgggactatggggttgattggttggcatactcacattactaaaacttgctatacttcatttagctaatatgtctaacatgtggccaataaaattaaagccacacttcagtcataggagaataaacttgccacacttttatatgccaatgatatgtgggacccacatcatggtgaatgaatcttgctaaacgtatggcaccaaccaaatgaatgactaattcaaacatggctaacttgagttgtggcatgatgaggcaaattgtggtagtgaaccaaacaaccccatatatattctagtctcttttaaactacagtattcaggagcaacgaggaagagtacttctcggtaggaacggccgtatctatactttctgtttactactctctccatttctagatgtaggtaaccattttcggtgtaaatgagcacaagatcgaggaaatagcccatatctgttagaacgtactcgtactgtacaataatagaaataagcaatgctgtagtactgtgtaaggggg

SEQ ID NO: 4824 - DNA, 1810 bp, Oryza sativa
cttttggacattacgtggctgctatctgaaccacgtcaggctcaacactgtcctccaagattagccttgtccccggggcgacggccgacgggggaggaagaagcagcagctccatgcaccggcttcctctggcctcacggccaccgggtccgcatcgcgcggcggccgccgctcatcgcgctccccagaggacgacgacggcgtgctgcggccgcctgaagcaggaggcgacgccgtcatttgcctctctcgccgtcgctgcgtctgcggcagcagagcgcgcggccacgccgctgttggccgcggcggcgctcctcctttctgccgcatctcctggcttcctagcttccacaccatcaggttaatcctctatctcaaacgtcaggatgcgtagtactagaatctagttcctcttgaagttttttagtggggaagcagtagaggaacataacagaagtaactctgaatgattctacacaagtacaccgagcatgattaattgccaatttaccatatttgctgaaatgtacgcgtcgcacatcacattctttcccccccttttgttgttgtagcttttgctcaatccgaaggcgcagcgctgttccggaaggcgtgcatcggctgccatgatatgggaggaaatatcctacagccggtaagcttctgaaaccattactcgatggccggacacaaattttcaacctttttattagcttgctgatttgtcatgtacagggcgccactctgtacatgaaggatcttgagaggtatgtgtgctcttgaaaacttttaactgctcgaaatttactgcccattgttggattggatcaaggcaaaattaagggcaaatttgctgcagaaatggagttgccacggaggacgagctatacaatataacgtactacgggaagggaagaatgccggtgagtaattcttagctgctatcatgatgatgtttgagtagtatagatagatactcattaatttcttgattgtatgtttgctgcgttaagggcttcggagaaaaatgcaccccgagagggcagtgcactttcggacctcggctggtcgaagatgatatcaagctactggccgcgtttgtcaagtcgcaggctgaaaatggctggcctaagatcgacggcgatggagattagttcaccgacacaacagagacaagtggcaaacattgttcagtgaaccagtgtatagtttggagtcaggtgtgctgtttgcatctgtaaaatcccaacgaaatccatacaaataaaaagtagcttaggccgtgtttagatttcaacttttttttcaaacttccaactttttcgtcacatcaaatgtttggacacatttatggagcatcaaatgtggacgaaaaaaacccaattgcacaatccgactgtaaattacgagatgaatcttttgagcctaattacgccatgatttgacaatgtgatgctatagtaaatatttactaatgatggattaattaaatttaatagattcgtctcgcagtttacatgcggaatctgtaatttgttttgttaatttgttttgttattagtctacgtttaatacttgaaatatgtgtctgtatacttaaaaaaaatttagcacacgaactaaacacagcattagtttcaaaaaacatgtgaaattcatacaaaaaatgtcatgtcaagtgttgtacataggtggcaagtcagctctctgacggcggttggtagggttggtgaggccgagcgcgacggcgaccgcagcatgggttgtggtttaaacacgaagaaaacacgaaagcttttgtgaaacgcgc

SEQ ID NO: 4825 - DNA, 1662 bp, Oryza sativa
ccaccaccaccaccaccaccaccaacgccgccgctgattccaccaccgatgcctcctccgtctccaaccctgaggacgatcccatcgacgagctcgacgtgctcgacgaggacaccgcgtccggcctaggcgcggccgacgaggtccccgcctccgcgtccgcgtcgtccctcgtctgggaccacgccgttggcgtcgcccgcctgcccttccgcctccccgccgccggcgaccccctcccggcggggttacctcacctcgagcccgcgcaccggatcgccgccgccgccttcggatccgacgacgagccggtggatctggagctccgggtggagatctcgtccatcgccggcgtcgaggacgcgttgctcctgaagcctgcctccagcgcccccgagactcccctccgtgctgggtgggcgcggtggctggaggggaaggctgactacctccggcgcgatcggatgctgcggtccaacctagaatttctcaatccccgcaaccacccgctgcttcaggacccggacagccccggccttacctctctcacccgtggcgaccgcatggtgcaccggatgcttctcgccgagatagagaaggctgcttccaaaaattttgagcggcggagtctgcaatcgtctgatattaagcagggaatgggagtaaccgagaaggtgcagcagaggaggtggggatattacccgggaattgatccacatttgggcttcaatgagttcatggagaagttttttgagcatgggaagtgctccgtgaaggtgttcatggtgtggaacagcccacagtgggcgtatggcgtacggcaccagcgtgggctggagagcctactgcggcaacaccctgaagcttgtgtcgtcatgctgtcggagacactggagctggagttcttccaggaatttgtgaaggaagggtatgttcctgtagttctcattctgtgactcttgttaagggtagcatttgattaatcataggtgctaattttactatctaacactaattaacaaagaaatgagtttatgcttctgacccaaaacctgaaatgatttgattggtatcatatagaatccaggattactatttagtgtttgatgtatcacatactactaatattggactcattagtaatgaaactagcaaaaatgtttctggagtcttgtcttattgacacatggagtgaaatctgatcaagtagaggggcctggtatatattccagtttgacttaatttaacaatttttaaatcttacaaaatacaaatgatgctcatagaagtagaacctaggtaattcctagccatttcagtgtttgaaattctgctacagacagctaaggtgttgtcgacatgttaatatgttattttgaatcagcttatagttttcactaccagaactctctctctctcaatggccagtgtccgttggtggctatattgtactgttatttgagctctctctctctggaactcattgtattgttagtggcacttaaaactcaattctatagttttttctgttttgtgatggatttggttcattttctgccactttgcttggaaagtctatagttctgataaccaaactgtgctcctctatatcttttcttttcagctagaaggatcctagtccttcccttttccagtaaagaa

SEQ ID NO: 4826 - DNA, 2046 bp, Oryza sativa
  unsure (1)..(2046): unsure at all n locations
acccatgacctacctcaccccattgttttttctcctccattaccttctgtcctgtgtcattaggtcataaccagttcagtaactaacagtctgacatattgaatgctcaacagctacacacaccatgattactaccttgctcctgctgtgctcaagttttttttataaccctgttacttttgtaatttgaagatacatttattttaacatttccttttgttatttgtggagtgggaaagcaacttatctatatattaccgttgctactaactgctaggtactggagtcaaatcatctgttgtcagttgatttcttatattaaataataaaattaagatatttctccacagtaactattcatttaatgttatatttgaacttcacatttacattccagaagcagcttctatttattttgtgtgataactaatgccacttgcatgtgactggtttcctcttacagatacaaagttgcagttgcgttgccgaatcttgatgaacttttggagggcactctaacccatgattttgtatcagtgtggaatgaatggcggaaaacaaaatactaccccttgcattacagtgagctagtacgccttgctgctctttacaagtaagacaagaaaggaccagacttgtttagttacatgcaagcttaacttcactctttacaatctgttagaagaatatagggagatgtcaatataccttcttgaaaataaaatctaatgtagtaatatatccatgtagacgaatccacaagtaatttactcttggtgaaagaataatatctcttacaaaggaactgaccgacaataccactgaaagaagatgagcagctttctgctgaatttaatacactgatttgtaatatatatataaattcatatgcctctaaaagtgtaactagcatgagcgaacatcaaaatgcaaatacagtcaccaacagattaatatattcaattgcttacaaacagccaaagccaaatttacattcatactgaattgaaatacttccttcacaaataaacattcagctaaacagagcataaacatcttattaagaggtgtaaaatgttctttcctttagtggaccactttagaatttctctggagctgacttgagctctgtgtatggattctcagntctgctgagctaaatcagtattttgtttgaatgctgccatgaaaacagttgagtagttgacataacataaaaggggggaatcttcacattcacgtatgaaaaaaagatgagtgctacaaactgtgcgaggtttaaatgccagtagcattcttcctgtaaacaaaggaaaaaaagttgaccagcaaatattatgagacttcatagaattttactttcgtcatactttattattactggaccaatagtttgaaagacagtatacttcatttttaattagttatattgctatttcgtctgaactaaacatagtcatgaatacatgtttagttccttttcttttttgaataggactattattgactgctgcctctgtgccctatctgcagatacggtgggatataccttgactctgatgttgttgttcttaaacctttaaacgcactccggaattctattggtgttgtcaaacaagtttctgaaaattccagttttagtggtgctgtattagcatttgaaaaaaacaggtaatagtattatatacttttctttcattgtaactgtttttttttgctttaattctggtcatcttggttaaaatgatatgtggtgcttttctgcattgcaaattggatgtgatttagccagttacccttcaagggctggcttagtaagccaattgatcaagagcaatgtcggaaacgttgttcaaatgtcatcaaattaaatgagaggtctgtgatgtattagccgggtgttactgttatggaagtaataagtcttttagtatgctttaataaattaatgcaatttagtcgaaagcacaagtcagtactactgtactgttatctactccctccgtcccaaaatatagcaaccttgtactggatgagacacttcct

SEQ ID NO: 4827 - DNA, 356 bp, Oryza sativa
aaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggt

SEQ ID NO: 4828 - DNA, 2029 bp, Oryza sativa
atgctctcatgcatagggtaacgtgctttcacacaatatttactattcatatattttgtatgacaggagaatatattggtgcaattttgagagaagtattctcgaccacttcacttttatttatcaagaaaatggtacggcctgctttaacttgttaaatactagatatattggacgaaccaatggctgccatatcttcgctcaaaatttgaaacatatacaattttgaaattttacaatacacagtcccttttgttgtaaatatatgaggatagataaaaccttaattcatttgcacttaagattaagattttttttatctagtacttgtttaaatgggtagttttaacccaagatattttggataggaggaattggaatggtaatttaatgtgttgcttttacatgaaaaacgagactatccatcatttattcttggagtttcactatgcaacatttctttgaagagcattgaagttttcttctggtttatccactccacatattatatctcatatttttgaaaattggattgtagggttgataaaaaaaaccaaaaaacacatcctcgtaggatcatatgctttatgttggaccgtatggttgagcaaaaatgatatgatttttgataaaacatcatctaaatcttattttagatgcatttcagggcaacatattggtttcgatcacgtgctcatgtataaaagtgtgatgaagacactaaggctgtgttcccctcctccccgacacgcaaaacgaagctcgtattattgcatgattaattaattattaactatttttttgaaaaatagattaatatggttttttaaaacaactttcgtataaaaagtttttgcataaatcacaccgtttagcagtttgaaaagcgtgtgtgcggaaaacgagagaagtgggttgggaaaatgggggaagaacacggcctaagagcaggtacaatagcagactatttactagctgcaataaaagatgagagagaaaagcagcggactatagatctgtagccagctatagcacggactataagacacaatgtgtgtatgacaggtgggaccatatactaatagtatagtaagcaattattgtatgaattagctatttgattggctatagatgaattggatctagtagtgggctatactattaaacttgctctaaggctttgttcgttgcccctagttcccaattcacccatctagttttccgcgcgcacgcttttcaagctgctaaacggtgtgtatttttgcaaaaagtttctatacgaaagttgcttaaaaaaatcatattgatctatttttttaaaaaaattagctaatatttaatgaattacgcacaaatggaccgctccgtttttcatgcggggacatgggttgggggttcccaagccagactgccgaacaaagcctaagttaataaaagttgcatgtcataaaatggagtcaatggctatgcaactattcacaaataggattcaataagtttgtgttttatttttctattggtgttagtaccagtgtgcacctctatcggcttggatgcgttctttatgtctttttgtgaggtgtgattgtgtgtagaatttttttaataattggttatagctctgtgagcaaaatcaagaattctattctattattaaaaaaactagcatggtggcccgtgcagattgcgcggctagcatcattatatcttctcgcatatatgttttctcattatattattcaaacatattaaagtaacaacatatttttaaattttgcaaaaactttacaaaactactaatgtgtaatattcatattatattttatgtacgtgttatttattaattatttttaatatcaaattttagttatttgtaagttatatatattccaatatggactctagactcgtattataatatttctttttttaattccgaattttttctgtaaattgtatttctatatagactctgtgctcttcttccagtattatttatttttatttctgaatttttattatttctaat

SEQ ID NO: 4829 - DNA, 7962 bp, Oryza sativa
acttctaatattctttattttttttaattctgaatttctattttttttcttaattgtatttttatatggactctatactctacttctaatatttcttatttttaatttcgaatttcagttatttcctaattgtatttctatatggactgtgtactctacttctaatattccttatttttagttccaaatttcagttatttcctaattgtatttctatatggactctagtctcctcttctaatattccttattttttaattccgaatttcatctatttctaaattatatttctatatggactctgccttttctttttctccgattaatgtgagaatttctaggccatgggagcgaacgtggatgctcctttttctattcctttaataatataactggctgggtggcccgcacaattgtgcggctagcacccaaacaaaatcatatatattagtatgattttacttaaaatttattaaatagctatctcattgtattaagagtttgaaagaccaaaccttatcatccctgtgtttctaattatattgttttttaaaagtcacaccaattgctactcctcatgtcatctccttctttatttgcttgctcgatctaccactatttctattcattctccttataacctttaaaaattggatcttatagtttttagagtttattgttacgttgggtttcgtttttataatttctagacgtccagtcaaacgttgctattatactcttctatagcccgtccactgtctcttctctttattatcattgagattttaaaaatcgaacataattatcgtttgggttcatttttactttttagaagtcccgccaaaccgtcagcggctttgccattgtacttctctatggctcgtccgctgccactgttattgagattttaaaatcgaacattattatcattgtttttttttactttttacaagttctgaacctttaaaaattgaaccttgtagcttttagagtttatttgtcttgttgggtttcattttttataatttttagaagtctcgtcaaacgatgccactttgcttctctacggcccgtctgccgcctactctttattgtcattgcgattctaaaaccggacataactatcgttggaattcattttttattttctagaagtcccgtcaatcgtcggcggctctataactatactccaatacacaccgcctgctgcttctcctttttattgtcattgagattttaaaaatcgaatatgattatcaatggggtttatttttttttactttctagaagttccggtaatcgccttgctcgtttacttcacgaactatctgtcatcctccttttaatcgtcattaggattctatttagtgctttattaatagtttttatatgtcgtatcaaccgccaccactctactcttttataggcctgttacttaatttatcccgtcatatgttttagatgatcttttatttcaatagtctttatttttatcataaattttagttatttataaattgtattcctaattgaaatcttatttttctttttctaatttcaaaatttatttttttttcaaaatttaattaatatcgtattgtgttcttttaatatatttttttattttcaatttcagttgtttcaaaattgtattcctacttgaactctcttttagtttttctaattttggatattattttatttttattctaaattttaattaatctcgtattgggttcttatatgtattcttctttcaatattgcttatttttaaatacgaattttagctaaatttaaattgtattcctacttgaactcttctttttttttatagtttcggatattatttttattattattcccaattttaattaatctcgtattaggttcttatatggactcttcttttaatattccttattttaattccgaatttcagctattttaaaattgtattcctacttagactatcattttcttttttaattttggattttattttgaattttgattaatcttgtattgggttcttatatgaaaacttctttcaatattgcttattttcaattccgaatttcagctatttttaaattgtatttctacttggactctcctttttttttctaattttagatttttttatttttgttttgaattttgattaatcttgtattgggttcttatatggaaacttcttctaatatagcttatttttaattctaaatttcagctatttttagattgtatttctacttggactctcattttcttttttttctttttatccgattaatgtgggaatgtctaacccccacaacgaatgtggtgtgtcctttcaaagctgttttaataatataatagatagatagatagatagataaatagatagatagataaaaaaaagaagaacaagaagggaatagggcctcatctatgtcgctccctctccagggcgacatgggcggcgaccgaacaaacaccgccgccatctccttctttctcctcctaccttgccgctgcccaagcggcccaccagcaaagccgccggccacgagggcggtggcggggctctctctcccattgaaattttacgtgtggacttgcatgttgtgcataagcaaaatttaaccgaacatgtgtctagtgaatagtggtggagttctcacatcagcactgtaattccaatggaccgagtatgaatgaacccatggaatcgacctattaatcaagccgtcaagacgaaccaatcactcgttcaaaatctatggtgcataattagctttagtgtttgaaacattaaatatttcagaatgaatcatcatatggttttttgtagggaacatcatatgatttttgtatgaatcgaattttgttttgtttctatgactaatggaacaggggttttgcccttatgatcgtattgaaaaaaatgtacgaatcagcaaagacacacactacttgttcttaattgagtctggtgtgagaccgtatttgatattgctcacagggcttgttcgtatgaatgtgaaacactatgatacagacgtgacattgatttcaaaaagattatcatatattatacatactgtgtgccgtccatattatcatgtggtaaacgtacggctgctgcacggctgcacttccatctttcatgcactcatacatgagaaagaatgcataaagcttgagctttatgaccagccaaattagtcagaaacgtagactgttttaattgtcaactgtcgtaaggtcagagacacggcaacggcgaccaaccaaactctactcggctcctatgtgtgcaactagcatatgttcgacgttaggcaccaacttaaccataactttaccttcacctataaaatcaagatccagcaaaacattgtccaagatagctcaacatcatctaagaagcttttgaagattgaaagaaagccaatggcgacggcgagggtggtgttcttgctcctgtttctggtgcagatcgtcggcgtcctcgcagccgcggcgaggccgttggaggagaacggtgtcgatggcatcgcgacgcagatgctcgccgccgtgaaatcgaggggcaacaggcgcacacactgctgctgaaggcaaatgtgttgtaagacattgatgatgtacagcttagccattcttgactagtgcagagaaaagaaagcatagaagttgtgtgagggtgaccagtccagaggagagaaagcagagcagaagatgtgtgcggcaatgccaagttagtgcttcatttttttttgttgtaaaaagtgggatgatggatacatattcattctttatattattcttcaccttttcaccatagacacataaaaatatttggagattaatttggctgactattttttgtttcaaaaatcaatgtgttatatggtgtcgctaactcactatcagtttttttctcccttctttcttcttaattgattccacgcctatgtataactagaacgatagactttgtaaaaattgtactgagattttgaattagttttttctgttcgtttcaaaagaaagcttagcatttttttcccgaaaaccatggaggaaaacagaatactgtctcctaactagtagctaagttctcctagctagtagctaagttctctcacaattgttaagtttattttttctagttttaagcttgtgttgagcaaaagcactcatggatgtgggtggtgtgtactagtgtatatctgttaacaacagaattttgtttcgtatgaacaatatcttccatgataaattaaaagataaagcaagatctgtgtacaaagttggaccctatgtatagtgcggctttttaatggagactttgaaccataaaaaaacaaagtaaaaaaatcttagaaacataatatacatgcatgtttcattttaatgtatatatctaaatgataaatcatttattttgtttgatagagcaaacataaacaatatgagtaaatagattggtctgtacaaaataatcccatcagaaaaataaataatgattatgggttacaattaatcccaccttgataaaaaaacattatttatgatatattgttagtccgtgttaataagcattatagaggtaacaaacagcataaccatgtcagtgtctgatggttgaactagacatcttgcaaaatattatatttaacaacaaaaaatatgaattaaattataaatttcgtagtttagtaataagtttatgcaacaaagaaacttattagaatattaaaaaacggcataataacccatattttcaatccctacattttgtcacgacgttttattgtatagtggttcacttcaatatcttgtatctcatgctatagagagttttagcaaacatatagttcggaagaaagaacaatgtaagaatatgagctatcatgcagcaaaatatgttcaatggtctatctagcttgcattgcattgagagagagagagagagagagagagagtgtgtgtgtgtgtatatatatatatatatatatatatatatatatatatatataggaagcctatattctactcccaggagtagctactcctattgtaaccatcggacacctgtccaactcacatcagggtttcgggcttcaactcactaacggattgtgagaaaagatccattaaaccagcgatgcagaaacttgaatattctttttttttttgaaaattcggatcactgcgctgtgttctgcatggtgagtcattttgaatgttctgcatgcatggtttgttacccgcacgcatgcacgaccgagcgaccaagagagtagttagtgtggaggttgttgtattgatactctatttaagttgacggtgatggaggacagaaaatgaggaccacaattatctttcggatttgtgaggaagaagattttgttctgcaggtttttgatggagcagaaactctccggtggaaagggcagaatgtcgtcggcgaggtctgttgcgtcgccttccgcggcgcgagtaggcggaggctcgtcggcgcctgatgtcgagcagcagaagtcggtggcagccgtaggcgcgtcgtcgccggtgagtagtagcaagcaccatcatatggcgaaggcagaagatggaaccattacagttaatggtgacaagcagcagaatcctgccgcagataggtacacattgaagtttagttttagtttatgttctgttgaaattttttctcttgtttgtttgtttggctctaactggttattgcgttatttggtcatcaggaatggttttgtgcgttgcatggatactgctgcccggagtgaagtgatgaaccactctctccaaaaatatgtcattcatttcgatggatgtcatcctcttcccatgagaaatcctaggaagagatgcgcttggtgctcactccgtgatattcgcgcggcttgcgacatgaatttcagaagcaacgaaacaacccgggtcaacagtaatggttgcgaacatgtgtccaatgaaaatatgtagacaatagtgtgatgatcaggaaaattgtaataagggcttgctttctgcacggtcgtagattagtcgtacgaactgtctctaattttgtatggtattttctatgaggaaaaagcgagtagtatctaagtttagaaatctgtatcttctgctgtttgggaagtgaaataaaattgagatgttatcctttcatttatctatttaagttgtgtgtactgcaaactccctgttgtcatcgtgaatgcaatccttcaccaagatgaagttcttcgagcagaatattgtacaagaatggagcagagatttcgaattggtttctgtgagtgtagcgttgcgtactcggaatgtttgttatagatgctatttttgtggcggtatggtttcatcagaattcgttaatgttgctagtggctgactttccggagtccaataacatgcttcgcacgtaggagccttgattttcggggaggttgttgaacagctaatggaaaataaaccggaattatttgtcagtatatatccaaccagctggaaaaaatgacgccctatagcaaattctgtttgccaaaaggggtagctaccagaatccgtgctggacagaaacaatattcgcgaagatagctatggaggaaaaaggctggccggagaaaggtggcgaggatcatagtggacaacccatggacgtagttccgttggaaaggtattttttatgtcagtgtgattgtagtgtacaatttccctttctgcattgttagctgaattctcatttttttgatcctaggatcgtggttgagggggaggaagatagtgatctgctgcctatttcactctctgacccagccattctgttgccgaaaattgggcagaccttcaatgaggactctgatggctatgcgttctacaatctgtacgctaggttcactggttttggtataaggagatccaagaacagatacaaagatggaggcgtgaagtccatgcaagagttctgctgcattcgcgaggtaaaaatctttagtgtattcttttttttttttttgaaaaccatggtttcgtattctcgtaagattggcaaggttctatagtgtgatgcgtaggatcatcatttcataggttttacgtagtaaggtgttcctgtaatttatgcagggtagagataattccgtcactggtccgccgaccaggataggctgcaaggctatggtcaggttaaatcgttcttctgaaagtcaaaagtggagagtttctgcattcgttagtgagcacaaccatgaaatgaaacgggacctgcagcatactaaacacttccggtctcataatttcattgatgaagggacaaagaggaacataaaggaaatggtagataatgggatgacacctacagctatgtatggattactttcaggtatgcacggcgggccatccttaaccccctttacaaggagggctgtgacaagaatggcgtatgccatcagaagggatgagtgtagcaatgatgtgcagaagacactgaatttttttagggaaatgcaatgccgtagtaagaatttcttttacaccatacagattgatggtgcttcaaggattaaaaatatattttggtgtcattctctttccagattaagttttgaccattttggggatgcaatcacttttgatactacatatcagactaataggtacaacatgccatttgggatttttgtcggtgtaaataaccattttcaaacagcaatttttggttgcgctttgttgagggaggagacaatcgaagcattcaagtggcttttccaaacatttactgatgcaatgcatgggaagaggcctgtagcaattttaacaggtatatgtttatttggatggatcagtggtgtgtttaatgatatgtcttctgtttttaatctcgaatggttgtgaacttcttttttagataactgtcatcaaatggaggtggcgatcaaagcgg

SEQ ID NO: 4830 - DNA, 8364 bp, Oryza sativa
tctgatcagcatgttctgcagctagtccatataggtgatgacaccttgcaaagttggggcagcaaagaatttaaggttcaggttgacctgactgaacaagatctgtcatgtggatgcaagctttttgaacacttgggaattatatgctcccatattatcagagtaagtttgaatattaagcagttctcataacgctgttgtgtttttgtgtgttaatgcatagtgtttttgcaggttatggtacagtatggtttcacggaaataccgaagaagtatatcctgaagaggtggacaaaagatgctagagattcaatcccaaagcacttggaggagtcgtacttgaaggataaggaggcggcatcatcgagaacttatcggaacaccctcctgcacaagtctgcacttgatatggttagacttggtggtactagttcagaaacatatgagaagacagtggaagtgttgacaaagctgattggagaacttcaggtcatgtgtacttcgcaagttgtaaacaacaaggaaattcactacggagatagaacaattgggaagaaacctactggtgtgcaattggatgatagtgtagacagttctgactcggagcatggaatgtctgatgaattttgtgtagccgatgaggacggcattggacaggatgtttctgctggtgaggattcagttgatgtggacatgactgatgtcaacgaagaagacatactccctcctgaggttagaagaagtcgtggacgaccgaggagtaccagactgatgtcgaagggagagacatctagcaaagcaaagaagaagaaggctagtgagagtacctccaaggacgagtcgaagaatcacgccaaaggaaaaaaagagtcaacgaagcagattaggtactgcaagcaatgtggtggtcatggccactataagagtacatgtggtcggaaatctagttatgagaggaagaagtgagtgtaattattctgttcaatgttctgcagggttgatgttagcatttcgtttagcatacaatggaaattttattattattaaatttcgtcagcagaacatgtagttcattttgaatatttacatttggcaaacattgtaggaaatttgcgaacactagttttgtattttcctattttctgttgtgcctcagagtatgtggtgaagttgtagtctttggaagcatcctattggagcagaacatggctaattgtttctgctagaggtagtgttggacgaatcttcgtgggagccaaaaacgtttttcatcatgctctgcatcgggagcagaacatgaaaagagtgcgtgtggtgtttttttagatggggtttagcacggtagcagaacatggctagtagtttctgctgttgttctggtgggatgttttctcggcagcagtacatggctaatagtttctgctgttgtttggtgggatgtatcctcgtggtagcataaatcaattggcatactgttctgctctgggagcagaacttgtctttttttcgccgggcatgcactgatttggatcgtgtcatgatctgctctctaagtttggaggagagctgatcacgtaatgtacggcaacagaagatgtaattagtttgtagtatttaatttgccataggtgaacatcatggatttgatgttgggaaaatctaaatttatgatatttggaaggtaaatgacaaattcattaatttgggaagagaataacagagaacatgaagccttgaaaaatgttgaataagaacaagacaaatattattgggacctaacaaattttagataataatgatgtaactgaatgtaatctttattttggcatgcttgcataacatgctcagatcttgttagataacttcaggcagtgaacgacgaagtccggcagaatagcttcgttgcctttgaatgacaataagttggacagaaattcctttcgaagatctcgttgatcctgttgttaatatagaaaaatatttattataaaaggaagctacttcaatgaaacttaagttgaacctagtgtgtacataaaactcacagattttggggggttcacaaggcgagttccatcccagtttcgcatgtagtagagcacgtgaaaggcacatcccagcctaccaaaattgttattattgtaatgaccataaatgagtagaatgaaaaatttaatttggatcaaattgggagcatgaactgaaaccctgttgttatagctgggatggccgaagggaactcagaaacccagtttggtatatcctcatcccaatctgaaaatgcaagcttcatgcactccttcagagcagatgaaatgtgaaattttgtttttaagtgtctttctgctgtatcctctgatcttttcgaggcgtctctcagtgggtcaagaatgcataatttttttttctccatatcaaatgcgtatagagaatagtgcaatggttgaagtagtggaataaatatctgcaaattaatattgacattgcaaaagttagtggcctgaacatttgcacttgatgtactgaatttttcaagatgctgttaattatcaaaccaggtggcaactaggtacgtcatatggtatcagagagtcatctttgaatgaggggagatgatcctctgggttccactggtcatcaccagctgttgcaaacatctacagcgccatattgtgttaaaacacaccatatttcagaattaaaatagtctagagtaattggaagcacttactgcaaaatcttgatttaagaaatgtctccagcatacaaaatcagttcctccaaatctctgtatctcatccgctgctaatacttgaactgcaacattgaatgtttcttcttgcatttgagtgtctagccgaatagcctgttgtatgtcatgtaggcttaatgacatagggacaggttgggagatgtgaacccagattttcctgttaaatgtgatatctttacaattagtggtgaaagaaaggaacatttcaggtaggtggcttacattagagcttatgcataagcgattgaagttgtatatgtctataaatcatcaactgtttcagataggtggcttacttaagagcctctgcatcagtgagtgaaaccgcatatgtgtataaatcatcaagtgccttctggtcatgcctgacgaaagagtgttgcttgctcagaaatggtgatttcaccgaatggcttggtttaatcgacctctttggccgatcgaatcggatatcagaaggaccgccgataattctcctcttggatttatgtgggagctttgtacatgcgtactcctcacgcatgaaaatcctcgccccactcgtctctttcaacatagagtacggagagaaactactaagtttagtttgttggtcacctattatgagacacaacagtaagagtgagacatattatgcgcatgtggttggttatgaatgaaaatgaaaaactgatacaggcttgggggtatcattacctccatgcgaagagggagttttgtgcactgcattaccttatccggatttgtcagaggcatctactgactttgagattggctgatctggggtacgtgctaaaaagttgagttcttgttctttgtcagagtcttcagccacattggagatgtcatgacctggggtacatgccaccatgtttgcttcttcgatatcttgtgttattcctagattaaagcttgggggctcgatgtcagacctggcatcgtaggtacgatccacatggatagcctgtgtacagatatatcaacaattcttatggaaaaatggattctttttatattgaatagattgacaaactacatgagattgcacctctatcaaactccatctgtttcactagctctttttgctgatcaccaaaacctgagaatagatctgagagaatagcaggagtgcacctggtgtaaattttttcttgtactacctttttacccttgatgccacttgtttttttggaatttgatactgcagaaccaggtagctgcttccgctgatgcatctttcttgcttgagcagcatgaagggctctagtgaaaacagaactagagccaccaccacctgaaacattcgcacctgctgcaggactgcaaaggtgctgcaaatgcaaaaacataaacaaaacaaattagtaagagatacgatcaaaaaaagactcaaagattaggaaaaaaaatccatcaatggctgccgcgagcttcgacggcgccggtgttggggcgctcggcgtgcacgcggcacattggggcgctcctctccggcagcctgcagcctgacactgctataccgtaccaatgtcaggttggtgctgttcatcgtcgccatggccggcaccacattcactgcaaaataacagatgaatatggcaacaaaccttggaactggagttctccatgctagacctttcaatgttatctgcaacgcagccgccggcgaggctactaatctgagtttagatgggttaagaactctcaaaacgcaaagaacagttttagatcgataatgttctgctcgacgggataatcatcctgctttctcgctttggataagcaaactgaagagcgaaaaaaccaccctgaaatatatctggtcagctgtctccgaacaaaattctatctacaacaaactcaggaatcttgattcaattttcgaatctgctacagaacagaaacaatcttgttgaccccgagggaaaaaaatacgggtaaaagaaaacgggtaaaagtattcgattcaataaacccgttaatagtcattaccattatctgggcaaacgaattgaattggtggcggacagggagggagtagctactcccggtagtagtgatatatatatatatatatatatatatatatatatatatatatatatatatatatatatataaaacgacgcttaacacggtaaccagacccacccccactccacccattttgattatgatatttgactactacacgtcctcagtcccacgtgctgcgcaaccctcctccctctccccccacaccaccaatgcgtatccccatagtaccacacatattgattcgcgagttaaatctttactactacatagctcaccatacatactcatatttagtcagttaaattttatctaagtgttattcagcaactataataaacatcacgtttagtcatgtatatttttttttcaaattttttaggaatcattttgactcacattgaaacaaatcagttattttttaactgccatcgaaggtagtctcttttttttttcactccaactcatccgacactaagttattttttaactatgaacacaattaattgttaactacgagccattttttttaattttttccaggcacaatgtatacagcagcgatttttcagtcatttcaaactattgtagttatcgtctccccacttttttcggttagttttttttttctcgccggcgacagtgagcgcccttcttctctcgccgcctgtgcagcggaggtcgcccgcgccgccgcaagttccttccaggcggggataagcggctgcgaggtaacgtgctacacaacaccgccccaaaacattttcccctattggatggcgacttgggcgctccatcgactgctggatggcaccatgcggttgaggctgcgacacccccccccccccccccaaatggcaccgtcggctgcccctctgtcaccgacatccatcccatcgccggatctaggagagcttcgcccgaatcctcttttgattcttgcgtgtcggtggtgggtggagagcagcggtaccaacgacatttgaagcacagagggtggcaggattcggagaggaggctgcggatctggggtccgatgggtcgttctccctcctcccctaaagcggtggcgaagaatgtcagtaaattgtcgttgccgtcgtgcgcggcaggtcagcgccggcaaagaatacaggaggtccgtgtagcagctgtagtcaattgaaatctatttcaggtacagctcgttagttcctatcaactagtagcgttatatggtatcagtagtttttttatcagcctgtattggattgcaccgtcgttttgattttggatgagctatgtgcctgtgttggctgtggggatgcggttttgttaagattgggtagtaaccactgattaatgcctgccgacagaagggcatgcgtttctcaattggcggccaacgtgaacctttgtttcacaggcaacttcattcctagccaacgggatgaagttaatatatgtcaggtacctaacagaactaatctttctgatgttttgactgatctttgattcatgtcttttgtatccgtgtattgagtggacacatccaacctaaacacattagaagttgtttggtggatggcttcgcttggtgctataagtgtatatgtgatgattcatgcatgcagggctgttcttagcttctgaaaacaacagaagaactaggatgatctgtagatgtgcacatgtggcctagagtcagcttaggtgtcgcattctctgacaaacgattgctttggtaaaccaagactggtgttttttattagtactaatttggtttatttgattagttgtatatacaatcaattgtttcctgtaaataattttgactgaacgttacaattgaagttattctatgtcctccatggcattcagatggtaactgaaaatatatgatcgctggtaggactatgtgctttcaactctgtagcttgcagcagttctcttggtaaaaacgagccaaaaattctctaataagcttaatccacacgatcaacaattcataagcctcttatcaacgctttgccacttatccctgatatgtaccaccaaatgcccatttcgatttcccatgagcttgcacttgcattaatttttggcttttcagcctgcaaacatcaccatgtcctgtgcaatgctcagttgctcatagcctcatactatgagtcaatccactaaggcatgcctactcatagtgcatttatatatggcaaattttggtcttgcaggaacacaatgtaacccggtggactcgaagatgatgaaatgcatcatgcggtgacatgggaaacattgtcgctagcgccggaggtataactttcaacaatcactaataatgcacctctgttggttgttagtgcactaatcttttgaggcattactgattttatggtctgcatgtttaatagcggccatgcttgatcctgggctgcccatcctgattcctaatgctaccgccacacagtcctgttctacgctggttggttggcgagccagccgcctccactacaacattcgtccatcaaagatggatcccgtggagaagaggaggatctgctgatctgaatttctttgatgatttttgttggagtgtttatatcctttgtaatttttttacttttgagtttaagcatgtaatttgtttattgtatagtgtgtgtctgaatgtaacagaacccgtgtgtaaaagaaaatattgttaatatctgaccggcagtgatttatttactcacgggctgacatactgttgtagggtcaaaacaagtaattttttaactcaccgtgttaggctccaaagtaatttatttactcgcggtctaacagggacgaaataacaaggaatgatttttttactggaggaacggaaagaagaatcgaacgagagggagagaaaagcgggagtgggagcgtgcgccaaaataaaaaatttactcgtggctgtaggctccaaagtaatttttttactcgcggtctaacaggaaagaacggaataatagcagaaaaacttttactggaggaccgagaagaggggtggaacgagagggatgcggtgggattttttttccgggatcgggaaaaaacggaaaatccggaggccagcagtgatgagagtcgcgctactaactatcgtagcgccacacacgcgccatgtagcgctaccgtgtgtgattacatacatacatacatacatacatgcatatacatatatacatacatacatatacatatatacatacactggtggagaaaccatctttaatcggtcggccaaaatacacaatagtctcggttgcaataaaaaccgagactaaagatatctttagtcccggttcaaaaggatagagttttttttttatcttaccaaccgggactaaagatctacactaaccgggactaaagatctctattatctttagtcccggttagtgttaccaaccgggactaaagatagatctttagtcccggttggtaacaccaaccggaataaaagatcggcatgcgcaacatgggcggcgaagagtacgagaccaaatcgaggaggaggaggagcagttaatatattctatctcctc

SEQ ID NO: 4831 - DNA, 11185 bp, Oryza sativa
gactaaaaatggatttttactcccggttttttcacccgggactaaagatagtgatctttagtcccggattggtagtcccggtttgaaaaccgggactataggggggttacgaaccgggagtaaagcccctttctccaccagtgatacatatatacatatgtacacatatatatacatatgtacatatatatacatatatacatatatatatacatctctcaacttacaaaaccgttcactttagatccttttgtggtttttatcctgattttgtcttacatggtggctaagtcagcgcagaacccacatgggctccatatgtcagaatgccaggtcatctctctccctcctcttctctcccttcctcatctctctctctcacttctctcctctctgcatggcggctggtgggtggggacgaggtcaccagggcgaggcgggagaggagattctgtggacgtcgcgtgcgacctcggggtcggaccgtcgacacgagagaagggaggcggcggcggctgcgacggttgagaagggagaggcagacggcggcgaagcagggtcggcggctggcgaccacgcgggaagaagctgggcggcggcgtgggaagaagctatcttatacgtcgtgcccgttccgcccacaaccgcctgctccactcgccgctccttcgcgctcacacactccttcccgccacgccaccctcgctctccccattcggctccccatcgatgccatttgcctccgcctcgtcgatgaggttcgaccattgtcgaggcggagatgtataactggacgacgacggattcgctttcttctttcccctcgcttctcctctctctcccctccagatggtcgacattgaccgtcgcctgccggtgccgcacgaccttctgcacccgcccttccacatcgccggcttcatggcctctgcacagccaaaaccaaacacttcaaatggtgtcgccgcctcccgcgcacgcaccgcggcgccgacggcgtgtaccttgctgccacagcctcttcctctcccgcagcgcgcctgccagccgctcgtctgctccgcagaccaacagctccccgtactgtcgcctgctccgtcaaccgctcgcccggtcctccggcaggccaatgcggcgggcgcagctaccgccgccgctccgcccaacgcccgcccgctccgccagccggctgctccccgcgccgtcgcccgctcctccagctggccgctccaccccgcgtcgtgccctctccagcgatctgcttggaggggaggggagagaggatagagagaagaagggaaaagagactaaggtttcacttacatgtggggcccacgtaggtcctacgctgacgcaaccgccacgtcggacaaaactggagtcaaaaccaccgaaggacatatagtaaacggttttctaagttgagggatgttatatatctggttttgagattaggggacgattttgtaactcgatgataagttgagagaccttcggtgtacttttttccgagacagaaatacccctctattgggccgacccattaaaatgggctaggaaaatgttatcccgacctccaaggattaacttttaatcttaacagtccagtccattcatgtcaccttatttcattctaatgttctattcattttcatttcccattccacccttcataacccattatcgaaactcacgctccggcctctgggctagtagcaatgtgtttgctttaggcgtatatttggtagtgatatgattgcaaatgctcttgtttagcacaactctagattttaggtcatgttgaaagtttatatatgttaaattatagttgtttaaagtttcgtattttattttaaataaaagtaaaattatttatccaaatgttacagagaaaatttgatctatagcaatgggaaaaaaatcagtactaaaaaatagcacaaaattttcccttttcaacaagaagcatatgccacttagtttttcttcattcatagcactcctgtcatatgttccgttcatgtatgtaggtttatatactatttttttttgttacctttattttctgtgctacagaaattttctcaactaggaaggtagcccgcgcattcgagcgggcatgtaccgtatgtaggatgaatttaagaaacttataggagcggtataacagcgaaataatatctgcaacgtttaaaattgtgattgtttccatgaattttcttcgttagcatcacaaaacgaatttaattgttatttataaaattatctattgaagattggggttggtatggtaccttaagagtctaagacatatgactcttgaagttccatatggaaagtgtaaaacttaagttataaaagatattacatatacaaccatatataattaatggttgtactgatttatgtagaaaaattgatactaactttattatttggcagatatcgattggccatagctatggataattcctcataggaaattatgaatatgtgtacagtatagggatacaaattagaaaaaaaaagtagaagttatgagaaaaaaacaaaatatatgaccctcaatttttacctaattcggtagtccatcatttctaaccattggatattcagatgatctaacatattgtgtatagtccaaccaaccaaattattcgtctttcctcattacagatgttggacatgttaatccggataaatctatgtatctatgatttacatatataaaaatttaagtataataaaatatacaccctactctaccaatgcagcgaacgatgtgtgcgacaggttcgccacggctggcttcaacacgaacatgatcgcgtacctgacgcagcagctgcacctgccgctggtggcagcctcgaatctcctcaccaacttcaccggcacggctgattccttcgccggccacctctggaccaccgccgcccccagcgttctgtcccagctcggcatgctcggcctcgtcgtgtccgcgctcgtccctgctccgccccgcgccgtgcagcgctgccgccgccgccctgtgacaatgactatttagagtatgtacaaatacatatgtacgcacgcactgaggagagggtgggcctatgggagaataggtgggctgtgggatttttttttctaaagataaatataatagttgaaaatagtaggtctagcgatttattattatagaaatagtgggtccaccaatttattataacgccacgtgatggcttagaagcgtttgtaggattctcacgtggtagcttgagagcgtttgtaggaagtttaatggacttttagtatataatagatagaagatagataaatagatgttttgacatagtcgtaaattcagattcatgaacttgtgaatctagaatacccagccccaaaacatgttggatccggagttgtgccaaacattcccctattaggggaaactacttcatttattgatcaaatttattcagtccatatgcgtccctaaatcaacagcagatgaacacggtcgccaaggcaaaacaacaacatgccaagaacacaacaacagagattattcttcttggttactgatgattatttttgtatcgcattgatcagattttggggacggcggcgagggcttcctgcagcttctcgtcggagtgggagaggtcgaccatgtcgcccctcaggtacttctcgtaggacgccaggtcgaagtggccgtgcccgcacatggccatcaggatcaccttcttctcccccgtcctcttgcactccatcgcctccctgatcgccgccgcgatcgcgtgcgtcggctccggcgccgggatgatcccctccgtccgcgcaaatttcaacgcagctggagttcaaagcaaaaacaattatgcaatcacatacatcagctttcgggagaacgaaatcatggataatttcagattataatactttctagtattacccacatttatatagatattaatgaatttagacatacatatatgtctagattcattggcatatatatgaatgtgggcaatgctagaaagtcttataatataaaacggagatctagcattataatataaaacggagatagtagtacggagtaccatcgaagcattcagtttgttggatggcaatggcttccatgaatccaagctcatacacatgggagattagtggcgccattccatggtagcgaagccctcctgcaattgcaaacaatggcttgggtttattagcaaccaagaacttcaaattggagcaagaactgaagaagtgtgcattgttgagatcgataaaagaattcgagacctgcatggatggggtcggggacgaatccatggccgagggtgtgcatcttcatgagcggcgtgaggccggcggtgtcgccgaagtcgtaggcgtagacgcccttggtgagcgtcgggcacgccgccggctcgacggccttgaacgccgggctcatcctgccggcgagcttctcgcgcatgaacgggaacaccagcccgccgaagttggacccgccgccagtgcagccgatgacgacgtcggggacgtcgccggcggccgccagctgctccaggcactcctccccaatcaccgtctggtggagcagcacgtggttgagcacgctgccgaggcagtacttggtgtcggcgtccctcgccgccacctccaccgcctccgagatggcgatcccgaggctgcccgggctcgccgggtcgcgttccaggatcctcctccccgactccgtcgccgccgacggcgacgggtgcaccgtggcgccccacgtctccatcatcagccgccggtacggcttctggtcgtacgacgcgcgcacctgccacacctcgcaggtgagcccgaacaggctgctcgcgaacgacagcgcgctgccccactgcccggcgccggtctccgtcaccacgctcctcaccccggcggcggcgttgtaccacgcctgcggcaccgccgtgttcggcttgtgcgaccccgccgggctcgtcccctcgtacttgtagtagatcttcgccggcgtgcccagcagcttctccagcctcctcgccctgcatcaccaatatatccgccattgcaacaacttttaacaaagaactcttctgaattccagcgctgagattggcaacaatgcagacgaagttctagaggctcattggttgaccacatttcctaatagcttatccacgaataaaaattactgcctcaaattgtttaacataaattaaattaatgtttgagaaaaaagaaactatagtgaccgtataggtaagagtggaagtctggaagggtggttaaaagtataataggaaaaaaaacttaatgaaatatgattgacaagacaatcagtacttcattgtgataactattttgggacaaatctgaatctaataaatacaataattatgagatggagataatgatttataggtgaaccttttgtatgtgcattcttaggcagcgttagttctgggagattagagatagaatgcacatcgttttccacgtgcacgcttcccaaactattaaacggtgtgttttttgcaaaaattttctataggaaagttgctttaaaaaatcatattagtccatttttaaaatttgaaataattaatatttaattaatcatgcactaatagctcacctcgttttgcgtatctttccaatcttctctatctcccctttctcaaacacagccttagtgatttaaaagccaatatccaataaaaactacgttgaaaatatttcaaaatcagcttcaaaattaagcttgaaaattcacattttggctttaactttggtttattaggcctaccgatggagatgctagtgttctacctgatcagcggcgtcgggcgccagagcttgtaaacctcggcgacctcctccgggatgtcgatgaaccgctcctcggtcacctcctgcctgatcagctcgtcggggaagagaggggacaggtcactagggttcagtggctggtgcgtctgcgggtgcagcggcggcggtggcttcaccggcaggtcggcgacgaggttgtaccattgcttcgggatgctcacaggattcgagctggccctggcagtgaagcttcttcttctgacagaagctctctgctttggtttgcaaaggagtgaggctttttctgaacctgctgctgcaatacaggtagtagtgttcatcaggttagtgtgtgtgcagatttgcagctccagaattcagaaattagattgaaggcctgttcactttgatgccattttcaaccttacttttagtaaggttgctaaaaaagtggctacatttaatttgctgccaaattttaataactatataaaaaatcctgccaaaattttgacaactatactaaaattttagcaatgccaaaatttgataaggtttttttggcatcaaagtgaacaggcccgaaaaaaaaagatatactactattaatttccataagatctagataagcatttttcagccacatatctgatatctcaaagtgttgaaattgttgcatagaaactgagtgctaggagtgtggtacactgattaatatttaatttggacatgtactaccaagatgatgtctactcctaactgaaacatttatgttttgccttgcccccacagtactgcaatttggtttaagattcccaattctgcaggacggttagaagggagagaaaatactgaacttacataatctgtaccaacatcatcatcatctattatgttcatctgtaatcaactattgcacatttagaaggaatgaaaatcaatcagaagtgcccaactggggtattctactggttagtttactttatcccactttgtttttctctaaggagagaatgctactgattaatttaatttaattttatgctaggaggtcatactactgttgatgggtttgggccggatagcagacagaacaggatcacaactaacaactgataacataataaattccttgagatccaagtgcacagaaacacaagtgtaaaataaataaagtaatgggttgagttcttgggttgctctacaggagtaacaagaaacataaaccaatccaatccaatccaagaacagcagcaaaacacaacacacccgttgctcccatctcctccaagacgatatctatgttgggccatcaatcaaatcaacccaatctaaagaatccaagaaagtactataaacccaatagcacaagagggcacgatgagatgcagggatccaccttgtcggagcaggggaggtcggacggaggcggtggtggccattctttctccctctcttccgctcccgacgaccctcgccgccggcgccggcttgccgtcggttcgccggagtaactggtcaaccccaaacgcgagctggagagctgcctctctgcctgctctctcctgtgatgcagctggtttttgtagtggccagctctgacggatgcagcaatttttattgttctatctaggtggtggtgcttctcccggcttgcgtttgatggcaaagggaagggagggagggagggaggagaggagactcggttttgctactgcgccatcggatcaacgcaactgaatgcgatggcaatggcaactctgcaatcgcaagcgcaagcacggcggcggatgcagcgagatggcacgtggggaaattgactggggcattggatcctctgcatctgtgtgaaatgtccctaagtttccgtgtctaaagtttaactgtccgtcttatatgaatttttttataattagtatttttattgttgttagatgataaaacatgattaatactttatgcgtgacttatctttttaattttttttcataatttttctaaataagacagatgatcaaacgttggatacgaaaacccagggtttgccttttttggacggaagggagtactactgacttgagctgatgatgctaatgacacaacaactcctcagtacacattttttgatgctaatgacacaacaactcctcagtacacattttttttcctgcgaagacgcaaaaagattgcacgtcaatctattagaaccgtacacatgcaatagaagtcacatgagatatgtttaggttgatagtacttattctaaacattctactatctagatgtttatagactactggtacgagatacgacacattctagtactatgaatctggatagggaatgttccacatcctatattagatttgtttttatgggacaaaggagtagtattgcacttaagagtatgggtgaaattatggtcgaatcacaaaattcctatatcataaccatattttccatttaaactgtaaccgacacagatggtatcagataataaatcacttatcccgtatcctatcaattttatatttctaattcatagattttaaatctagtgaggcaattagtcttaaaaagatagtcaagaaaaaattaagtaatattttttggtgagctcgtaaaaaaatatgaaccaatctttcatcatattcataataaattttcatacatgtttgatcaaattggatatacgggtagatacaactcttcgcttatcctaacccatatttgtttgcaggtttggattcggatttagactcgaattagaatattaccagatatctcattttctctctcgtatccttcccacgagctttccgtcgagcggacggtcaggaaatgttcgttctgttttcacccatactacatactcaatagagaaaaactatgtacagcaaacctaaaaattcatcgaatatataaatagacgtctcagacgtctcatatatatccatgtcttctgagtaaaaggattagttacatataaatctatgagtaaacaaactactcactgttaaatctggagtaaaaaacataggtgaatctcagatgttcatttgtgaatataacgacagttgttaagtacacatatgaagtatgcagtatactgccagtatgtattttcccaatcacaaaggatctctcgttccatggctatataaaacaacaggagtacatgtcactgtttgtactgtgtgaccgttttactgttccaacaaaagcaccgtttagcttcacttttctaggagcggctgtagcatcttagtttcttcttcaatgctgagcagaggatccgattcccggaaaccatggagatgggatttgtacttatcaggcactaatatatccgagtgaactcatacagtaaattttatcttaactaaatcatataacaataataagattaaaatcaacttcgcccgttgcaacgcatgatattttctctagtattatttaaaataataaaaggcacgaataatatggaaggatctaatatcaaataattagaaggtgtgaggcttcgaacccaggtcatctagcccaccaccttaaggagctaagccggaaccagtcgtgtctatcactcttggtagatacttcctccgtcccaaaaaaaagacaaaccctggtttccgtgtccaatgtttgaccgtccgtcttatttaaaaaaattatgaaaaaaattaaaaagataagtcacgcataaagtattaatcatgttttatcatctaacaacaatgaaaatactaattataaaaaaattttatattaagacgaacaatcaaacgttggcacgggaactcacggtttgtctttttttttttgggacggagggaacaattagattgaggatttaagacttcttttctcactaaatttcctctcttcttattcaggtgagctacatataccatttttttttaaatacgcaaaaggcttgcctaacaaaatttggtacagaatttgcccacgcggagctatatacagatcacttagaatatagaaattttacctgaataagtttatttcctgtgaagtttgttttgcttttccaacaaaaaccgcaaatctattttctcaaggttgattgatctcatctcttacatcacacccctggcccgaaaatattaaatggttggtcgcctcaaccgttgcccgtatcacgtcggattcacctacccttaatcctaacattcaaattagaactggaataatactctcatttttttattcagtcagaatgaaaagtgaaacgagcgagaaatcaagttttgcctttgtgagaacacggttattctcagaaacaacagttctcctttgctaaaaggccattgaaaaatcgttgcaaattgcaacaagttagcacctaatcttccccataaaatgtccatcaccttgaccttatctcctaattaaaccaaaaggacagtactttcagaatgctgacaaatatttcggtgttagcatgtagccgtctgttgctgttgctttctcggtagccaatgtgtccagctcatagtgctgccagaggaaaaagcaagacagagtagtcagagatcaaacgcataatttgatatcaatatctcctaagacaaatcaagattagctaagactagtaaactataaatcgtttatgcgatgtgcatgtctctgtcaacatttcttctgccgttgatgctgtgttcctaccaactccctcaatcttaaaaacaaaccaatctaaaatagaatatgaatataatgaatttggatagcaggttgatttattttggaacggatggagtactactgttgtagtagtgacaccacactgcaaatatttgtagtagtgtctctacttaaataattattcagtcctaggaaaaacctaaatgattattcagagtaataaaaaaaacatgtctctgctcacaggagattatgaacaacaggttaactcttgtttcctgatgaacatagtttgatgaagatacaagaagaaggttcaataatggacatttctgtagccaaaatttaaattttaaaacttagttgcagacttaattttggttttctttttcatggactttatttttagcacttacttttaaatcggtaagaatatataaaaattttaccctgtgcggccatatatgggcgtgcatgggctaagaagagagtcctgaaggagcaggcatacggtgacacacactgtagattcagactggcccattaattagatggcatttcgtttaatttaggaataagttcaccggaggtccctcaacttaacagcgagattctttgaggtcccactggtggagaaaccatttttcatcggtcggccgaattccacaat

SEQ ID NO: 4832 - DNA, 14689 bp, Oryza sativa
ggattatataatacatatttaattttagtctcggttggtactactaaccggggctaaagattatcttgatctttaataccaaccgagactaaagtggtgatctttagtactggttattaacaccaaccgggactaaagatcctcggccccctgacatacatctgacaagggatgaacggttggtgttaccaaccgggactaaagataaaaatttttataaccgggactaaaaacaatctttagtcctggttctttttggatccgggattttgccggaccgaccaaaatggtttctccactagtgattgtagtgaatatccacggcttagagtagcattcgagcgaatcctataataacaatgagcgaagcagctttttaaggatggcgcatatctaaatttctcgttattttctatccaactgtatattccaatattggacggctacacgatctaatccgcacgtgagccactgcaatctacttcacgtccggacagcatggatcgatgaccaacagcatggatcgatgaccacatatcggcgcctctcctatacatgcagtcttccctccactcgaatgaattgttgtatgcttgccatcaccgcttgtgtgttagagtaggtacataaagatattgagaaactaagcaatacccctttaccacaaataaataaatagtccactttgactccttcatagtgttccaaaactaattcctgaccctgaaccgtaaaatcagatatcttaaccccttaaactgttaaaaccggtcaaccagtttgactctctcggtagtttcggagagcggtttcgctgatgtggcacgttacgttacggtgttgacctggtctttgtcccacgtggcactcacgtgacattagaattaaaaaatatatatgagcccatttgtcattaaaaaaattgtggggcccacatggcggtctatctcttcacccatctttctctgtctctctcatcttggtacccctaggacatccccgacgagctcgacgcggcggggctattggcaccggtggtggctaccctggtggtgtccactggagctccctcgccgagctctatcatgctaccgtcgccatccaccactagtcatcgtcccgtgctccctcgatgtcccacgtgaataagaaaaggagaccagcggtggctaccccggtggcggcacaacgggcagtggcttgcttcaccaggcatggccagccaacgtctgctccttgtcactatcatcatcctgatggagctcccgcaggcagggggcggtgttgaccacctatgagagatggagctcgccgaagctcctccaataccacccaaatctaaccgaggcttgagagcgaggcttggcgtcgaccaccctccttcttacgtcaacgttagactaggtcaacattgtcacgtcagcgaaaacgctcttcaaaatcaccaatgagtcaatttgcactagtttttaatagtttagagggtcaagatatctggttttgtggttcagggttatggattagattcaggtcactggttcagggttatggattagatttgggtcacttttaagagagtccagttgaactttattcccttcttaaatagaacgaagtctgagcccgtatatgaacccaccctgccccctctcttctctcatactcgtttgggcttttgcaggagaccaattgcatattgcgtattcgcgatcccccgggtctgctcactgcgtgagaagaagagatgatgcaatcgatggtgcggtcggcggcgcggcacgcggtgtacgtgctgcggcggttcggctgcgtctgtgagagcagagccgccgcggggagaagcctgagcaacgtacgcgccggtgagccgccggcggcgctccgggaggagaagaagaagaagagattattttctttcaggatgacggaggaagagaggtcgagggtcttccacgccagcgtcatctggggcgtcgtattcggccaaatagtcatcttcacgatgcataagcctcggtcttgcaaagaaatcatggccgaattagaggctaaggctgctgtttcgagacaaaattccccgaattaagatgctaggttccatatcgttggctgtttaccatgtactactagtatttcttgagtaatttgagtattagtatttgcttatttgctactgttcccttctttggaattgctagataaaattcgttcttttttttgggcaacaatacatgattgtgctggcaatgatacatcgaacgaagagtcgaatgcgccgtcggcgccgcctgtcggcacgcactggtggagaaaccatctttcgtcggtcggccgatttccacaatagtcccggatgcaataaaaaccggggctaaagatcatctttagtcccggttcaaaagggtaacgggcatatttgatctttagtccggtttgtgtggaagccaccgagatagaaggcgctggagtgttgccttgtgttatcggcggaagagccagtttacatgtttgggcctgagtgagaaggttaagaatggaaagagatgggattttttttaatcggttaactgcacatgacattcagcccttgcaggagtaaaaagtctatatgacttaacgtcttagcatagcttttcttttaaaaccctgtataagcaaccgggactaaagatcatctttagtcccggttcgaatgctgtcaggacctgtcaggccccaccaggatctttagtctcggttggtattaccaaccgggactaaagacgtaactttagtcccggttggtgttaccaaccgggactaaagatcccggtgatctttagccccggctggtgctaccaaccgggactaaagatcttaactttagtcccggttggtaataccaaccgggactaatgatcccggtgatctttagacccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcaaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgataccgattattattcaaggccccaagcaacctggtaacgacatcgacgtgtacctaagaccactggtcgaagatcttacatagttgtggaagaaggaagatgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgctgcaaaccacccggtacggaagaaaggcaagcactttgaacataaggccgaccaccgtacgaagcctaaacatcgcagcgggaaaacagtgtttgctatggttaaagatcttaaagtagtgtttggaaaggggcctagaagccagcctatagagagcgaagatggtcacgcggcgatgtggaaaaagaactctatattttgggagttaccctattgggaattcttgaacgtacgccacgcaatcgatgtgatgcacctcactaagaacctttgcgtaaaccttcttggcttcctaggtgtatatggaaagtcgaaagatacactggaagcacataatgatctgaagcatatggaacaacgcggcgaccttcacccggaaccaaaggagaaaggaagccattacttgagtccagccagctacactcttagcaaggcagagaaggaaagtatgtttgaatgcttagagagcataaaggtaccatctggatactccacgaatatcaagcgaataataagcacgaaggagaagaagttcacaaatctaaagtctcatgactgtcacgtgttaatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataataacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcgggaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacaacaacatctcatgggtaacgagacgatcaaccaacaacttgccttcctggcgaggggaccgtctgggtcgatcgcgacattccagggatgtgagatcaatgggtacacattctacacgagagcccaagacatgaagagcacgaaccaaaacagtgctgttcgtatcgatgccatgggacacgatggaacaactggcacgtattacggtgccatcgaggatatatgggaacttgactatggtcctcccaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacatgaaggacatgtctagcaaaggaaagaagggcagagggcctgacgagccgaagcatcacgtggttctcccaggcaaaagaaaaatcgtcggagttgaggacaagactgacgaggattacgatcagttggatgggcaaccccctttcatggtgacgattgaccctagcatcctcctatcaaatgaagacaccccttactcacgtagcgatcacaaggagggaacaatagtgaggagaaagtacgtgcggtcaaccgttacggccaatgtattgccgtaattatggtgtacacgatgtaaactattttggatgtattcattatccatataaatcaattgttgtatgacatatgttaattacgtacgattattagaggttttaacaattttaaatcatgtatatgctagttatatgcgataattagaatttttaaaagttttaaatcatgcatgtggcatttacatatgttacttagagtttttaacaattttaaatcatgcatatgctagttatatgcgataattagaatttttaaaagttttaaattatgcatgtggcatttacatatgttacttagagtttttaacaattttaaatcatgcatatgctagttatatgcgatacttagaatttttaaaagttttaaatcatgcatgtggcatttacatatatgatttctaaaagttttaaatcatatatgattattagaatttttattaattttaaatcatgcacgtcgtatgtatatacatatgttaattgcaatttttaacaatttaatatcattcatatgctaattatataagattattagaatttttattaattttaaatcatgcatgtcgtatgtatatacatatgttaattacaatttttaacaatttaatatcattcatatgctaagtatatatgattattagaacttttattaattttaaatcatatatttgcttattacgttttatccacttaatttactacaaacaacaataatttttcgaagtaattgtcattaatttttcgactttaaataattttaatgcattattttctattttagaaacacatatgtaatggaaatcaatattcaatgcgtttatcagtagtcccggttcttaaccctaaccgggtttaaaaagaatttggaaatagcgggaaaatatctttagtcccggttgatgagaacaaccgggagtaaagatatagggctatatatattcccgatgcgcgccctcatcttctccaccaacacttagaagttttttccccgatcgatctcccttggcttctccttcgccgccactacctagggcatccccgcgccgacgccgccgtcgtatctcgccgtcgtctccgccgccgccgcatctctggggtgagagccgccaccgcctccccctctctctctctctgacctcgatctctctctctctccccaaaccaccgccagccgcctcgttgccgacgccgccgccgacgtcatcgcggccgaacacgactccgccgcgccgacgatgccgaccccgacctcgatgcggccgtcaccggcgacgacgtcgcgccggcagtgccgacaaagccgggccatgccacgcccgccgcgccacgacgccgagacaccacgacgccgccgcggcacgccaccgccgcgcaccgccgatgcccgccgccgccgccgcgccatgccgcagccgcgccgccacgccgccgctccactgccgccactccgccgctccgttgctgccacgtgaacgaacgaacgatcgtgaacgaacgaaacgtacgtgaatgtgaacgaacgaacgaacgtacgtgaacgtgaacgtgaacgaacgaacgtacgttaacgtgaacgtgaacgaacgaacgtacgttaacgaaggaaacatacatgaatgagaacgtgaacgaacaaacgtacgtgaacgtgaacctaacgtgaacgtgaacgaacgtgaacttaacgttgtacgtgaatgtacgtaaacgaacgaacgtgcgtgaacgaaaagtgaacttaacaagaacacgaacatgaacttaacgtacgttaacgtgaacgcacgtaaacgaacgaacgtaggtgaacgaaacgtgaacttcatgagaacgcgaacgtgaacgatcgtgaacgaaacatgaacttaacgagaacgcgaacatgaaatacaatatatgttactttgcgtttatcctaatacatctttttgtatgttgcagaaaagacgttgtcgtcaccatccctcaagccggagtggtagctagccctcaaaggaattcgcgcatgcaagtgatgtaaatatatgattgttagatttttaatgcaattaagactactagagttaatatacgacacttaaacttagcatatatgattatctagggttgtaatgtatgacacttagacaacttagcatatatgattacctagggtcctaatatacgacacttagacttagcatagtataagattattagatttgtaataagacttagcatataagattgtgtagggttctaatatacgacagttagacttagcatatatgaatatttgagttttaatataagattattagagttttaatacaagattatttgagttttaatataagattattagatttgtaattagacttagtatataattattgtctagggtcctaatatacgacacttagacttagcatagttgactattagagttttaatacaatattatttgagttttaatataaaattattaaagttttaacataagattattagatttgtaataagacttagcatataagattgtgtagggttctaatagacgacagttagacttagcatatttgacttagcatatatgattgttagcatataagattgttaaatcaaaaatgacctatagacttagcaactatttcttgtatgaacagatggttgatcgcgatgaggaacagataatgtacgatacaatcgcggatggaagcaaccagtactagaacgaagaagaggggaacgaggatccaaaccagtacttgaacgaggaagggaatgtggagagggatgcggaggggaaccaggaggggaacgtggagagggatgtggaatggaaccaggtagaggaggctagtggaagtcaaccctccgctggacagaagagggcacgtgggcaacgaggtgccgcgaagaagctagagggtcggcacatcataacgaaagtggacaaagacggctaacctagtgccccggcggaagcagccaagaactacgtacgacacagcggttgggttgtgcgggataacgtgcctgtcagtacgaacatgctaagtgtttcatatgtaatgtgtcacgaccggaaataacccaacgggcgttccttacgtgcgtgcattattccttgtcccaggaggcaaggtacaccaaaagttgatacaattcagagttcaacaagcggaagcgtaaatagttaattattacatgggcagcgaaggcccggcacacacaaagacaaacgagaaacagcggaagactagggcgacgaccacaggcgcttgacggcaggcacgagctagacaccaaaaccttcatcttccagagactcctcttctgggtttgggaaaaaattgagcaagactgagtacaacccccgtactcaacaagacacacccacaagtgcataataaatgcaagggagtacaagggaggtataacataaagggttaagggtgcagtaaacagcatttaaagatacttagttgctcaaagctattttgtaaacacgattctagaactatacaatattatttatcaaggccgtgaacccacacgaacctgccttaacccaaggcctacgatgattcagaccgaaccggcaacccgaccctgggtcccacctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacggatggaagacgtgacatagttcccaacccatcctagccataaacaagagtaccgacccaaccccacctacggccggaacccccgggacaggtaggcaggactgagcccccagcagcaggacaccggccctgtgccatgatatctcgactaccgggccgcagctcgtgtagccttcatttgtcctagagatgtccatcgacccccgacttcgtccatctccatccgtgtacttttgtttataaccagtctgagctacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaatactccaacaattccaaagtgtccaggtgatatgaatatcccaaagtctagagttataaaaccacctaatgttgcctaattaatcagcgaagcatctacctaaattcatactagtgggaccatgaatagagtacccactagttggggttttgtttatcctagggtgaacaaggtaataataaccataacaataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcactttcccaaacgccggcttcaacttccacgaagagcggatcttccgaagctgcagcgtctacacgaccaacggaaaagaaaaggcttttacactaagaaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgcgcggaccgggtccactggggtggggcccacgcggcagccccacggcccacggtggaccgggcgcacccgggctcgcacctgccggcgccgtgggtcccacgcgtcagccgcacctaagggcgcgggcggctgacagccgggccccacacggcagccgcggggcgcgcccgaaggcggccacgccggcacagccgacgggaggcggcgcgcccgcgcccctatggtcgccggcggcggccataggtacggcggagcggcggccgagaaaggggagggaagggggaaacgaatcggcggtccacggctcaccccgggtcgacggcgacgacgggaacggcgaccggagcggagcaaagcggcggcgcggctcgggtggacggggtcgacggtgctccggcggtcggcgagcgaaacggaggggtggacgaggtcgccggggatgcggtgaagccgaaggtggcgacgccgatgcgggaggtggtccggggcgacgccggcggcggaccggagctcggcggtgacggcggagagagagagcgacggcgcgagctcgattccgacggggagacaggtcggcgagtggcgcaaccggtgaagggaggcacggggaaggtttatatagggttgggaggggaagagagcggccggacgagggggaaacgggcgcggaagatccgcccgccattgatggcgccggcgaggttaggggaggggtttccaaacgaatccgagggagagagagagggaaaaatggggggaaagagggagggaatcacggggaatatttcccccctcttgattgcacgcggggcggacgggggcggcgggattcgcggcggcggcggcggcgctagggcgcgggcggggcggcgggagcgacgggaggaaggggatgacgggtgggccccacctgtcagcgagggaggcgggcgggcccgcccgtcagcggcacgccacgggcaggaggccgaatgggccgcggggagaggagagggagggggagggagctggccggaccggcccaagagggagagagggagggaaagggaactttttagggtttttctttttataaaacctttttaactttgtttatttcttcttaattattatttgtgctctgaaaattccactaaaatttatttacgccttttaggcttttaggaaatatacaaaaatcctccaagccttatttgacttttaactttgcacattttaattgttggaggctttcacacggattttaattattctaggcataatttcgaggatgtattttagagtcgttttgggacgcgacataatgcatcccacgcacattgcagattccactgggtctttttactcttcgacctggaggcctgcaccgtcaacgtatatgactcaatcgataaagaagagtcgatgtttgacaaggtttttgaacttatagacaggtactgtcataagttcctatgttaattaagaatcttgttatatttaattactactacgaatcatagctttaaactccatgtagggcttggtatcggttccgtcatttggtccgcggcaaatggagagaaagacttaggcggaagttcaattttcctgtgagtacacatgctctacatttatattcaatctccaattcaaatacataaaagtgtatattaattagatctctcgccgtttgtcatttatttatagtgcgcaaagcaaaagcagggaactaacttgtgcggctactacgtgtgcgagtattgccactaccttgcagaccaaatcatcaccacaagagagctcgatgtacgtacaaataatatgaaaatttcattgcgtacgtatcgatttgttgtttaattactaattaatttcatacattcatatagtttattcgcatgagggataacctgatcacacacaaggaatttatcgcggcggttcaagaacaactcatgggattcatcaacgaacaaatccttgatcccaagggtgaattctactacgacggaaatacaattcataggtccttagcttctgagataacgactactactacgtcgaaatcgtagctagctaggacatcataatgaattggtattaatacatgtctatttttctatatgcatgtacacattttctttaatgtaaatatatattttgggcatatatatatatatatatatatataattctactacgacggaaatacaattcatagttccttagcttctgagataacgactactactacgtcgaaatcgtagctagctaggacatcataatggattgtaattaatacatgtctatttttctatatgcatgtacacattttctttaatgtaaatatatattttggtcatatatatatatatatatatatatatatatatatatatatatatatatatatatatatatatatatatatatatatatacacatatgcatttgcataacatatatatatatatatgtataaatacatatatattatgcatgtatatgtattgaaacatatatatgcatggtttttatatatatatatatatatatatatatatatataaaccatgcagcaacagggccatgcaaaaaaaaaaggtcagctcgatctttagtcctggattggtagtcccggtttgaaaaccgggattaaaggggggttacgaaccgggactacaaacgctttctccaccagtgtcccttaacaacaaaaccagaaatgtgtacccctaaactcactcaaaccgttcaaaggaggtcccatggcagtatatatgggtggttttcattgacgtggcatccaaatcagcaaaaaaaggggtccacattgtcggtgacatgggaccgggggtatcgtgactagaggcttgggcagccgcggtcacccacatggcctgaccccctcgggggggtcgggcccgagggtgacgtggccacccctccctctgtctccccgaggggtcgg

SEQ ID NO: 4833 - DNA, 24891 bp, Oryza sativa
  unsure (1)..(24891): unsure at all n locations
ggggctaaagcggaaactctgtctggctctccggcactctgtattccttcacacacagatccaccagaacacaggagtagggtgttacgcttctcagcggcccgaacctgtctacgtcgcccgtgtcttgtgcgcttcctctctcgcggacgttcctcagatcgagggcgaagaacctcacttagcgcccctggccgaaccggcaaaggggggcctgtgcggtctccctgtgaggagccccacgctccgtcatctggcgcgccaggtagggggcgcgtgtctttctgagccctcgtcctcctttcgtgtgcgccaagcttctcccgctcagcccaatggccgaacgggcagtggcgcacaacctctctccgagcgctagcggtgacgacggggagcagaacccgcgccgtcgggctcgcaccccaccgtccccctctcgccgaaatcttgggcgggggaaggcgctcgagggggtcgaaggatctgcgacttcgccgcccgcgagcgacgggggaggacggcgagacggggcgcgtcgccgcctcgtctacggcgatggcggcatgccccagggcgcgctccaggctgcgggcgcgctcctgcgtcacccgcccatcgtccccgatccagagactccagcccggcgttggctggatgacgtggccgacttggtcatgacggcgcagcagcgcctaggcgccggcgggcggtcctccgccaccgaggcctctggcgctgccgccgccggctccacgtcgtcaaggcggagggcgcggcgagcggcggccgttacccgccgttcgtccgccattccctcgtcaacgcctccgacccaagaagatgtgcgtgggggtcggatgcccgcctcgatatcgagcgccggcacgacgctcgtcgcgccacccacgcaacggagggcgtttcctcgtccggagcgccacttcggtccgggcacgggggccggccccccgtgtccccggttggtggtgccggctgtcgagcctttgtggcgagccttcggaacgtccgttggcccccaaggttccggcccaccgtcaccgaaaaatacgacggaagcgtcaaccccgtcgagtttctccagatctacacgaccgggatcgaggccgccgggggtgacgacagggtcatggcgaatttcttccccatggccctgaaaggtcaggcgcggggttggctaatgaacttgccacccgcgtcggtccactcctgggaggatttgtgccagcagttcaccacgaacttccagggcacatatccacgcccaggtgaagaagcggacttgcatgcagtacagcgaagggacgatgagtctcttcgctcgtacatccagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctagaactcctccggttctggtgtggcagctccggccgcccccgggtccgccgctcggtcagggcggcgggacaggaggaggaagaaggggtcgacccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcagactgccgcgcggtcaaaagtttggctgagcggacgaggaagtgggaggaggagaagaggcaggagcgccgtgagggcaaggccccggcggctcccgccggcaaccggcgaggtgaggccaagcagaaggccaccgccgaggacatcgacgatggcgacgatgacctggggtttcaggagcctgaggccaccgtcgccaccgtcgatgggggagcgtgcgctcacgtttcttgccggagcctcaaggccatgaagcgcgagcttctggccgcggcccctacccatgaggctacgcggcgggcgcggtggtcggaggttaccctcaccttcgaccagaccgaccacccgccgtgcgttgcccggggaggacagatcgcgattgtggtttcccccaccgtttgcaatgtgaagttggggaggtgattgagcaccgtctcgccgtgcggccaggcgcaaggccggtccggcagaaagtgcggcgacaggccccggaacgtcaaaccttcatccgcgaggaggtggcgcgacttctggaggccggattcatccgtgaggtcatccatccggagtggctggcgaatccggtcgtcgttcccaaggcgaacggcaagcttcggatgtgcattgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaaggatgtgcagtgcgtcaccggctgcatggccgccttaagtcggttcatatcgaggctgggagagaaggcgctacccctatttaagctcctcaaacgctccgggccgtttacctggacggaggaggctgagagggccttcgctcagttgaaggcgtacctcagttctcccccagtcctggtcgtcccggagccagatgagccgttgctactctacctagcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccaaggcccccgacggccggagctggccctccgcctgcttgtccgacggtgccaggtgctcccgacccccaggatggcctcggggccactgcgggaaggccacgcctgtcgccctctgaccccgaggtcgtcggcacagaagccgagtgcgccccgcgcggcctctcggacgaagagcgccctggagatgcggcccctggcgaagaggatcggccccgccgaaaggtgcagcggcccgtctacttcgttagcgaggccctccgagataccaagacccgataccctcaggcccagaagatgctttacgctattctgatggcttcgaggaagttgcgccattatttccaggcgcatcgggtcacggtggttacgtcttaccccctcggccaaatcttgcataaccgagagggtaccggacgggtggtgaaatgggcaatcgaactctctgaattcgatttgcgctttgaaccacgccacgcgatcaagagtcaggccctcgccgactttgtggcggagtggaccccagctcccgagcccgtcttcgcccccgaggccacctcgggcccctcgcagctgcctcacaccgcctactgggtgatacagttcgacggctccctgtctctttagggcgccggtgcgggggtcacgttgacctcgccgagcggagacgtcctcagatacctggtccgcctcgactttcgggcgaccaacaatatggcggagtacgagggactccttgcgggactcagagtggcagcaggactggggatccgctgcctcctagtgttaggcgactcccagttggtcgttaaccaggtctgtaaggagtaccggtgctctgacccgcagatggacgcttacgtgcgccatgtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcccagccatcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacaatgcggtcgacctggtccggcggtgcagggcgtgccagttccacgccaggcaaacccatcagccggcccaggccctgcagaccatacctctttcatggccgtttgctgtctgggggctcgatatcctgggtccgttcaggcgggccccgggcgggttcgagtatctgtatgtcgctgtcgataagttcactaagtggcccgaggcttatccggtcatcaagatcgataggcactccgcgcttaaattcatcaggggcatcactgctcggttcggggtgcctaaccgtatcattacggataacggcacccagttcactagtgagctcttcggtgactactgcgaagacataggcatcaagctctgcttcgcctcccccgcccaccccagaagaaatggccaagtggagcgcgccaacgcggaaatcctcaagggcctcaaaaccaagaccttcaacatcctcaagaagcacggcgactcgtgggtcgaggagctgccagcggtgctctgggcgaaccgaatcacgccaagccgagcaaccggggaaacgcctttcttcctcatctacggcgcggaggcggtcctcccatctgagctcaccctgaggtcccctcgggtcaccatgtattgcgaggcagatcaagatcagcttcgccgagacgacctcgactatttggaggagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagcgggggtcgggtgtcatgtatcgggctcgggccaaccccgcacccccccccccccgggcgtgcagggttggccgggggctaccacatgcatatactcatcttttttctcttccgtatttcaataaaagcattttcgatttcctaaggactgtgtctgtgccatcgttttccttttgaagaatcttggcttgaattagcacgctcgtgctcgaccctgccctcggtggcccgggtcggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgtggatctccccaggcactagccccgacccgcgccgtttgaggatgggacctgggcacgagcccttgttcaagccaagacatagaagtaccacggcacagaccatcctcgtctcatacaaacaacaaacagaactgacgcagaaatttcctctttacttgattgcagattaaatcagtctatacaagaagggggcccgaaggcctcggaagaagaaggaaaagttattaagattggcgggggcctgggggctcactccgacgcgcccgggtcgccggcctcatcgtcgctgttgtccgcaccgtcgtcgccaccctcctcgtcggagtcgagggcgaacgcgagccgaggggccgtaccctcgaagctgtggacgatgtgatcggcggcatcccggacctgcgcgcgcgcgccgtcctcggttccgggagggaactcttccagcgctgcccacggggagaagtcagggtccctggcctggtagcttgccagtacgagctccaccgccccccgggcgaggtccctcgaggatgacttgatcgtctcctcgagctcctcggggagccgcttgagggtcccggccatctctgagaggcgctaggcgaggcccccctggttggcggcgtacttcgcgtaccgcccgccccagaggcccgcctgccgcccggcgcagtctagacgggagacggcgtcccgaagcatgccgggccctacctcgttcgccaagcggagggcctcaacctccccggcggacgagtccagcgcgccctgcagctcggcgatggtgtgttcggcggctgcgaggcgggcggctaggtcgccgtcgcccgcggccgccccgccgctgtgcgctctcgcgtccagttccttcgcccgcgcctcgagctcagcggcccgctgatccagtgcggccctctcggcgtgggcgccttccagattgtggcgcgcctgctcctcccgcgctgcctcgcggaggaacaggctgtccgccagccgctgcgccgcggcctcggcctcctcgagagctcgcccccgctcggtgagcacgtcctcgcggaggcggagtgcggactcctcttcggcgcaggcggcctcgtgcgccgccagtgttgcctcccgggtggcgacggcggcctcgcggcccgccaggtccttctccttcgtgtccagggcgcgggcgcgctcctccagcgccgtggcgcgagcctcaagggcctcttcgcgctgccgagacgccgcctcgatctccgccgcccgccgttctcgggcagcggcggcgtcaaggactccccgggcggcgtagagcttcttctctagctccgccgcccggctcctgtattggaggcggaggtcgtcccgcacctcgtcgagcacggcggtggcgatgagggcagtctcccgctcctcctccacctccctagcgatctccgccaggtccctacgacgggcctcgagctcggaggcgtgccggcggtgtgccttgcggcccgcctccaccatggcctccaccgagcaccgcccctcctcgacgcgcgcccacgccgcgtcgagctccgcccgctctgcctgcaggacctccatctgggcacttaacccgtccagcaccgtggtgttcgcggcggctaaggcctgcaggaggggctccgcgctcagtggagcagcggaaggcagaggggagagccgcctcggtgtgggtgccgcgcagctcggcccgccgatcgacgtgccggacccgggggcgtcccccgaagctggctcgtcccaagcatcgcccgaggggtcgggccagagcggcgcgtccgcggcctcgtcgtgggtggcctcggaagtcgtcgtcgcctcgggcggagtcgggtcgggggcttggcaggccgcctggcgtgcgcgcgccgcctcctcctcccggacggactccccggcccggcggagtctggcctcctcccgagcggcctcctcagcctggcgaacccggacggcctcctaggcagcctcctcggcttcccggaggcggtctgcggcttctcgccggtcagcttcccgcctccgggcctccgcggtcgccgtctcctcggcctcaaaccggccggacttggaatggcgggggggcgcgacgggatctcgctgaggcagaagaaaaaccagaagacaaaaagaaacgggcgagtgaaaactcgccttgggagatgggagaatgaacacggccgcggtgggcgcggggacgaacctgcggggaggtcggctaaacgaccacctcggaggcgagatgaggttcccccggcatggctcggtcccccccatcttgcggagccgtttcttctttcgctccccctcgggctgcggcgtcggcacggcaccctccgggcgcctgctgctggcacgcaccgccccgccccctcggggaggagatgggggggcgtgccctcctgcttcctcttcccccgggcgtcggcagggcggctgccccccgggcccccgtcgcggggcccagaagcatgaccccctcccggggtagattgtttcctcctgcggctcccgcccgcgccatcgtggcctcggggggcccgctcccccgacgccccgaccgcctgcatgatgatcaggatgttggcgcgatctggatcgctgcagagggggaggacaccttgggggataagggatgcctccacggagctgagattcagcacccgttggaccaccatcctgaagtcctcagggacccagtcccatttgcgcccctggtgggtcctcatgtagtcctcgggcccggtgtactcccaggcgccccgggcgcgccgctggagcggcgcgatccggcgacgaaggtagtcgccgaacaccatggctcccgtaagcccctgggatcgcagacccgccaggcggtcaagaacggcgtcgtagccgtctcccagatctaccgtctcccgccagctggaggcctgcgccgggggctggctcggaagtcggaggcgcgcttcgtcggcgaggggggtgtagaaccaatcgctcttccagtcgtcccacttcttgcggaggacgcagggaatgtagcggtgcagcacctgcccccgcggctggaagtagcagccaccgactaccgtcggcggcgacaccggctgtacggtgaagaaccaccggaacagccggagagatgggcgcaccccgataaacatctcgcacaggtgcgcgaagatggccaacgtcattattgcgttgggggtgagatgcgccatctggagatcataaaactccagaacatccatgaagaaattagagaatggcgggaccagcccggccattgcgaaagagaggaagaagacggaccgccccgggtagtctggcgccaggcgtccctcgcccagcgcgaccacctcccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcacaggtggcgaaggcaaggggaagagtggcgagaggaaggaaacgaatcccttcctcggcgtctttattcccttgccaacgctatgcccggctcctcgcttcccgcgcccactatctcgccccctcgtttctcgcgcccacgcctccactaatcccactcgcccgtttgcggcgcacgcggcagatgtgcggccgtggcggttgagatgggacagatcgtgcgcgcattaactacgtttgccaaccgagaagagcgccatcatcatgtctccaggcgaaacgaaccggctcgtcccgattcgcgcgctgctcgagtaatgtagcggtcttgaagagaccgctcattattgtcggtcggttttcccttgccgatgcacgcgatttgcgaccgctgggtttctgcccgcctgtagagaccggccccacctgtcaccaggcctaaggagtggcgtcacgcccgagcgcttccctcgaggggggcgatcgccctggcgtaacgccgggggctactgtcggtgacatgggaccgggggtatcatgactagaggcttgggcagccgcggtcacccacgtggcctgacccccttgggggggtcgggcccaagggtgacgtggccaccccacactctgtctccccgaggggtcgggccgctcccgtttcggccccgagggctggggcgccccgactccccgtggtattggcgccacgtgtgtgggttaggtgagcacagcggcgctcacctaaccgcatttatagcggattgaatgagcgcgtcacgccgcatttaatgcggcgcagcgcacgtttatccggtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccagggttcagcgcaagtatggcaaggaagtcgccggccattaaatgaagtttgaaatgggcgtcctccggaaaagctgacgagcggggcaggagacgtgcgctctgcttgtcaaagatcacttccggctgtagactagccctcattgtaaaaagcatgtttcctttcttaggcagctagaggcccatgtggtgacccctgaccagataaaaaggaggcccaggcctaagggagaaggggggaggacgggggggggggctaaagcggaaactctgtctggctctccggcactctgtattccttcacacacagatccaccagaacacaggagtagggtgttacgcttctcagcggcccgaacctgtctacgtcgcccgtgtcttgtgcgcttcctctctcgcggacgttcctcagatcgagggcgaagaacctcacttagcgcccccggccgaaccggcaaaggggggcctgtgcggtctcccggtgaggagccccacgctccgtcacacatgtaagtgagatgaaaaaatatcgggcccacatatcttattttttcctttttttctcttcttctcttttgctttttttgtctttgccaaaaaaggggagtggcgacgtcggcgggcgagccggaggcaggcgaagcggcggctccgggcgcggaaagagcagaggggcaggggacgcggcgggcgagtggaaaaggagtgccagagccgccgctcgcccgctgccgctgcactcgcccgttgagatcatcaagctctgctccgagttcctcaacgctgacaccgacacgacgtccaccacgttgtggtggatcatggccaagctggtcaagaacccgtccatccagtcaaatatccacgacaagatcacggcgaagaccggtgacgaaaaggtcgaggtctccgaggagaacgtccacggtatgccgtacctgagggcagtggtcctggagggtctccggaagcacccaccggggcacttcgtgctgccgcagaaggcaatggaggacatggaggttggcggctacctcatccccaagggcgcaacggtgaacttcatggtggccgagatcagcagggatgagcaggagtgggcgaagccaatggagttcatcccgaagcggttcctccctgatggcgacagcgagggagtggacgtgacgggcagcaaggggatccgcatgatgccgttcggcgtcaagcggaggatctgcgtggggctcaacttcgccatgcaccacctggagtacttcgtggccaacatggtgagggagttcaagtagaaggaggtcgccggcgacgaggtggagttcgtcgagaagcaggagtagcggtgggcgagcagagcgtggtgggcctgaagaagagaatagaggaaagagaagagaaggagaagaaaaaagaagaaaaaaaatgtgcagctgacatgtgggccctatgtacttttttttctgactaggatgccacgtcagctaaaccacgcatatatactggcataggaccttgtgtgcatggtttgtgtgagtttagggtacacagtgatagggctggatgtcgagctggctcggctcggctcggtctggctcgttaggataacgagctagctcggctcggctcgttatcctaacgagctagaaaccaagctcggctcggctcgtcagcaagctcgagctagctcgtttagctcgtgagctttggggacgagagaaagcgaacaaggggagaagccgaggaggggcaccgggaggagccgaggaggggcgcccagaggagcggcgcgggcggcggcgtccacgaccggccgcgtcagcgccgggaggagcggcacaggcgacggcatccacggcggcgtcagcgccggggaggagcggcgcggccggcggcatccatggccagccgcgtcggcgctggggaggagaggcgccggccgcggtgtcggccccgggaggaacggcgcgggcggcggcgtccacggctggccgtgtcggcgccggggaggagaggcacgggcggtggcatcggcaccggggaggagcggcagcgttgagggctggcgcctggcggcggcttgggtggggattggggatggggacaagccagaaggggattcactcactagggttttgagaaggggatgggctgttgggctgggctgggcgcctgagcctcatttgctctggctcattaaggctcgcgagccagctcaagctctctaacgagctgaaatgccagctcggctcgttaggaaattcaaatgagccaagtcgagcctatcacgagccgagctaggtaacgagcgacaagctttctgtccacccctcaaaacatctggtaaggcctttggtggttttgtggttaaagaacctcaaaacatctcaccattaaggaaaattgaggggccttcggtgaatttattcctttaatttatgtagcataaatatattcagcccaccaaacatttggtaaggcctcatttagagcctcaataatttgagttgagaaatgttttgagcttgatggtgaaggaaactgatttgagttccagtggctaagaacgcacctgaatctaaatgcatgacctagcttggatcaaatgactagacagcaataagttcatagcctttactacagaaagcagaagagatcgagaagataaacaaaagtgataagaaaaataaaaggttcaaactctagctacgcttgagtgggaacctggaatatgttaggccctatcatcgtcttgggtttaaacattaaacccctcgatcagagtaattaacaaagatgtcaaggacaaagaaagggtataattaaagaaattaatgtaaaggcaagcatcttttagggcatgcaactatgcaagtagaagagaaactcctcaggtttattagaagaacctggaaaaaaatgctcatagcctaaacactctcttgtcccggtgctgctttattaaaaattttcttttgaaaacatatataggtgtactttattcccaattacaaggcaatttgcaatgcacatgcatgcatacgttggctagctctctgggttgataaggaagaatgcacattattgatattaatttattaatttggttgtcatggcaacatttctcttccaatgttgaaattaatctgtaataatattaaatgatactccctccgtcccaaaataagcgcagccatgagtttctgtgtccaactttgatcatccgtcttatttaatttttttaaaaaaaagctaaaaacataagtcatgcataactaatcataaaaaaaattcaattaagacggacgatcaaagttggacacgaaaactcatgaatggacttattttgggacggaggtaataaattatcactgaagtacttgatcacaaccattagtttgtcaagtaaaattaccattccttttgcctatgaaaccgtttaaattttagttcagtttttctaaaccaggattttggagcatgcgtcttacttaggattattgactcgattcatatattttcctagcactaatgttcctatagggtggctcttgcgtgttactcttaacatttaattgattgatgtatcaaacaatttgttgttctttatttatttttcttacagttttaagtttataatcaatatatatccaaatatttatatttttaatatatctcaattcatgtccatttgtttccaccttattcgactcatgtttaacttaattctttaattaaagagattatactaatttagttaatgtggtttttcaagtgttgttaaaagtgtttctaaattcccgttgcagcgtgtaggcatccataagtttgtagagaaaacggataaccatgtccatccatgtgattttcattaattatgctatctatcaactaatctttttctaactgttgatggagatatatttcaacaggcggtgacacaggtggctagcagagaagaggagggaagtgttttggtaaatatcataaaaaatctaggaaaatgttctatctgcaagaggaaaattattttggccaggattggtctctactagtgctaggccggctgagtgtaagatggggtggttgtttttgctgatggaggaaaatatctcctatatccttttatccttcacatttgttgagaaaatggataagatccatgtatgagagtttcattatctctatcaactaattcttcttctttattgtagatagagatatatttcagcccgcaacgatatcacaattggtgtaactttatcagccgcgtaatttagagaatatatggcttttctccgtataaaaaaaagaagtgttttacacttctggtctctgcacaacgtgcacacaaaccaatgaggaatatatagctaacactacatcgatccgtcgtccacaggcatttgctctcgcctaacaacggctctagctagacctctgaacaagtgatcattatcatcataagattctgcctaaaagctagttattatatataagcattgtggttacagcatgcaagcattacatgcacgatatgatggcactacacgatcgagagagagagagagagattatatatgcagtttggcgtccagaacaaaccaaacactgcaactctagctttctcaaaaagacagtgaaagttctactagctagctaggatcgatattatgcatccaatttgcactttgaaatgggaatttaatgccacctttttgactggtcctacctgattaggtagtactaattaatcttttatgttagttgcattgaccttggcgaaataatgcatgttaaaaggaggaaggtaccatttgaactgtgaaactttgggctagttagggtggttagctaggcaccgaatatggtaaagatgaagagagctatatgaaagatatttctctctctctctctctcaaaagcttgaacatttcgtttcttcaatgtaattaagctatagtcatcgtttcatcgagcagaggtttaagctgataggtaaaaacggggaaattttcttcggattggtatgcattgctttacatttagacgactagactgtacatttatgtcttttataaaattatatatatatacaaaagatttgcatattattgtgttaatataagctaaactgtagttaacgagtggatttaagttgtaaaggtgaacatatttctatttgtttattacaactgtataaacaagttgtacacattgcttttattagttgtagacacaactagacatatgaacgtgaaaaaccctggaaaattaccccattaagagacttactagctagaggccatatacagtacgcctgcatgtttgcaaatcaagcagctggtttttttttgcaagtagtgagtgatcgcctgcatatatagctagaccaaatcttgatgaatgttaattatatataaaaaaaattggccttgaaatgaccgaacgtattagtgactctgagatgccggcttatcgccataaacttttcttatctgaacagttgctccgtatctgaattcagaaaaggaaattatttcctcaagttaaaatgcttatagacagcttcatgtgaaacgaaaccaaaataccatttcgccaccattattaccttaatatattcatgacatttcatatccaagatatccaatgcgtgcatcacgctatgcctatactacatcactactgtcattgtctgtactagcgccctgttcattcagatcaggcttgcaggattcagagctgagtgcagacagctttggtgaccaatagaactctcattgttacatttcgaaagaaaaaccatggaaacttttcatataagtttatatttatcaggaaatatattaaacattcaatcatgatagcaggaagaatgaaataagtacagatataaaattttaagaaaaatcctatttctaaattctaactctctcattgtgtacttgttggccacagcaaaaaaaataataattatatacataatttagagttgattttaagatcttttcatcaaattctattttctatcatcaaacctgtagcaatagaaatataaaagtttaagtgaatttaaaaaactgcatatagatatttttcacaaaactacagatttaaggtgttatatcacaaaattacaaattgaacattaaatttatcataaaactatagatttaaggtgagataaagcaaaattacagatataatagtgaagttatcacataactacacatttagagtttaaatctttagcactactattatgttggagttatatatattatagttttgtgattaaattggcgctaaacatgtagttttgtaataattttaccagtatatctatatttttgcgatactcaatcttaattccattttttcataataagtttactactaaatctattgtttcatgattttttttagataaggaaaatgatttatatccccgacctctgccaacaagttgcatgcggccaatgactcagaaaagataaataaatacttgaggttatgagacaaacccacatctctctcctaattatatctagctgaaaaaccgaaaatagaacatataaaatctataacgatattctataaaaactacaacatccaaagtggaacaacagacatctagctatcgacttcaagagtgtgtagctacactgcacacagtatcatgctccttctgtgaaagcatccagaacaaaaatggagtcaactggaaggaagacatgaagataacctgtaatggttagaaaattttttatcattgaatagtatatcattgcgataatgccaaattaaccaatataagacacttccaaacaaattagtttttttagtggatctaggcactccctttagacaattactaaaaatatttttttagcatatcactatatcagggaggagggattttgaaaggaaaaaatatatatcgctaagcacactttacaatatggcaataaaaaaaatatgctgtataggaactttggactttgggcatttggatggtttgtacgaaacaaattaaacgacagaaggttggtgaaaataatttaatggacgagagatactagagagagaaaggggaagagagagtgcatgcgacttctcaaaacatgagataagacctcatgtttgttttcatttagaattgggacatacgtaggaagcaagttatttttcttaatcatatactccctcattccttaaatgtttgacgccattgacttttttaaatatgtttgaccgttcgtcttattcaaaaattcttgtgaaatgtctaaaactatatgtatacataaaagtatatttaacaataaatcaaatgataggaaaagaattaataattacttaaattttttgaataagatgaatggtcaaacatttttaaaaaaatcaacggcgtcaagcattttagaatggatggagtatattccttcgttccaaaggagttaatatataagaaaattttcctaaggattaatgaaatcgtttcaaattaatttcctctgaaattccttccacccagaagtctgaagaagctaggaactttgctgatcgagtttcacacgcgccgttgtcttccgaagaatctacctgaaccccagcatcaccaccaccaccaccaccacccctgcgcgcggcgcgcaacgtgcacaacacgcggtacgcacgttctctgcagcaatctccaccgtcagatcacggcgcggccgcggttcgagcgaatcccggccgtccgtgatctccttggggggttgccatccctcccctataaattggagagggccaagccatttacccttcaaaattaagcagagctagcttcctctacctgacaagtgtgttccaagtgatcactaccagctacttgacaagtgtatttaagtagctaattaagcaagcagctgtactgagtacacaatgggaggaaacctgtcttgcttcgggtcggcggcggctggttcaggttacggggacatcgccgacgaccagccggcggcggcggcggcgtacgagctgcgacggtcgtcgaggaaggtgcggccgagcgacgaggacaggctgtggtacgtcggcgagcgggacgtcgacaggaaggcggcggagttcatcgccaagttccatgcctcggctaggttcgtggaggcttgaattgagcctaatttgatgacatcttcagatatcttggttcttggatctatacctgggtcactctctctagctagctgctgctcatgctggtgatctgcttggttcgtttagtttacttctcttcttgtataattaactgtgttaattagctagtcctatgcatatatagatatatgtatgtgtatatcaatgtatgtacttaatcggtgtaattaaggacgtgtaaatctgtattattattattctgctaaataagagcaatgctgcacaagctgctgttgtatgtaagtacatgtttcttgcaacgagttggtctctgaaatctgaagtgaaatgcaatgtttattgcttgatgggatttgagaggatgcagtgaattaataattacttgcattaggagaacagaagttccagtaaggattaattatttatcagtactaagtagtgaactctacaaagatgttgtggctggtcaggtaattaacacaaaacttatttggcacgcagtttatatgtgaattaagtgctgattcagactggcatcctctcgctagccatatcaggaatgctgattttttgctttccaattttccaattttgaccaagaaaatatttatgtaactagccttgcccttcatacaaatgcttatagactatgttacccacttacctggctacccttcacgactaaattaacaatgcaattccggtagttttactagctagctgattcgattaattcctttgaaaactagcaaattaacaatatataatgatatacttgaagcctcgatcggtaagctcatcatcaagactagcttatctgtaacggattacaacattatgttcagcttaattaaagtcagagaaaaaggaaattccacagtggatctcctcaattttacccttctgctattttcactcatagcactttaccaagtcgaggtagagtttccaacatttacagaaaaacgatggatgttttctttggctaaatacttgtcaaagagatgacaatttaaggacttactgattaaaagttatgcaaacctcagcctttgcatccaagcattactattgatgccttgattagttcatcttcttcagatatttagaaggagatctgctatagattgacagtaaaatgtgatggtgaacgttaataaagttaatgcgaaataattgaggaatcacattattattggagtaacagttttgattgaacacttagcactatttagtagctgatatatgtttacttccaattatacatccatgattgagtaatattaacccttgcaagaattgtgatgatattcgatcgcatctcattttcaaaaaataaaaaaaaaacatttatgttgtttcagtacttaatttcttgcctctaactgaatttctgctgcaactaattttcttacaacatttatgaagttaatttgttttaaaagacatgatattactgaaaattgttatatttatgtaagttgaaaaggtttgacatatggatacaaaagattcaagcttatcttgggaaaagatgatcaaatgctcggctcgctggacgatacttatctaaacagtctcttggatgcaaatattgcatagtaaaacaaaaaatcaattgcctactatttcgtcagtacaatggagttttggtgccataaaaattaccaggattttgtaccaacagatagtaccaaatatatttttgccgtatggtcttttcagtgcaatgaacatattctacagctacatatcaccaaccattttaaggacctaaccaaaaaataaaaacatttaaaaacaaaacatgaaaggcgcgacaatctttcccgacaaaagcttttatcataaacatatttgtcgcattacttgtccccgtttcatgtacggtgggatctcataggccagaaccatgttccagcctagcaatgtaaccatgttcctgcctagcaatctgctgtcacactaaatcattaatcaactgtcacttgatgctttcattcatgacatttcctccaaaccatcactgatcagcattctaattctatttttaaaaatcagtgtgatgtgttgcctgtcaatctgttaattaacttttacatatatctgttcagtcaatttttttcacttgcaacacatctcttccatatgaatatatttcaccgaaaacttcaaaattcaggttagtactagtaagctgtttttcatacggaatgttattaattgcagtaaaaaaaaacgcattcgacaaggatcatcagcaacttaagctcccaagaacctgtgatacacactttccccggcaaaattaagattcgatccaacttagagggatcacttgaatttgtctctgaactctcatcctttctttcccttaacgtccgaaaattccccttctcaagccatcatcaatactttagggctggggtatcaaatcctcccatggcaagtgttgctttaggtagataagaagaaggagccaatgatttgtgacaagtcactggaccttgtgtgttggaaaattatcagaaaagatcgttgctttgtaccaatggcaccggatcatcgtcctcggaattgcgctttacatataccgtttacattacattcttcagtggagttgcaattacccaattactatatctttgacctgtcaatctctgcatgtttgagaggacagggctggtgaatctgaatattctcaagaaatggtggagatatcgttttgagaaagcggaaattcctttggcatataccgcgctttcgcttttctactgtaccaaactctgagattgtccgcgagatttcctgttcatgttcatctgcaaataatagcctgtgtatgtgcttgccactgttgcatgatttggacatcatgatcaaatcaatagacaccgccatatgtgccacaaaattgcctatttgtgtcacccttgttcatggattttcagaagctgaatggttgcttgtagaagtatctatgacacttcctggatttcaaattatcaccaaatttcaaacttggcaagggacatttttttcaggacatagcgtcaaataggctcagaaacagtcttttattctttttctcatttttccccttgttgataggaacaaaaacgtgcaaaattatgtcatttctttgggcagcattggacggaggagagcaatcttcacatggtgttgcacagctgtgagcacatgatgtgtgaaaaggctatcaaagaaggccttttttttcagtactttggaagtaccagttactatggaaaaagtacatccatagtccaccaggtttctggaagaaaaaaaaacaaattttgataaatgaatgctagcctaacttgttaggactttctagttataaactattttttacaatgagattgaacctttgtacctaataaaggtttcccttttatgttttcaaatgatcctttaagcatcctgaagctaataaattatggattcttgattttgacatcataggtattggtattatatgtattggttcagtgaaccaaacatgagattctaattcagatagctccttgatggggcaatatgcattaaatcttacataaatacactatcattagacaagtgacaagaacctggctatagccaagatttgcattggtccttttttgccaagctgtatcccatggaatctgaaaaagaaaagagggagttcttctttggggcaattaccagcagattgctcagtatgcatatgtcagaattcagagattgttctcatctataaagtgccgcaaaattcattccaccatgacaaatatagatcgcagatcgagcttgcgttcgatgatgagaacaagttgcactttgaagccacacctgataattttgctttcaatcaggagaaaaggctgcccaaagcatcgattctctgctatgcaacaagcgcatgtagcatgtgcgtagctctcttatcttctctgaacctctagctgaattatgaacagattttagtatcatacacactgatatgttggcagaagcagaactgcagaaggttggtacgggacaagtaaagagatcagtactacgtatttcagtacatgatacgtctactggcgtaccaacattcaacaaaaccattgttcagacttatctaactgggctaccgatatatacagctggttttcagtgatatgttctaccacatattttcaaacctacaactgggattggcattgctaggcaaagtagtgggactattttttcgcgttcttcattttttgtgctagcaatgcacaataacaacatgccagaccgttgtttcaatggcgttgaaggtgaggcgatcaccttcttttacctcattttccaggcaaaattttctccaacctggtccatttatgtagccataggtgttcgctgttttgaaagccactcgccaagatccttttttcttcatggatatcttcagtgtgatcgcacaggcttctagcagaccaatttgagagcaaaaggtgcctctcacagactgcaatgttaaagcaatataaagaaataaaatagtagtgagatgtttcattatttttgaaaaaataaacgttcacaaaaatcagaaggattgttattgtcaacacactgtagattaagaatatgtatggcatttctgtattgccttccctaacaaaaaaaatatattgagaaacacaaaagaaattttcattttcatatcagaatcaataacaagtactacaaaatggtcaaaataaacagccaaggacttcttgtcaggaaattctcgacatttaactgatggtatttaaccaaaattctcatgataaactacatttttagttgatatcatgttgtagtgtcctttttctctatgtgtatgacaattttacaattacagatttggttctttaaagcaaaaaaaatcatccatatttagacctaacagatagtttcagaaattgaagaaacaaaagtcagtgattttccatgttgataatttctatatttttttccttaagctcgtattaaaccaaaaaaatcatccatatttagacctgaacagatagttttcagaaatagaagaaacaaaatgtcagtgatctttcatgttgattaatttcatttttttgttcttaagctcataagcagttaagctagataaaaacagcagaagctgaagcgctcacaagtaggctatgaatactataggccgtcatttcctttgtgaatgaattctgtgacacaatgctgacatgtttcttatgtggttcaaccttcacggaaattggggaagccctagatttcctgtttggtccctctaagcatgtaccctcaattcttcgcgtccttttccgcttgacaggtgaaactccaacttttgctgcacctgcataattacattttgaaaagaaacacggaaaatccatagttgaaactacaacggagctggaatgctactggcttactttgttgaggcgcattgctcggtccttcggtaccatcagttaagtacagcgctgccgttttgtactccttcaggcagccgttctgtaggaacacctcaaccgtgaacaccatgttaccttcataccggaacagcaggatgttgccttcggagagatcatgagcagccagaaatggcgcccagccgtctcgcagtagcacgtccggttgctcccgttgtagttcgactcgccagaacttgccaagagggcaaacaataatggcattctggtggttgtttgtgtaggtttcagtcaggtgttgctgcacaaacttctcagggattttctgaaagaatgttgacagcaaaagaaagagcatgctgtgagcacataatacatataactgcatcaccttcagagctaatagcctatcaattccacaaatacatagtactactagcactagcttattagctgaaggcggttttcccctgttcttttcatctcattcatcgaactattgaaacggggttatttgctccactcttcgaaaaatacgttaccacttgttttaagttatttgtttaagtttatttcttaaagcatttaacttatccccataatccaatcgatcgataatccgcttaacaatctaaatcaaacaaggccagagtgcattatcataagaagaagagaagcaggtaatcaaccagaagagcagaacttgggcggaagttgcaagggttatgacgggtgaagcggagctgtggcggctagctagagctgcaatccctgttttggtagctcatgttagtggagaagggtcgcaaaatttagttggagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4834 - DNA, 4828 bp, Oryza sativa
  unsure (1)..(4828): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctttttcacattcccacctaaatttacattctagattcatcactaggtggccgatgtccgggtagcttctgacgcagtggtcagcgcgcatgcagcggttgtttaggttgccggtgtagaagcagatggcgccaaatataggggagatcgaccgccaggctaagccacatgctctacgacagcacgtactgcacggagagcatccccatgccggctgccatcacgttgctcagattgaagcagctcttcctaaaggaagcgccagtgatccaccagtagggtggaggggcggcggctgctccacgtcgtaaaccacctcatcgtgtcgtagatatatttgctaatattatttagtaccattttttttcttattactatttataatcttgctcgcaccgtttagatgttagtattaaattcagtgttattatttgctccttctaattatggctacctggtttactccactatctcatacaaacaaatcacgtaaaatggaacagaagttgagatatcgaaagaacttgtaaactaataactatataaaccatattatacctcttaaatgttaacccattacgtatttataggaggcagtaacctacccagtcatataacggcgctagcggatcatacagttttcaccctctttctatgcacacattccacactgccagtaacatatttttctttcaagagagaagttgtttgagttcttgcccaccaactttgcgtgaggttctctgatgggctctcctgtaactgtttctcggctagcaggatgggcctcggggccacggcccaccgtcggtcctgacgcaaaggcgctgagatggtattagtactaggattttcttttgttttcatatttctttaataaaatgtttacaaaatataatggctttaaaattagacgtgactacacagctagtggtagctggtttgtctaaaccagctaccactccatataagagagatactatccacttatactttaaatacaattttctcttaaactactaatccgatctacgatccgattgcaccgttatattcgtaacaattaaatgtttataacaagatcttacatgattatattttaatgaaaaattataaattacttttatcatatatctaaattacttttagatttcactaaattacttcttagacatataaaagtaaattcaataaagcctaaaagtaatttacatatattatagaagtaacttatgacaaaaagaaaataactttaatgaatgccttttttcattggacatgtagtcatatttttattcctataacgaatttacttttaacgtcgtgacaaagttacttccaagttgttttaagttacttttataatatatgtaaattacttttagattttattgaatttacttttatatgtctaagaagtaatttagttaaatctaaaagtaacttatatatatatatgataaaagtaacttacgtatataataaaagtaatttataaatataaatattttttcatcataatataatcattatatgtccaaaatggccaaccctgatgggcgatcatcaccatgcgtcaaagattgtatactacttcgtgtaaaacgctgtctgaaagaggatttttcccaatgtgtgttagggggtataaggccgcatttgttacacggtgttgagagcttatttctcatttctcacgcacgcaaaatgttacgacacattagcgtatgattaattaagctttcgctatttttttaaaaaaattgcttatatgattttttaaagcaatttttttacatataacttttgaaaaacacaccgtttagcagtaagagatgtttatgtgcagaaaacgaggaaggtgagttgggaaagttagaaaaaacaccgcctaaatctatagaagatgaaaacaaatttaaaaaacattttaaaaaaataataaaaagttgtagtactagcttgtagcacactgagcatacacatatgcacggcgtggtggtcaacctctaacagcactacacctacactcactcgcgtacagaacatcgtcgcgcgagcgtgacccttttgcccgaaattacctcgcctttgccatcgcccaagtacgctagcacacgcaccgcaccacgtcaagttttaaaactcatggagtgggtgcatttaaaactcatacttcctccgtcccaaaatataaagagttttagttgaaaaatataattggttagaatggatatatcccagtactagaaatatggacagactgcatgtccaaatttgtggtactaagatatgtcctatccaaccaaaactcttcatgttcttataacaaactaaattaaaatataattattaatttgtaaaaagttgaattgaatgcttgacaaggaagtgttatctatgcttcctataaagttaaagtccactaagtctaaagctcaacatgcaatcatgtcacattatcacccactaacaataattacatatttaatctcatgcaagcatacaacatgatctataagtttggtgacctatgctatctatttataacatgtctaaattatccctctaagtaaaaggtaaaacttaaaacgcaacatcattaagccacatcatttgaaaatatggaccattggatgcgacagttgataaaatatctgatattagatcatagataagtatcagtaaaagatagtgaaaggtccaagattgttcaataaactttcataagctgtttgaccaatagtcaatatcctacactttggtatattatccctaacaattctcatacctactggcctattaagtcgtgcatttgcacgactctaacaatcacggtatatgtgatgtgtatgaaaatttattagatgagccaagtatacacagtcaaaatttatagtctgtagcgttgggattgggccatcaaaattggcctattatctattttaaatatttcggcgcgacctgtcatttttgcgccagttgtattagattttgtcgaatttatttataaattatttgatcaaacagttacaggttgtcatttagtccataaatatgtgtcgatactccttcaacttgtaattggaaaggggaaaggtcatgacaaaacaaatgccacttccgagtgatctaagaaagaattttgtgtcctactttcaaggctgagtgccctgtttttgttaaaagtacaactccagggttttctaccaggttagcctgggaaagagagagaagcatcagagcatcgagatccctgatattctttttagtagtatcagtgacttttacctagtgaacagaaatctggcctctagctgtatcagtgattagttcatcacagaatcaaagatacatcaaaatccagagtactgaaagcccaggattatctgcaaattaaaagaagaaaaacaggatgataccttctccattaattaaaattcacgggaaatttgcttgctggctttatcagtaggtttgcaattgcaacaatacgtaccaatgtattagcctggaagatgcctgggtgagagggcgcaggatgtgcagctactatgatttcttcgacgccaacctctccgaggctccgagcctcatggttgctgttatggatcggcgaacgattgccacataccacggcagggcggaactagaacagaacgaaatagaggatggtgcttcttgcttaatttattctattttagatcaagttcaatttaatgcgtgtgtctaagtttgtattgagaaggttacacacatagtgaaaatcaccatatcgatgagttataacttaaaaaaaaattttgatcgggttgctggacacccctgcccatatgctacctccgcccctgcaccacgggacgtacagcaccacagccgtcacgtggatgtggatccggttccacatcgccaagccccatggcttctgcttgtcaccatttccatattctgttgcagttgccagtggatttgtatatgagggcaagtggccggcggcgagcagaacgcctccaccacgtaggcggcaacagagagaaagaagagggagaactcgggcggaacggaggagtggtggtgtaccatgttttgtagtagtgcttagagcattcccagcagctcattcatattcaatcctccatatgcctatttggatagtcctccaaaaggattctcactccatatttctttttactccaacaaatcattcatattacattatctatcctatattttactattatctttcaactgccatctattttatattaatttttctcttctattcattccattctttctcaactcttctcctctcatctactcttttctcaactcttctcctctctcgccgaatccccttcacctccaccacccaccaccgccgccatggcctccgacctacgcccgccagagcaccaagtggcggggaactacgcgtccaccgataagttgggcccgctcgtcccgcgcgtctacaagatcctccaggccggggagcgcggggagcacgaggccgccttcttcccgggagggggaggggaaggcggtggaagtggggag

SEQ ID NO: 4835 - DNA, 19449 bp, Oryza sativa
  unsure (1)..(19449): unsure at all n locations
tgctggagcgttgtttttcccctccatgcgccaaaaacgggatggaggaccggatagaggagctgctgggaatgctcttatatctcactattatccttgctttaagactgtgttcgttccctctcttttccaacctcccctcacttgtttttcacgcatacgtttttcaaagtgctagatggtatgttttttttgctaaaaattttttttgtatgaaagttactttaaaaaaatcatattaatatatttttcaaattttttagttaataagtaattaattatgcgttaatgagttgcttcgtttttcacgccggaggattagttcccaaagttaaagaaccgaatacagcattaagaagttctgcgaacaacattcgagaagattccaaatgacgagagattgagattatccgatggcctgtaatgtttgaagtaaacatcggacggctaatgctcattttctaatccgacggtctttattattttgattgcgtggagcatgctggtagcttggtgggatttacctttcatgaaagtagattggttaagactaacttagtacaataatatatacaacacaatagttctctattttaactcggcatagaaaagtttatgatgcaacacatctttcaaatttagatacacaaccttttaatttcactaaaattgtattggactatgtataaaattacttaaaaaacaaatttcataaactttgttttcaaatggctaatataattctttcatttaagtgttagacgcatcttctaagttcaggtttaacatataaattaatccataataggcggctcatgattagctttatctttaagctacaatgcttttaaatgggtggattagaggtaaccatatagttgagaggtgaccttcatcgccttcagtcacctgttcatcctgctggggtgataggctatactgtggcacattacgcctccatgtcactacacatgttaaactagtcgaaaggccaaccaggcattacccttgccattaatttacgtcataatgcaaaaaaaaatattaatgctaaaatctgaatattgcacttgccattaattccatattgcactcgccattccgtatcattgtaaattaacattacaaaatttataaaatttataagtagtacaacatttttttaagggatggtacaacttattttaataaatgattttaatgttgatttcgtatgatcctaattcttacttttaattagacgatcaaaataaacttattagcttaaactttatctgcacaatctatatagatgggagcgccaacaaaacatatgatatgaggccatgcaatggtgagtataatgggaacatagcagcgatgatgattaagaggtgtgcgagtatagtgtgcatgattagtgatgtacgaaatctaaaaagtaattatgagtgtgcgcgtcttccatgcatccatataataaaaaaaatatgtttgtatccttactaaacctgttgctaacttaattccaccattgacttttcaattttcattaaccataattctaaatttacattgttaattgttatcacaaattttagcaaacttactatcaacaacacataaatacattttaaaaggtgtaccttggcaaaattcttattagacatcatcgaggagtacatggtcgggaagacgccatggccggcgaagcagacgaagtagaggctgagggaccctttcaggtaagaggcagttgccctctatgtcgaagcccttatcggacatgccgacccaaaccagcgatgtcgtaacgccaccgacgagatgagcctgaccgccaagacataggcgagcatgctgaggtaattgagccacgtcgtcgggaggatgacggcacccgcagcgagcatgaacaactgcttcccgtacacatctggtaccgtaggatctccaccacgtgctagggagtagcttgtcgaggatgtcgccctcgaggatgaggaagctgatggcaaggaggtagagcttgatgtacatgacaaggcagatggttatcttgctgtacccgcaaaggcgaggtggtcacagtgggagatccacggttggggctggttggggcaccagccccacctccaattcatgcacctaattagccattaacatatacgaggccgatggctatctggctgtagccgtcgaaggcgaggtggccacagtgggagatctgttgggctggttagggcgccagccccacctccgattcatgcacctaattagccattaattagtgaaaaactggtttggggcaaggcaagctacctcactgtctaaagcagaccataccagtagtactgtgcaagacaaggcaatatagattttattcgtagatcactcacgatcatacctatttattcatggatcttttaggatattttatatagcaacaaaagtttttcccactgcgtcgctggatctaggcgggaggaggcaagccgccatcgtgggaaaaggccctcccaccaccgctgcttccgccgccgtccggtcctgctatcggagctgggtgggaggaggcccgccgccactggatctaggcaggaggaggtgagctgccgtccactcccaccgccgtcgccagatatgcaagggaggaggtgagccgccgtcctctcccaccaccgctgctcccgtcgccgagccgtcgaccactcctgccgccgtcgccagatgtgggcgggaggaggtgagccgtcgttcgctcccaccgccactgctcccatcgccgagccaccgaccgctcccgccgccatcaccagatatgggcaggaggaggcccgccgcatggcatcaaccgctgctgccgcctcgtcggtggcggcggcgtcgggggggatggagccgatcgcctcctcctcgtcgtcgtcggtggcggtgaggaaggggatgacggtggcactgctgaccgcccatcgccgcccactcggagggagagagatagagagattgaggagaggattttgagaggagaggaagagaggagtggaggagaggattgaaaatatgttgagaggagatgggtgaaaaaaattgaagtggtgaggagggaaagagagaggatgggagaaaaaaaaggagatatttttgtatgcggatcacttaaggcatcgtatacgaaaatgtatttttgcatgtggttaagggaccgcatgccaaaataggagcttttaactatttgccacttttagatttggcatttaactatttgccacctctatcttaatgacatttgggtccagtggcaaatagttatttgccacatctaaaagtagtaaacagttaaatatctcgtaaaaataggtttattttcacttgcgtctaggttcgtttgtgaaaatcgattttcgaatgcgggcatcttactaaaccgtatatgaatttgaaggctgatttttatagacgtggacaattatgatccgtctgcagcctaaccagggtcctcaaaaaatttcttatgtagtagcacctgccctacgacagcgcatacggcacggagagcatgcaataactgagatcacgttgctgaggctgaggcacatgtcaggttgctgaggttaaggcagcttatacatgcagaacgacctgctggcggtagggaggacgagagctgctcctgctccaacatcgttgtaaaccacctcatcgtgccattcttgctagtattaatatcaatcattttcctgttactatttactcccttgctcgcactgtttagagcatataaaaaaaaggtccaatcagattcccaaaagagataaaaaaagttccaatcagattcggaatttagcgaaaaaccatacatccaacatatacaacaagctaataaatagcgttcgtagcacccactatagcgcggacctctaccgctaccgctacgaggtagcagactgaagatagcatgttgtaacttagcgcccgctatagcatttcgctactgctataacagcctgttatagcgcttcgtgtccgctataacagcccgctattgactttgttggaccattgtaacgcttaaatgttgttcttcatatatggattgtagaactttacattgtttatcttatttatcttataaatctatatgtgatttcatatttttttttatgttatgaaatataggagtaattaaaaatgtattattaattctaatttttacgtgaaatttatgttaatattgatatatttatggctattttcttatatttgctatcggaacttagcgcccgctatccgcaacactctacacagacgctaatccactaacaacccgctatacgctactatttattaggacatggatacacagaaaccagctaccactccatctattaaagatactatctacctatacttcaaataaacttttctcttaaactactcatctgatatacgatccgattacaccgttgtgttcgtaacaattaaatctttatgacaagttctcacatgattatattttgatgaaaaattataaattacttttataatatatctaaattacttttaaatttcactaaattacttcttggactaaaaaagtaattcaataaagcctaaaagttattccatcaatgttatttacaatccatgaaaggttttatcttctttttattaaacggatttacagagagttacttctcaaccatgcaaaagttacttctaattaacattgaagttacttttaaaaaatgttaaacttacttgtgttaatctgtactgattaaatttaatttcgagataaaatcatatttttatccctacaatgaatttacttctaatatcgtgataaagttacttccgtttggttttaagttacttttataatatatgtaaattacttttagactttattgaatttacttttatatgtctaagaagtaatttagtcaaatctaaaagtaacttatatatatgataaaagtaacttacgtatataataaaagtaatttataaatataaatattttttcatcgtaatataatcatgtaagatcttgttgtgaagatttaattgtaatgaacataatggtgtaatcggattatagattggataagtaatttgagagaaaactttatttgaggagaaaaaagacatacgtatctattaaaaaaaggcaaacaggcactacgttgatccttcttattgagccattagagcgcagccacgcagatgtacgtcgggatgacaggcacgatcgaacggctgtgagccgtgtcgcgtgatacgactaaagcgagaagcctctcggtttagattttacgtacctatatggcccttatattcacccacatccaaaatcggtgccaatcctaaccagattttgggatgctctgcgcattcccaaccacagtagatttgggccgccagcgccaattttttccgtacgcaccatttttctcttcctctcgtgccgtaggcttcctgggtcatatccttcatagctccggatgaagccgcgttcttgccttcgttgacttgtctgattaattgtctcctcacctatggcagcgccagtccttcatccaaggtgcagaggcccccaatccgaggaatcacaacattttttgttgaactcaatgctcgcctccattccttccatggctgtgtttagttccttataaaaatttttttgacgtatatgaacacacatttaaagtattaaacataggttaataacaaaacaaattatagatttcgcttgtaaactgcgagacaaatctattaagtctaattaatccgttattaacaaatgtttactatagcactatattgttaaatcatggcgcaattaaacttaaaagatttgtctcgcaatttatatgcaaactgtgtaattggttttgtttctgtccatatttaatgctccatgtatgtttccaaacatttaatgtgacattttttgaaagtttaaagggaagtcacaacctatgtcaccgacgcccccctccgatcagggccatcgagggcaccaccacacagcttgacctccatccaggaccctcaagggcgccaccgcacggccttaccttcttccaggctgcctcgcccgctccatcttatggtgctgcatccccttcgttggcggtcaccggatcccgtgttgcaggtaaacgacgatcccctgaacgtcgcttggtctctctcgttagcattttcttgttgaatgatgcattgcatgttttcaatggatagactgatgcactctcagtgtagctgtcaagtgaatgcactgcttgatgccgttttaacatgtgggaaaaatctacttttgctgattgagggggaatggactcctaccagaaaatctttgtgcaaactgagtaggacaaactgaaattgcaatatgatcgacttcaggttgttgttgctacttgctgtcatgctccaggcgtccaagtaggtgataaaaaagtaatgagtaatcatttgtcttgaatctgcagcctaaagtttggtgggcattctattgaattggcagttaaaaataatgaatgtgcttacaagtccactgaattccagctagttgataaatggtgcatctatatatctttcagaagacgagttgtgtgtggtttcctactgtactataccttattcagaaattatgcaacagcctattccacatcacactatgctctgaaatgtaaactgtctacttcatgattcgtttgtttttggtgttgctattgttctctgcaaatcttaaaagtgcttcaccatgaagcctaatttaatttggttaggtttttaaggtctagcttcgtatatcaaaacactaactatattagtaaccctatgctctgttctgccatggaaatcctggaaaacttggcagctctgtacatgtgttttgaatttggactataggatgatggacctagctaattactccctccgtttcgaaatgtttgacgccgttgactttttatcacatgtttgaccgttcgtcttatttaaaaaatttaagtaattattaattctttttctatcatttgattcattgttaaatatatttttatgtaggcatataattttacatatctcacaaaagtttttgaataaggtgaacggtcaaacatgtgctaaaaagtcaacggtgtcaaacatttcaaaacggagggagtactacattcaaaacgcgcttttagaaccattttatcgaactgtttccccttttcttcatttgctgtattattcaccaatctgcagtttggaaattttgttatgttgtcatatagagtaaactgactgaactaggtgactgtcgaatcagtagaacaatgtgtgtgcattgtattcaggtttttctttcttgttacttactgattatatcaaacttgttgataatgtggcagcttttttttatggctatatgagaagtgacaataatggatatgtgcaatacatttggtactgcagactagagtagctcccataaacaaatgtttaccgatacgctttcgtaaaaatctctacagaaaagggaggttgcatggattagtctcaatgcatgatttccatatgacttagtcttccgtttctccacacgatcggtcaatccgaacaacagtagtggtggcgggggcgcaaaagtagagcggctagaaaaagaagcgtacggcgattgcacgtggcagagaactgcaatggtaagcggtagagagcgacgaccctagctacccacacggcctacaggccaacaaccatatttttatttttaggattcaagttttgagaatctcctggagatgaagatttttgtgcccaatcatttatgggttggtcctaatctaatattttttgggactattttatagggactattttgtagtcctctattggagatgctcttatatgtgagcattaaattcagtgttattgtatcactcctactaatcatggctatctagtttgctccactatctaacaaaacaaatcacatcaaataaaaaagaagttgagatattgaaagaattgttaactaataacaataaactatattatacatcttaaatgttaacctattaggtttatttataggaggccataatctaaccagtcatgccaatggccaatagctgcgttagcaaatcatacactttccacccacatattccactctgccagtaacctatttttctttcacgagagtgaagccgaagttgtttctgttcttgccaccaaccttgcgtgactctgagataggctctcctatttcgtgcttcggttagcaggattggcctcgggcccacggcccatgggtggtcctgatgcaaaggagctcgagctagtattagtacatgattatttttgttttcatatttttaataagactaatggaaatgatcagtaataattcttaccactaagttagataccatattttattttattatatgcaaatattgacagtcagatattatgatgtaaggaccgtcaacatctcgcatggtcaagtctagacaaaacagagtcaccgtgaactattctcttaatatataattatttttatatgatacgtatcaaaaatattaatattagctatacttaacaaagtagtctgataattgcatacagagacgtacaaggcctccaacgtactcccttcgtcccataaaataaggaatttgggaggtatgcgacacatcctagtacaacgaatctagacatgctctatatccaattcgtagtactacgatgtgtcgcatccctcccaaatcgcttatattatgggatggaaggagtaggagagtagatcatggaacacaagacgtgtaggagatagaaaaaaattgatgatcctatccaaccaagcctcgatcaatttgttctcgttccgagaaaaaaaaaacccaagcaagaattcacaccaaaatattccacgaacgttttgaaaaaaccaaactgacacaggagacgatggaacttacaaacgatatgactacttttcatggaatcggatttttttttcttgaaatcaggtactttttttttttcattgcacagtgccgaaccggattattttataagcgcgggttttttttcacattgggtcagatagttttcttcagagcggtatttttataaatgactttttttttctcgcgtggggtcgaacggttttttcgatccactttttctcgtgtggattcggacttctttaatctttttttatatacaacgatttttatctcacattaagtcggacgttttctataactggtatttttataaacgacagtttttctcctcgtgttgagtcaggtgatttttacgaacagattttcttataatggcgtttttctcgctttagggtctgatttttttttccttttttaagatgatggaaacttgcccatgtgttacaataggtaaaggctttttttccagtagtacatcaactattaggagttgaggaataaattgaaaaagccttgtgtcctacctcccttcgctcggcctgcttccggatcatcccatcaaatattcttgatcactgaaaatttattgagtgattttgatccacttgatctcctcattctattttttgcaaaatcggaacgaaactgcaatacttgggattgggaaaaatcatcggtcggccatcattgacaaccgttaaatggagattaaattcggtgaattaaaaccaaattgaaaggggaaattgggaaaggatgaggacggaatagagaatcgatttttggaattaattagatgagaaaatgtatgggtagagcgttttgacctttttttttttatggactttgaattaggactttttttttacggacgagaagtccttcctttttttatacggacaagaagtcctttttctaaggaatcaaacgtttttttaaggggagccagacattcttttccttttttttaacagaatttttttctcgccgtttttttagttttatacggacggcggaaacatcttttattttgtaagtagtagagaagatatttacaataccaaattaatttcatcaatatattttgataatatgtttattttatattaaaatactactatatcacccttttttataaatttaattaaactttaattttttgacttggataaaaatcaaatgacttgtaatataaaacagaaagagtagcacgctttcctaactcacctccccattttccacgtgcacgcttttcaaactactaatccaaagaaattctttacaaaagatgctttaaaaaatcatattaatatattttttataaaaaatagtaaatacttaattaattataagaaaatgcgtcgcacagtttttgtttttgtggtggtcaacctctaatggcgctacacctacactcactcgcgtaagtacagcgccgcgcgagcatgacccttttgcccgaaattaccccgccttgccatcgcccatagtacgctaacgcacgcaccacaccacgtcgaacctttcacagatccgtcccctcattccccaccccccgtcctccctccccccacttttccctcctcccctagcgagggcgacgccgccggcgagccccccactttcccctccttcccctagcggtgaagattccggcgaccctcctcttccccntcatcctcgcttctcccgaccccagtgcgagctatttcntccgaccccccccccctcaccaagagctgcccttcttccgagctgggtgcgaggtctataccccctccccccaactactccggttgtgactattccggccccggcgagggctccccccgcggagtcccttgcgaccgttagaagttgaggtgcgagagatcgctataaacgactagtgtacaaccaggagtatgcatctctcgacagttagaagtcggggtgtgagagattgctacaaccgaccggtgcgagagatctctattttaactcgacataaaaaagtttatgatgcaacaccttccaaatttagatacactaccttttaatttaactaaaattgtattggactactgatgatgctctctctcgtggcccgatctcctggtgaggggataactctcgctttgatcgagtgcgatgtttgcgacgtggctatcaaccaaaacaagtctaggacgccgtgcaatcgctacaccgcaaacgatgtcgtaccaaccgtgacgcacggttgatgatccctgcaatgcaaacgagagaacactgcaagaataagataagatgcaatcaaaatattgcgaataggggattaagcacaaaggaatagttgtgattgaagtggtagatccaatcgacccggcaaatcaacacaccaactattgggtgatgtgcactagggttcccgatcttctgaaaggttctgataaacaacgatttgggcggagtcgagacacaaatcaatccagcttcttgaacacgcacgctcttgagccccgcaatcgcagcaccacatctcctctggttatcaccgtgtcgaaatgcggatgacatcgccgagaaggctaatccctgtttgccaatcgaagaacacaaacaagaacgagatagaaaacaaccaaaattgtagatgaatgattaagctcacgagttggggtcttacaaaccgatctagcgacgaaactgttctcgacagaataatctaagcaaaacccgactcaaaacgatgacggctactgaataaatgtgattagggacgtcctagggttgccctagggtgcacaatcccttgggctaagcccacgacacaattacaaggctcaaaacccaaatcagattcggatctagatgagatacgtgaattgttttgcagattcccggcagctcggtaggaattttgacgtggaactaaaaccatctgaaagtagactcaataagctttctaataagtactcatgggccccgaaataccttctagatcagtggctaggtctgtttgaagttgatgctgtcaggaggcccgaatccgaatccaaaacgtgtacaacttgatctcttgtcttctatgtgccaaaagtgatgtggtgaggtagaagtagacttggagaaggtcttggtttggtccccaatcaacttctttaatcatccatgtattagttaagctcggtctcttttccttcgcccaagcaagtacctctgcaatcgaaaacacacaaaattcattgtgtagtaacgtttgttcaaatatataacaagtaaatctaatgtagaatatatgcacctttatttgattaatacataaggtagtcatggttatatccgagctagttatgtcctcatcatcctccccttcttgattggaaaccgtcctcggtttcaccttgtcatggagcatattgtatttatctttgtctatcacagcatcctgtgcggaacatttcttgatgtacactagggttcccgatcttccaaaaggttctgataaacgacgatttgggcggagtcgcgacacaaatcgatctggcttcttgaacgcgcacgctcttgagccctgcaatcgcagtatcacgtctcctctggttatcacccgtgtcgaaacgcggatgacctcgccgagaaggctaatccctatttgccaatcgaagaacacaaacaagaacgagatagaaagcaaccaagcgagataaccatgactaccttatgtattaatcattgggggctctgaatctatagtcgccaactaatcgagcaaggactagaaacaaggtgaatgacacttagcaaaattcaactaaacaaaacccaattgttctagagggtgtacataaatatttatagaggaaaatagatatagggtttagtgctgattcgtggaggtagagggagacactttcgagatgggcctagtctattagaaagcccaaggcccaagttcggttttagcaacaacactgtcttgttttgacgattcccgttaactcaaaatgaatttggatatgagactggatgcatttgaaagttgattagataagctttccatcaagtccaacatcatccaaatcggagttggcatgaccatatgaaggcgctaggtccgtttgaagtcagtgctgtctccggaggctgaactggattccaaaactcattggactttaatatctttagatcctccattcatccgatgtattcttttgcaatgttttatatttctcatgcttggttgtatgaatatacttgatgatcacatcatcctccttcttgtctggaaaccgttctcgatttcttgttgcaattgtcgtcataggagagatcacatgaaaaaaatagcaaacaagcaatcattgtgtagcatcatttgttctatataaatccaatttacatcacgaaaaacgaactcaccttaatggacatgtcttaaaaagatagtgagacttgaccatagaatctaatggtgcatagcactccccttcttgaatattgtcatcgatcttcaaaacaaggttaagtaaatttatcccaatagcatcaacgctgtacgatccatttagtttctcacattttttccatatttaaaggagtattcaaatatgaacatatataaacacgatgcaccatataatctcctctattattatatttaccaatgacatgataactattccaagaaaaacatagaaaatcataaaatttcatctctaaggtatttagatcacaaggaacgtcaaattcgatataacctaaagtacataaagaagacaataattgcagctcttctcagtcattagcaatagcaaagacacgtttattttgagtggaacccaaatattcagaaatagaagtagcatgttctttcactaattgtgccatgtatataagttaagcattgcacaactcttcctcattacaagcattatcaatatcaacacaatctgaatttttagcttgtgataaaggcacattagaaattcgttccactagaggttgctctaacatagcataactagtggacaattgtagcataacacaattattcctaccttggtctagttgaacatcaattaagttacctgaaatgctctcttgagttaatttaggtgctttattattcttttcttcaaaatttcttttaccttcctacatgatgttatatacaatagaaggcgcaagaatattctcatgtatcaaaagtaactaaaaagatggctatgtgttttatttttaagcctaagctgaaactttaaatcaagcccatgtaaaaaccttttaattgtatcttctctagactcgcctatgccaccgtacaacatacaaatttaaaactcccggtggtagtctctcacggttctattcccttatttcaaattttgcattttcttttgtaaatcacgaatacaataatcgggtacaaatcaaaatcagcaccaccaacgagatgagcccgaccgccgagtcataggcgggcatgctgaggttcttgagccacgtcgtcaggaggatgatggcgccccaccgcgagcatgaatagctgcttcccatacacctggtacccccaggatcttcaccaccgtgccaggaaggagcttctcgatgttgtcaccctcgaggatgaggaagctgatggcgacaaggtagagctcgacttataagacgaggccgatggccatctagccgtagccggcgaaggctaggtacggccatcgtaggcaagatggacacagtgtcggatccactcttggggctggttgggacaccaaccccacctaattagcgattaacacatataattaacctctaattcatgcacctaattagcgattaacacatataattaaccattgattagtgaaaaactagttggcggcaaggcaagctacctcactagctaaagtagaccataccaatggtcttaagcaagataaattttattcgtagatcattctctgcagaccatacctatttatttatagatcgttaaggatattttttatagcaacaaaagttgaaatggagaaataattgtgttctctcccgttcatatgcgtatttggatttcattaaaaaatacttttgtcgatatatttctagtttgtttcagtcatacagcttttacacagccccatctcaatttacaattcgcactgggtggctgatgtccggatagcttctgacgcagtggtcagcgcacatgcagcgatcgatgagtttgccggtgtagaagcagatagcgccgaccatggtgaagagtgcaaggctgagccacttaccgcatatgacacggagagcagatgcctgagatgacgttgttgaggttgaggcagctcctcctgaaggaagtgccaatgatgcagaacgagccgtcgctagtaaagaggagtggctgctgctccatatcgtaaaccacctcatcgtgccatatatcttcttactagtataatttaataccaatcattttcttattattatttataaccttgcttgcaccttttagatgtgagcttcaaatttagtgatattgtatcgctccttttaatcatggttatttggtttactccactatctcataaaaataaatcacataaaatggaaaagaagttgagagatattgaaagaaattgtaaactactactaataactataaaccatattatacatcttacatgttaacatgtaacgtatttagagcaagtttaatagtatagccaacaacaagctccaatttatctatagccaatttagggcctgtttggcatagctccagctccagctccacccctcctagagctggagctcaaccaaacagttttagctccaccaaaactaggagtggagttgggtagagctctctcacaaaatgtactagagttgtggagctgggttaggcaggttcacaacttcactccagactcaactcctggagcaatatttaggagttggagctatgccaaacaggtccttaatagtcgattcatacaatagtgcttactatactattaatacctgatcccacctgtcatacacacattatatacacacattatgtcttgaagtccgtgctggagctgtctacagatctgtagcccgctgctcttctctctcctattttatctctttaaaatatgtttataactgacttataacctcctattatacctgctcttataggaggcagtaacctaaccagccataccaatggccaatagtgcgctagcggatcatatagttttcaccattttcctacgcacacattccacactgtcaataacctaattttctttcacgagagtgaagctgcccaccaactttgcgtgtctgtgatggactctcctatttcgtgctttggctatcaggatgggcctcgggtccacagcccgcggggtcctgactccttatgcaaaggagctcgagctattatcagtactaggattttttttcatatttttaataagatatttaccatatcaaattagttttattaatatattttgataatatgtttattttatattaaaaatactacagtattacatattactcattggataaaaatcaaacgatttgtaatataaaacggagcgagtggcgggtagcacacggttaatttccgcaaactttcccaactcaccttcctcgtttttcgcgtgcatattttttaaactgctaaacggtgtgttttttttcaaaaaagttatattgaaaagttgctttaaaaaaccatattaatattttttttaaaaaaaataagtaaatccttaattaagcataagaaaacacgtcgcaccgttttgcgtgcgtgagaggtaaggttgtgtgagttgccaacctcacctcccgaacacagccggagcatatttatgcatgtcgtggtggtcaacctctaacggccctacacctacacgcactcgtgtacgtacggccctgcgcgggcgcgacccttttgcccgaaattaccccgccttcccatcgcccacagttacgctaccgcaccacaccacgtcgaacatttcacggatccgtcccatcattccccaccccctcctctcctccctttccccgcgattcgtgcgagggcgacgccgccagcaatccccccctcccacacccactttcccctcctccccccgctggcgaagattccggtgatcctccccttcccctccttccctcctctcccgaccccagcgcaagccatatccttcaacttccccaggagcggccctctcccgagccgggtgcgaggtctatactcacccccctggatcgtcagttgtgactactccggccccggcgagggctccccccgcggagtcccttgcgccgttgggtggagacttgtggcgttgatggtgagtttccccattctcgtacccatctttcccttttacctcccgatggattctagggtttcgggggtggtgtgcaatttgggggcgaattttgcggatgcgcatttcgtcataatgcaaaaaaatattaatgctaaattgtgtatgttgcacttggcattaatttcgtattgcactcgccattctctatcagtgtaaaataactttacaaaatttataagtagtacaactttttttaagggatggtacaacttattttaataaaataagttattttaatgttgatttcgtctgatcctaatttttacttttaattggacgatcaaaataaccttattagcttaaattttatctgcacgatgtatatagacctggtatatgatgggagcgccaacaaaacatatgagggccatgcagtggtgagtataatgagaacgtagtagcgatgatgattaggaggtgtgcgagtatgttgtgcatgattagtgatatacgagttgtaaaaaataattatgagtgtgtgcgtcttccatgcacgcatataataaaaaaacaatctgtttgtattcttaccaaaccggttgctaatttaatttcaccattgacttttcatttttcattaaccataatctaaatttacattgttaattgttatcacaaattttagtaaacttaccatcacaacacataaataaattttaataaagtgtattttgggaaaatcattcttggacttcatcgaggagtacactgtcaggaagaagccatggccggcgaagcagaggaagtagaggatgagggcgatgggcaacccggttcatgttcaacaggctgctgcccgccatgtggaagcacatatcggccatgccggcccagactagcggcgccgtcagtgcgaccgaagagacgagcctgatcgccgagacgtaggcgagcatgatgaggttcttgagccacatcttcgggagcatgatggcgcctgaaatcacgttgttgaggttgaggcagctcctccttctgaaggaagcgcccgtgatgcagaacaagctgccgctggtagggaagatgagctgctgctaacaagctgccgctggtagggaagaggagctgctgctgctccagttcataaaccacctgatcgtgccgagtattttttaaaaccaattcttttcttattactatttataatcttgctcgtgccgtttagatgtgagcattaaattcagtgttgctgtatcgctccttctaataatggctctctggtttactccactatctcatataaacaagtcacataaaatagaaaaggagttgagatattgaaagaacgtgtaaactagtaactataaaccatattatacatctgaaatgttaacctattacgtattcataggaggcagtaaccgaaccagtcatgctaattgccaatatgtgcgctagcggatcatatagttttcactctattcccatgcacacattctacactacctctatttttggttcacgagagtgaagcagaagttgtttcttttctttcttgcccaacaattttgcgtgactgtgatgggctctcctattttgtgcgtggaacagttgagtggtagaaatatccagtattgcagttgaaagatccgaatcagatttgatcattagttaagggagttaaagtggacttattccggctagcaggatgggcctcgggcccatggcccacgggtggttctgaacacctgatgcaacggagctcgagctagtattagtattaggttttttttgttttcatattttttaatagaatatttacaatattaaattagttttataatatattttgataatatgtttaatattgaaaaatactattatattacttatttttataaatttaattaaactaaaaattttgaaaaaaaatcaaacaacttggaatatactacctccgtcctatattaattgtcgctttgactttttacttacaacgtttgaccattcgttttatttataaaaataatacaaatataaaaaatgataagtcatacttagagtatatttgataataaaacaagtcacaaataaaataaataataattctaaaattttgtaaataagacgaatgatcaaataattactcccttcgtcccacaatataagggattttg

SEQ ID NO: 4836 - DNA, 12538 bp, Oryza sativa
gtgtgcctatgggatttgtgttgatctgtgcttattccttttgcagttcacttgccgatgtgtacgatttactcctgtgtgtatgatttactgattggatgcgctattcgttataagcggggaaattgcggttgattctggtggatgcgtgtttcttccttattagtggcttactgcactagtacactacacttagatttatgtgtgattcatgtgtaattgtggcataatttgcacttcttactccgcctgtagaacgcaccgattagatgactctttagaatttgctgataaagaattactgagctctgagcagtggacgtagttctgtaaattaagaaatgttaggcatctttttgtcagtggcatatacggacacactcaaagtcaatacttgtattgtcttgaccaaataaggatctaagccattcattatatcctatgcaattaactaaaactaatgccttattgggttatgcacatgcaattattcctagagataaagggtgctgctgcttgcacttctgctcatatattcttttttcttcttttgcctagatacactttcgatattatcttttttagctgttttcttcaccatgattcatactgttatttgaattgtggtaagttgatccaaaatactttttaatggccaagctgctttccatatttcaggatgttatataaccatcaaaccagataacactcagtttagcactcaagcagccgtatagtgacttagtgcaagaagcacgatgcttgaggatttctttactcttactgagatgaaggatggcatttcaactgtagcacgaattggagaactggtatctgagatcaagaagctcaaaagtgctgctgaacttaacaccgctgacttgataaggcagtgtgcaacggctgcaaacactctagcgtccaccaaaaatgaagagtgtcttcagcattttgttcagctaaatggtgtcggtttcctccatcaatggcttcaggatgctcagaactgtggtgaggatatcagcaatgcagcagaagacctaatagttgcagtattgtctgcactggagtgtcttccagttgaaaatgcacaaattacttcttgtggtgttctgcatactgttgagcatctactttctcatagcaatactgatatcaacaaaaaggcaggagtgctttgtcataaatggagaagtgtaccgaaatgcacttctgatgtccatgacatggtagcaaaagagcggaacccagatcaactcaaactcccagaacctaaacctgagtctggtggggcaaatgaagctgcaattgcaggagataagtcgaagtctgaggtgatggtctgctcgagtgttcctttgcctaatcactcccagaccaatgataactgtgatatagtgaagcagtcgctggtgatgatacccccaaactccgatggaaatgccattattggtgatgggaacccctcagtaccatcacttgcatgtcgtaatggtttagaaaatgtacctgtgacggaggagtcttctgctaacaatgatgcaaaaagtggtgctgcacaagtctcactgccagatggaactgcagaggccaagtcttctgggactaataatccagaaaatccatttgttagtaacaaaatggatgtgcaggaccaaaatgtttctattagcgtggatatcaagaaaggtgaatcctttttggaagatatgccacactctgagaagaatacagtgggaggctgggacctagccccccttgacatgcaagattcatcagatgatgaaagtacaaggaaagaggaggggcctacatcatcatctgatacagatgtaaagggcgctgtcaatgaattgaggttgaagagatgcatgacgagctttggggattcctcaaaggcagcagacaagaaatcgaaagcagaaaagggagatacatcaacaccattagctgagtatgatgatactgatgcactggaagtagctcgtctggttgctattgaggtagagcgggaagtcattgactacaggggaccattttgtggttcccctgatattaattccagacggtctgatagtcccgacttagaagcacgccggcagcctgaaccgcccatggatgaaccggataatgataataaatcctccactacaggggaggattcaggaagttcctcatctatgaaggaggatggttcaggcatcacggatgacagtggtactttcagtagaaaacatacgcgaagcatgaagctgggaggcattgatcttaatgaaaaccagtgcactgaggaagttgattgtcatacgaagtccacgcttagtaattcaattaatttatcaacacctatagctgtggctgcctcaagaacctcatctgtattcccagctcgattgcactttgaaggtgaactgggatggaaaggttctgcagccaccagtgcttttcgaccggcttctcctcggtgtactcccgatggagagaaatcagtatctgcctcttcacagagaacaggcaatgctctgtttgacttgaatgtttctgaaagtgacaatgctactgctggtgaaccactttcagcagccatccttccgctttcttctgacatagtgcgaaaggatgcctctgcaactgttggcctgaatagccttgaacttgaccttaattgtccatgtgacgatgaggaagctgcaatcaccacaagtaatgtaccatcattttggaatcgacaacaatgtaatggcgattggagtcacccttcttcctcttcatcttcaaggcaacctgcagtaaggaactttgacttgaatgacaacacaccaatcgtggatggctttttacgaggtgcagatgagtcctctgtcaagacttctgggagggatgtgtcagaccattctgcagtgacaattctgggcaagagaatagttcttggacagaaggaacatagccatcaaaatgagcataactttcttgggccaagtgtggaatcaagagatcctgcaaggtctatgcaatcttacgggcatacaccccctgattatagtgttgtcagctattcgtctcattctgctttgtctttcccgtcacctttctatgcaccagggactgttccttatatggttgatgcaaagggcacgccagttatacctccattgccaggtttcggtgtaccaacggtgccaaacttaggagtgggcacatctcatccatctctcggcagcagagcaatcccaccctctagtgaattgagctattttcatcccagcatggatctcaactatggaaggtcatatgaaggtgcacgtagggaaggtgcaagctattggcctgtgtctttccaaggtcagaccatgtttgtggacgagcgcatgggtaacatgtcacagggtggcagctctggggtgccagtattgaagcgaaaagagccagacttaggttgggatctgtacccacgtcgctaggtatgatgtttgtcgcaattgtaatcgatttttgttgttttatttatttggtttgttcaatgtaccgcttgctgtggtaccttggacattctggagtatttttggcacctaaaaataggtcccagttctattaggttggaagacataccacagagaactgaataaggccagctactagttagatttcagagatgttgacttgccatggacattgttggcagctgaataccttgtgcagatttggttctttgtgaacgtagcttcttttagtagtcttcatatagccaaaccactgtacggaaagctgaatttatgtatatcattgtagaacttataattaatagatgaaatgcttccagtttgtccttttttttttgttgtcttaactgggttccttaatgtaattaagtatacccaatcttgtagcatgtgctgaagtaattgtacttattagaatccaatgtgaaatggcataaacaaaagaattaattcccacttgatttgatgtattcatgtagatttaacttgccttttttgtctcttgatgttgtatggaatccgctgatagttgcttaccgttagattggatgtatgatgtagaaggttgtttgctgcatcacggtagaaggttcttccttttggtattgtaataactgacagtattattctcatttctgtattgaaatgggagaggtgatcctctctttctcaaaaaaagggaaagatttataacttaacagttcgcattacataggtactagaagattatctatctaccagagtagtacgactcgctgattcgctcaaaaccgataagttaattaaagcttacttcaaattcgagtagcaacaggggagataaaagctagttatttgctaatatctcctaaaactcttggacatggttaagaaagtatgtggaattcaatagagaaaaattatgattgatttagaagagttggtagatgaagaatttggatcgaggattagttaatccagccatagaacacgctaattaagccccctcttttttctactcatcaaactcccataaaactcgctgattaaacctgaaaagaacatatcaagaaacgcccgagaaaactgaactgtcctcagacgataacccagctgcaggagacgcagttggaccggctgcaagggacgtcgtcgtcgccgtcggtctccccggcaatggggtcgaggcagcgagcggcggcccggcgaagtagctgccaccggcggcgccgcctcctcggcgaaggttaaccggacggcgttgcccgctctcgcggcggccatggctagatagatgcttgcaggtttcttggattccttgtatactctttctgcaggattactacaagaattgctcgatgtggctaagcttatcgagtgtgcttatagaccaaggacgaagaggaagaggagattctcgcgccatttttagcttactcttttcgcgtttctttttcgatgttattttggcaaatttggcagttttgcaggtagcagaaagttattggttgctattggcctaacttgcaattcttcagggtaatttcgtgcgctgttacaggtgtgaatgatatttatctagctgttgagtgatgttaaaatacatgatgtctttgtcgatagctccagaaatactgtcaattgaaaatctctccgagcaatgcaaattatcacttgccatcttccgccgattgtagcgagcatgccttttggagcaaagttgggggcgtatctgacgatgaaaacaaatatgcccaacaaaatgtgcatcaacgaactatcaactccctaaaatgtatcattatcagtttaccatcgaacgagagggcctaagaatgaatctttgtaccgctcgaataagatttgccagcacgatcatgtatcatcggttaataatatccctgtccccaccgtctttctcctttattgaaattttttatcctcgattgactgtcacgctgttttttttttcagcggtgcttcctgattggactagaggaaaaggagtttgtgtttggactgtcatcgcactatttatcgggcgtttccgtgtttggtatgggcgactgggcacgtgcttgtttatatggcgttgtgtgttgcctagcttggtgtctgatatggacgtccgggcatgggttattaggccattcacaaagctccgatgtgtcattcagctccgactagccacgtagatgaattggttgcgtggagaagagaaagggatggggaccatgttttcatggggttctcgtgcactcttttggtaccagggacctcatcaacttcgttaggaaaagtgagggagtgggtctttacgcgcagcaggaagcaagggagagagagagagaggagaatacgatggtaaagaggggaggggctcgccggcgtaggcgaggagggcagcgcggtggcaaccacggcggcgacgacgaagccatggccatgaccatcctcacgtcgcgccccgatgagccatcaccactggatttgtcgagcttggccacgccgtcgtcgagactcgccaccaccgcgctgtgctgctccccgacaagccaccgccatcagatctggcgagccttgtcagtgccgcgccgggccagatccggtgagtcgcgcagctccagtcggcggtgacctccgcgaggaagacgcagaacagtcggcggcggcgagcgagaagaggggaggccaagtccactgccgccgtcgagcgccaatcccatcaccgccactatccatgttcgctgtcgtcaagttccatatccgccatcaccgaggtgggtaggggagggaggcactgacgtggtcgctgggatatgagaggagaggaatcggttacggaggggatgtgttaggatttttaaaaaggtaatgaggaaagacagggaagatgaaaaagtgtatgttggtggggcccattataattagcttgcactatgggttgagttgctttgtagagttccatccaatatggcatcccaggttcggtttttgtgtggatgcactgtaaacgctcttaattaggggcatgtgcatgctagacacgtatggattagctctacacgttttgcacgaaagcttttgatattttctaaaatagcgaaactcctttcgctacctacatcttattttaaattttgcgaaaagaaaacattatccttaagtgaaatataatgcgaagaagagaaaaaaaaaacagattcagggatattgctgtaattattaaaagtatatgaaaattttacccccccccccccccaaaaaaaaagacccaccacggcaccacaccattgctccacccctcgttccagcggtgttggcttccccggtgtaaggggctctcgcgaggtgttcgcctgagtcggaccgatgcaaacctgctacgccatgcgctcgcctcctcctcttgcctcgagctgccaccgttgcagttctcctcctatagcggcgctagcctgtcctcctctacctcacggacgtccactactagaaaaaggctttttccaggccgccaaatcatattttcgcaggcggacaagtcatccgcttgcacctcaacgcctgtaaaatagttgattttcgcaggcgcgcaatagatccagctacgaaaatagcttcgagcgctaaaaaaaatgggcagcttcccattcgcaatccattccccatccaatccattcatttcatccagttcatccaaaaatcaccaaatcaattcatccagttcatccaaaatcaccgaatcaattttagcaaagaaagcaaataaaaacattcaaaaaatcacgaccgcctcctagccgtcgtccgccgccgcccagccgtcgtccgtcgccgcttctgcatgtctgcgccgtgccgtcgtcccgccgccgccgcacggccgcggcccgccccccctccggccagatctaggagggaggggtggccgggagccaccgtggccgcgccgcctagaccctcctctccgccacccggccgccgccgtgctttccccgcccccctccggccagatctgggagggaggggccgggagcctccggccactgctctccccccgccccctccgaccagatttgggagggaggggtcgggagccgcgccgcctcgaccctcctcaccgctgccgcccttcgccgccaccgcccgccgccgccgccgggagcacacgccgtcaccgtcccgcgcctggctgccggtccgcgcttcgctgccggctgccggcctcccccctgccccctccggccagatctggaggggagggagggggagcccgctggccgccccacaccgtctgccccttccgccggcggggagagtgagggaagaggagaagacttagaaaaatttcagctgcatgtgccacatatatataccacactaattttcgcaggcgccgatttatatttttgtaggtggttatttggctctaagcgtcatgtccgccagcgaaaataagacctccacgtaaaaaaaatgctttttctaccagtgatcgtggcgctgagaaagaccagatggtgtggatccggtctctttggcgcgagggtgtcaatgtatcggtcgacactgtgtgtctcgagagaagggaggggccatagggcttggcggcagttgatccatggggacgacgacaaggtcggaggcgttcactggtggagaaaccctttgcagtcccggttcgtaacccccctttagtcccggtttccaaaccgggagtaccaatccgggactaaagatcgctatctttagtcccgggtgaaataaccgggagtaaagatcgagctgacctttttttttgcatgccccctattgctgcatggtttatatatatatatatatatatatatatatatatatatatataaaccatgcatatatatatgtttcaatacatatatatgcatacatatatatatatgtatatatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgatagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccttgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatggcggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgatgcgccttcagaagatggacgagattgtcctctgtttcttgtggatattggtcgagcattgcgacgtttattttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccaccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaatggtctcttgacttctgatgcaacgtaagcgtcgagctcctcttgcgtgcaatcgtaccccgggtccttgttcttggcggcgtcaactttcgccttcttcgttgcccttgtgtgggtaggcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatacagctcatatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtatgtgtggatgtcctccttgaaaccaatcttccaaggaatcacccctttccctcgagttcgtcctggatgctctggagtctgcagggcgagtgtcagctcgtccctatctctgtctggtcagaacgtgccctgagaggaggcttccactgcatctgttagtcgtcgcgcagcctctcgtatctgatagccgaagaccagtgagccatcagctgggttgagcgttccatcgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgacgctcggagtctgccccttcagtatatacttctgggacagatctccctggaagctctgaaactgttctgccattctcttcagagtccaccttttcactttgtcctctgtacccgcacgaagggtgaatgtctcgagcattgtggtccacagcatctctttctccgaatctgggacaaagctctcatgatctccgtgtgcccttgctcttcgccagtacaccgtactgacaggcacgttatcccgcacaacccaaccgctgtgacgtacatagttcttggtggcttcggctggggcactaggacgtccatcttcttccacttccgttatgatgtgccgaccctcaagcttcttcgctgcacctcgttgcccgcgtgccctcttctgtccaacggagggttgactaccactagcctcctcctcgtggttcccctccacatccctttccacgtgcccctcgtggttcccctccgcattcctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgttaagtcacgagacatttatgttttaacaatctaagtcatgtatgctaagtgtaaatgtcgtacattagaaccctacacacccttacgtgctaagtctaattacaaatcgtgatataagctaagtctaggtgacgtatattatacaaccctagctagtaaataattatatactaagtctaattacaaataaaataatcttatattaa

SEQ ID NO: 4837 - DNA, 1661 bp, Oryza sativa
ctcaaataatattacatgctaagactaaataagtcatgtatatgctaagtgtttcgtgcgtatatgctaagtcacgagacattatattttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttacaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatatatacatatatatatatatatatatatatatatacatatatatatatacatatatatatatatatatatgtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtatatatatatacatatatatatatatatattgcatttcacgttaacgttcgtcctcgttcgttcgctcgttcacgttccctagctcgttcacgttcgttcgctcgttctcattcacgttcgttcgctcgttctcattcacgttcgttcgcttgttctcattcacgttcgttccctcgttctcgcttgtcttcgttcgatcgttctcgttctcgctctcgttcggtcgatcgttctcgttctcgttcacgttgtcgcggcaacgtacgttgacgtgttcattctcgctctcgttcgttcgatcgttctcgttctcgctcgttaacggcggtgtggcggcatc

SEQ ID NO: 4838 - DNA, 1663 bp, Oryza sativa
attatagcactgcatatgattttcgcttacatatgtgtttataaaatagaagttaatgcattaacattatttaaagtacaaagattaatgataattacttggaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaagtaaatgttaaaaactctaattaacatatgaaattgccacttgtgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtactcaactccgacgatttttcttttgcctgggagaaccacttgacgcttaggctcatcaggccctctgcccttctttcctttgctagacatgtccttcacgaaaaagacttacgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagatgttccatcgtgtcccatggcatcgacacgaacaacgctgttttggttcgtgctctccatgtcttgggctctcgtgtagaatgtatacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatccgacttaccgatgttcctggcgcgaactagagccaagtgcttctcgatgtagggagctaccaatgaagagtgttgcagaacagtgaaatgggctttacggaataaaat

SEQ ID NO: 4839 - DNA, 807 bp, Oryza sativa
acaaatcggagggggcaaaaaggttaacaacttcatcccccaatgttttttttgtcatattacatttggagctatgttttgcacaattttttgtctctaaaatttagttgtagttgatgagagagaaaatttgtgtggggaagaaagaatatatagaaatttagtttatttgctaaagaaggttttataaaatagttgagaaggaaaatatagtgaaagttaatcttaaataatagaaaacaagctaaaatgaaaattaaaagaagtacaacacattaatattagtttaaactttagaaatagtaaataagaattatttggtgtaatattttataatttttgtatgaataatgatatgtcattattgtatgactgttgaaagagtttgttattattttataattattgtatgactgtcattattgtacgaataattatttgtgtacgattttttccatctcatgtagatggatcggcaatggatgtacgctgaccggtggtccaaagagtttattgacggcgtgcattattttttgagagtggccgaagctaacaggcataagggttttatttgttgtccatgcaataagtgtaagaatcagaaggagtattctgcatctaggactattcatttccacttgtttgagtcggggttcatgctaagctataactgttggacatcccacggagagtaaggggttgaaatgcaagaagatgaagtggaagtcgacaatattcaggatattggtcagtacgctggatttgaaggaaatcaaacgggcgaggaggaaagggatgctgatggta

SEQ ID NO: 4840 - DNA, 738 bp, Oryza sativa
cagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttatttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcacaagctcctacatttaattaacaagagaactattgtatttatctaacacctggattatctcacctttcatttgatccctatttatagattacgctgcgttgctaacgggccgcacctcct

SEQ ID NO: 4841 - DNA, 628 bp, Oryza sativa
agaaccccagagtccgcacatcctcaaatacaaagcacttccctagttagatgtaggttagacttcccgttcgagaaactttaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctac

SEQ ID NO: 4842 - DNA, 784 bp, Oryza sativa
ttaatataaaaaatagggaacttactttattcaattgttgtacaaaaaacaaagaaagaaaagaaccaatacatgtgttgggatgttcactacctagcacttgcttctgatatagcaatgaaagacatgcattgtggttacataacactgatggtcttatgagagtaggttccagctgctagtagttaaggggacacagttacatttaaaggaatatgggcacgtggaaagagagaatttgaaaattgaggcaggggattgctgaggcacccattctaggaacaattatgtgggtcaatcaagtcggtcagctaatgtaatataatccttctgacatcactttgttcgtcagtttcacaaaaactgcctggtttgactttcctcattctgaagtgaaggcaaccagatcaagcagataaagtcactttgtttttgatgaggacatcaacaccctcggtacatccacatctccacaagtccaacttcatagtcctattacccgtgctcgtgcacgtcaagtcaactatcaggtgagttcattcttgagtccatgttcatcatctttataccccagagacacgtgcactcttgttttactcaggaacaatggagaggatccagaggggagaggattcgcgcaggctggattcggactgcaggacagcaccaacttttgacgatcgccacgacttcatacgaactccgatttggcgtgcaagtacttcatcgaaaacttatcaagtctatttcaaatggatccggcctcatgtcaaagatggtctgg

SEQ ID NO: 4843 - DNA, 10042 bp, Oryza sativa
tcatgctcaaatggtcatttgagatctgtgtgacttgccttgctggccttggaactcttcaaagtcttctcctgcaaaatcggactctccgggaacgtcggaatctaagcagaaaagagcaaaatcaccaaaacagcacataaacaatcatgaacagtacatgtggatatttttaacatgtagatctcaattttagaaaaatttagagacttgaaccaactaaatccgagcttagatgaattagttatgaatttttaaagattaaatcggattaaatcatttatatagattttaattgaattatgacgcaataaagaattatttttgaaaaggaaaaaggatttattgcttcagcggctcgggtttacggtggaccgggtgcacaggaatggtctacggaatggacggctgagatctaatcctatccaaaacggatggccgagatcaacttgatctaccgcggtctacggctgacgtcgacgatgacatcggcgatgacgtcaccaccgggggcggctcggccacgcacgctcgccggcgaacgatggcgcggcggcgcaaacggagggcacctacgggtagcgggcgacgcggcgaactcaccgcaagcacggacggcggcggacggcaaccagacggcgacggcgacgaggttgaagtgacggcggcgttcggttcgacgacgacggcggtgctccggtgatcttcgacggaaacagaggggtggacgaggacggtgacgacttggcgaacctgacggtggccttcccgagcgacgacgacgacctaagcgacggtatgatccttttgcttcaatgccctgaactcacgcttcttcaaagcaacaactcctacaggtatgtgtgtcttcttgaatgcctcagtgaactccgcccaagtgattggttgtccttctgctctgttcacccggaaatgatcccaccattctgatgcaggtccttgcaactgatgtgaagcgaaaacaactttctcctgatccgtgcactggagcagttccaacttcttctcaatagtgtgcaaccaatcacctgcttccactgggttagtagtactagaaaaggtaggtggcctcacacgaagaaaatcagctagcttgttctgcggcggtggagcattgttgtttccttggttgagctggttctgcatctgctgtatcatcatgttcattaattgagtctgttgagccagaacttgagcaagagttgggttatcttcattgttattatttccacttccactggtgcgagtgttcaccatctgttgcatattagagaagatagaaggagaggggttacactaaagacaagaccttaaccaggttaacactgatctgatgtgtgtagaccattatattgttcaggttgattaagcaagcaacctagtacagttacacactcatcaatgaactactccaatgatgggaatgcaaccatacctacacacaaagcaaacaaacgttctaccctactaactattcttcaaagacactttggcggcataggtttctaaggtaggatccaaacttcattccatcttgaccacttggcacttcggtccttcctcgatccacttgactgacctccataagtagacctcattggcgtcttcaagtttcaacaactagtttcagaactactcaagttgaaagcaggaggggagaggatgataaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcatgaaatcctcgtccaggaatcagccgaggtacacaaattgacaatttaatatacagattcatcaaattaactaaaacgataaatacttacttaagaggcactaagtcctcaccaagaagaaaactgcagcggaaaataaaatctagcgaagctccggctacactcccacaggcagctcaactggggtataagccaaacgtcttctccttctggatcctttttcttcaactgaggttgattgattattgcaaggtgagcatatgacatactcagcaagccacacaacaaatatgcaagtgcacaaggataccaaaggatggcataatataggctcatttgcaaaagcagcatttagcaaaacatttaagaggaataaaatagtggagtagttaatcagaaattttaatcaacactgaacagcacacccatgctgcacaggcccaaccatcctgaacaaccatacccggctgtacagatcaaatctccaaaccaggagctaagcaaattattaccagtataacatcattaattattgtgagaggtgtgagactaatcacgaaaaacattgctcaactcgcccataaccgcgggcacgactattcgaatagttttactctggccagaggtgtaccactgtatccacaagacacagcctcaacatcatgtctaccatgcgtcgcgatactggaaagtacccgaatagaagctgtgacaataccctctgcacaacacaactcacgacagtgcaccattcctggatcataatcacccccttataaaacaaggcatggactccccagcgacccctgtgggcttatctccgccacttctcagtctggtgctccgcaatgaatcatgctatacaaaaggtaaagctgttgcccacgctggcttgtggttggcacgattaatgtttcacaatagtagctcgcgaaccggtccttaattgtcatgagcacgactctcaaaaccatgtactcacaacccaccattatcaagttttagttggcaagtaattaattaaccaatcacgattgaccatcgtgaactatcattaagccatcataataatgagtcataagttatcccaatagtgtgctaatgtttctaagcatggctaagcaatcatatctaatatctagctgaactaatatatatagctcaactagttaagttataatatcccaaggtatcaaggaatagagtaatcaatgcaaacaggccataacaaaggaatagattcacaccacccaatgacattcgaaaataaatacacagttgaaataaatagagaatttaaatataggatcaacatgctcaaaggattgtgtttaggatctgtgtgacttgccttgcaataatcggtcttcaattaatcttcttgaatacttccggcgcactcgcgaacctttgcaatgacggaaacgacaagctaacacgcaaaacgaagaaaaagactaataaaaaccaaataaacaatacatataaagtaaacaaacatgtagattataattttagatgaattatgagacttgaacggcctcattctgacttcaaatgaatttattatgaattttacaagattaaatctatttaaagcccatttaaaaagaattaaataaatttaattcaatttatggaaaattttaatatgtagatctttattttacacaatttttgcaacttgaaccacattaaactgagttcaaatgaattagttatgaatttttaaagattaaatcggattaaaacacttatatggattttaattgaattatgacgcaataatgaattatttttgaaaaggaaaaagggtttattgcgtcagcgctagggtttgcggtggaccgggcgcacggcaacggtccacgggaacggacggccgagatcaaccctatccaaaacggacggccgagatcgatcctatccaaaacggatggccgagatcgaacggtccacgacgggtctacggcagacggccacgatgacgtcagcgacaacgtcagcgatgacgtcagcaccggcggcgactcgggcggctcgggcgcgcatgctcgccggcgaacgacggcgcggcgacgcgaacggagggcaccaacgggtagagggcgacgcggcgaactcaccggtgaccaaagaagcggcggaggaacaacggacagcgccggcgacaaggaagaagcggcggcggagatcgggtcgacggtggtgacggtgctccggcggtcttcggcagcggcgaaggggcggacgaggacggcgacgcgacggcgaccacgatggtgacctccccgagcgacgacgacgactggagtgacggcggcacacggctggagcggcggcgacaacggcggcacgaggcggcacggcgctagggcgctacaagcgacgagaggcgaaggcgagggtggcggcggttagaggagagctcgggggtccttttaaaggggctagcgagcggcggcggaggcccacggcgaccggcggcgagaaggaaagattaaggttagaggagagagatcgatccgaatcaaactcgaatccacggatttccaaaccgaattagctcatgattccataagagaaaagatagaggagatctcaaggatcatttgccctcaatcaatttcacccgatcgggaaagacgcggccgaatttggaaggagacggcggcacggctcggctagggttcgggcggcggcggcggcgcgaggaaaacgaacctgacaggtgggacccacctgtcagcggccgagagagaggaggaaggggcgcggcggactaggccgactgggccggggagggagagagaaagagagaggttttgggccgactttcggcccaaagccaaaaggaggatttaaaaacatttttctatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttagacttttaaaatcatttctaataattccttttaaacaacaatttataatttaaggatttttaaacaagaaaaactcttaacaattataattagatcattatttatcaaataattactgaactgttctttgtatcatttaggaattgagctccgaaagatccgagaatatttcagagagtgtaattaaccatggagaatttaataaaaaaattaaatccattcatgctttatatttaggaaattttatttcccacatttaacttcacttgtaaattaaagatcatttaatataaattctattattagtttattaaataatttataaatcctgaaacaaaaatcaggatgtgacagaggcccacggcggccggcggcgagaaggaaagattagggttagagggagaaaattgaatccgaatcgagctcgaatccgacgatttccaaacgaaattagcgagagattccaaaagacaaaaggaagaggggatcccggggatcatttcccctctattaatttgatcggatcgggaaaggggcgggcgaatttggaaggggcggcggcggctagggctcggctgcggcggcgcgaggaggaagacgactctgacaggtgggccccacctgtccgcaggagggagagggggagagcggcggctcggctcggcgggctggatgggcctggcgctagcaggccggggtgagagagaggggttttgggccgactttcggcccaaagccaaaagaggatttttaaaacctttttcaatttaaattattcgtgaaatgcaattctatttattaaaaatacttccttggctcaaataaatcctagaaaaatctaggaactatagaatcaaatgaagtatttaataaaattttatctagcccactttcatattggaatttattatttaaaattagatcttttcttctaggcttttaaaatcatttctaataattccaattaaacaacaatttataaatttggggtttttagggtgtgacatgtatcctttctgaagcaaatcatctacttgcctcttgacctctgctagttcattggctgccattctataaggtctcttatggatcggagtttttcttggtaccagatctattctgaattctatatctctcttgggcggcataccaggtaaatcatccgggaacacatccgggtagtcctgtactatgggaatctcttccaaacttacttggttcagacttgaccttaaaggctcagaaggcaatgcgtaaacagttacaacttgaccgtcattgctggtgagagttacttttctattggcacagtctatcacacctttatatcgggctaaccagtccatccctaggatgacatcaaggtctttggattctaatagaataaggttggccagaaatggtactccttgaatctctattctgacggaggggctacgttgtgacgagagtgcttggttgctgggggtactaaccatcaacggacgtctaagatcttctacctccatcccgtgatttctcgcaaaactcatagacaaaaatgaatgtgtagcaccagaatcgaaaagcactgttgcaggaactgagttaacaaggaacgtacccaaaatcacatctggagcaccttgggcttctgcagcagcaacatgattgacacgagccttggacactggtgcggtggagttgttctgtgcagggacaaccttcacgcgccggggcttcggacacttgtcagaataatgacctggttccccacagttgaagcacactcttggcttgtttcccggctccctcttggcaggctgatgctgggctagagttgcaacaggacgtggagcttggttgcggttgttgttgccagaattgttgttgaagaactgacgctgtggacgggcaaccaacgaagatcctccctgtgacactgcctgaggtcccatagcaagacacggcctctgactattcccctgctgagctttgaagtgagcaatcctgcgtttcttctgctccattcggttgtacttgtcctcctggcgaatggccatatccaccaacttctggaaatcatgataatccccagtcattaatgggtaagagagctcatcattcagtccttccaagaacttctcttgacgctcttcatctgtacgtacatcttctggagcatagcgagctagacgattaaattcatgcaagtattcagtgacagagcgagatccctgagtgagcgtcctgaactccttcttcttgggagacaccactcccgacggtatgtgagttttccgcaaagcagcagtgaactcaagccaagtgattggttccgcagtggtcctgttgagacggaagtgatcccaccactcagaggcagggccatgaagctgatgtgaagcgaaggagactttttcttgattagtgcactgaagcaggtccaatttcttttctatggcgtgcagccaatcactagcctcaactggattggtagtgctagaaaaagtgggcggcctcacacgaagaaattctgctaacttgttctggggaggtgcatggttgttcccctggttctgctggttctggaattgctgcatcatcatgttcatgagctgtgcctgttggaccaggacttgggcaagcgtgggattctctccattgttgttgttgttgttgttgttgttgtttgggccattcccattgctgtgagtaagcaccatttggcataggcaggagcacaagaagagaaacaaggaggaaaaaactacttaggacagggaattgatttttattaacttgacttttattgatcttaactgagtttcattattacacaaaactgaagactctcacacaacttaacttaaactccctaacactcgaaagcaaacaaacgcatgcatttacatcccaacaatgatgtaaaccacatgcaagacccacacacgcaaccaaacttaaacaagcaaactaacacaatgatctagggcaacgacttaacaaggcgttctagatcttccgggcatcggaattgattgaaggctcgttcggcttgcccccatcatcttgagtagctccccactcgacctttgaatgggtgcgcttcgattcttctccatcatcatcacttacgttaacgaccgaaggattcgctgagactgggacaacttcttcttcttccaccacacgaaccttaggcgccaactggtagcgagggacaaatagagctctcttccttgtggtaagacgaaccctggccttttgtggtggtgcttctcccttcaacgcggctagttccttctccaaacgatcaactttgtcctcaagcttacatatcttaccacgattccggtcttcacgatcttgagcagctaacacaatctcagcgcggaactcatccatggcccacagcatctcaaccaaatgccttgtggtagcatcattctcaattcctgcaggttcaaggtagctgccacggtcacttccctggggttggcgaggatggtagcgatactcagtgtcggccaactgatcactgtagcaatcgcgaagctctcctatggcgatccttgccacctcctgacaagcatgaatgtagtttccccctccagcctcgaacatcagcgatgggatgtcttcatgattagtgttcaaggtgaccttgacacggcacttctcttcatcacggtcatgaggaatctgggcatacaaaggggcagtcccaaatcctatggcgaaggacatcgtacgcaactcctggacaaatccctcagtaccgaacaagtactcaggcttgaagcgcggcatctaaagacaagtgaaaggagggagttaagacatttatccaattaatagcacaagtttttggattaatttgaataaagttagaaaatcaaagtaaaaggtaaataaataaagtaaaccaatcttgcaagataagttgaaacagttgaaaacagaatcacaaattttgcacttttgaataacaggtttcaaaagaaataaaataaaagagagttataaaatcaacatgctaaattatattgcaacatgattgaataaataaataaataaatgaaaggttgtaaaatctctgctagaaagtgggccattagtatagtaatagatgtacagtactaacaacacaggaataataaataaattttgaatgagaacaattaaagggactataaactgcatgtgccattagcttggtttaattaaaagagaaagagaggagaacagttctactttttcaatctttttagagggcttctataggtatccatttggcataacctagggtcaatgtggctctgataccaacttatgacgcccggaatttctatccaaaattccaaacgcttacatgtgtgtaaaccctcgtccaggaatcagccgaggcacacaataacaaattgataatagagtgcaataattactctaataaataagcgaatagaaagtcattacagaggtagatagttcctctcaaacaataaaattaggaaaataagataaacggcgcaggcgactccattccacaagcagcttgaccagggctacgcctaatcctccacaccttcagcatcactgtagaactcctatgatgaatgattgcaaggtgagtatatgacatactcaacaagccacgcagcaaatatgcaaatgcaaggcataacaaaggatggtataatatagtctcatttgcataaatggcatttaataaatacttcagaatttaataaaacagtaaagtatttaattaaacaatattaatccatcgctatacaacatacccgttgcataggcccaaccatcctgaacaaccattcccggctgcacagttctatctccaaaccaggaatataccattccaaaccaggagctaaacaagttattaccaattacagcatcatttattacggtgagaggtatgagactaatcacaaaagacattgttagacccgcccaaaaccgcgggcacggctattcgaatagttttactctggccagaggtgtaccactgtacccacaagacacaacctcaacatcatgtcaaccatgcgtcgcgatacttaacaagtacccgaatagagatggtgacaataccctctgcataacacaattcaaagcagtgcaccgt

SEQ ID NO: 4844 - DNA, 316 bp, Oryza sativa
ataatttcccctcgggggcaagttttgagtttgcctatacaattaagccctatgcaacaaacaatcaggctgaatatgaagcggttctcaaggggttgcagttgcttaaggaagttgaagccgatgcagtcgaaattatgggtgattccttgttggtgatcagtcaattggtaggagaatatgaatgcaaaaatggtacgttgatggtatacaatgagaggtgccgggagttgatggatggatttcggctggtaactttaaagcatgtatctcgggagcaaaatgttgaagctaatgatttgggggatgctataca

SEQ ID NO: 4845 - DNA, 84356 bp, Oryza sativa
  unsure (1)..(84356): unsure at all n locations
aatctgttctggagaggctgcaatcgccgttttactagacctttttctgccaacggtgttgcgtcaacttatttgggcccaatgggttgtgtatcaagttgagtccgttaggggcaggtcttagggttagaggacgaccccatagatcaatttgggttttgtttagatcaaagtagcgaaccgtgtaatcccatgatcggttagatcgccggtttgctcggtacggaaccccacctatgatacttctgttgattcaatcctacatctttagttcgcaaattgagttgcttgttcatcttgttcttgctagttctcgagtgcttgcaggaacaaatacccttgtggttaggctgactatgcaattcacgactgcctttggagttggtgtaacgattgctaaggagcaacatccctggatagttgtagtcagatcgccaacgtcactcaatccaatcgacttatcctctcatcgaaagatcgggacaccctcgtgcacatcagcttttcaatttaatatgtaacagtctagtttcttatagcacgagttatggagacgatgcaatttgaagatttctctgacaaaattgacaaaagtataaaaatactttataaacaaaaatgtctccatgtggatatttggtattaccgggaaatttaaatttatgtgccaattctttggactagttttgtattcctggaacttcatgaaaaccagaaattgcgatatactcatttcatcgtaattctgctgtgttttgcctatttaattaaaaatcttgcagaaaagttgtggccttgttggaactcaacatttatgaagtaatgaaatcaacacgaagtcagataagtcatgtttccgctgcaatcccagacactgttctccgtctagcttttattccaaaatcacatataactaatcaggctaatcaagatagttttgttttttctaccaaagaagacacctttccccacctctgaaaggcttttatgtataacttattgttattgttattgttattgttttcacacacaacaaaactattgttctttagaaaaatatgcttactcaagaatatcataaaacatcgcaggatatcacattattggatgaggtaaacatttccttctgtatttgagaactattttcacctatagttatacatgaaaaaataaatttatgaatgttgagacttgtttaaatggtagacctagtcatactgagataaattgttgacttgtgtcttcagagcattaagttgggaatcaaatatttgtacggggttcactggacaaagacttgtactcaatagtcgaaaaactataaaatctggaaataaatgcttactgtatgacattttgcttttgtagtttggggttgatgttttctcgcaacagtacttgcaaatataggatttcgcagaaccacattgagtggaacaccagagacctgaaaataatcattctttttaacaggcagaaagattgatgtgcacctcagcaaatagcacatgagaagatccccgatctgaaacacaaacaagtatcttatcaaataaaaaaagattgcaagccataatcatcagagaaaaggatttttgttaaacttactctgtgcaaaagaatactccaagatgaagaagaaacaagatcactgatacatatagactggccaccctaataacaataacaacctaatattattaatgggaagtataaaataatatctgtgtatatcaaagtagccaacatgtcactcgaccaatcatataagaagttatcaggtcgtaatgattcgaagtagtaaaatcaatagtatgtgcgaagaagcaaactaaagagatataattgcatcacagcttccttgacacatccaaggccagtttgtacaagtttacataagtccgtatggctaacctaatattgttcagagctatatgatgagtggttatcaacgattataagcctgtaattcactttttggtcctttttgaaaacttactttacaaatagaccccagaaaaatttattccgggaatggacctttcttgtggggctaacgtcattggtgttatggtccaacatgagggcgccaatgacattggcaccgtacccctagcctccccgtggaagctaagccacttatgtgaagggggataggcgccaatgtcattggcaccgaagaccaagtattcacaaaaccctacgtccttacctttattcaatattagctaactttagcacatcttaaacgacattgttaatagccccaacagaatccaaacatcctatttttccaaatagttgtcgttgagccaaataaatggtagtttatcagtatttcaatggaataattggtttatttcaatgcttactggctagttactaactaccacatctaatgatctgattctataaatggctggttcaggtaataaaattggtagtttaagtgtgaactttgtttattatctcatcatttttcactcattgccagaaatgaccccttttgaccaacaagattgaacatgctcgtagagatgcctcacaccaccaacaccaaggagacaaggatatccaacaaattaagttaggataattttacagtgttttaactgaaaattattctttcactagtaacaaccataccatgtatactggcatggcagcacttcaacgggatctcagtctgcgggaatcccagtaacccattttgtatgaaaagggccaccaccacaggtagaatgacggataatggatgcaataagaagtgtcaactcatggtatacactttttaactttacctcgtgcaaaccattgcagaggacgttcttggttccatgagactgatccgcaacgatcgacttcatcatctcccgaacgagctgtgagtcaaacaccatgcaggcaaaaaaaaagggcagcctcagataaccaatagaagacgagaaatgtacacaccctaagcagcacataagtaaggcaagatcgagagtaggagagcagcaggacaaaccctgggcctgcgaatgcccggagttgcccggagtgtaccggggcggcgggggcgcggacagatcgtcggccgcaatggcgcagacggctcgtgtgatgaggcggcgataagcgacggggtccccgtcacggaggaggtgctcccagcggcggcacgcgaggcaccccgaggccactcttccccggcacgcaggacagggggactcacaatgtcgaggcgagggcaggagggagaaaaccgcgcggccgagcgtgagcgcgcgggcgccataagccaggcgtagctctgggggaacttggccgccgggtgccgcacgccgccgccgccgccgccgtggcatcgcgacaggaaagtgaggggggtggaggatgaggcggcagcggagaggcccggtaggggaaagggggatcaggggcttttgaccgtttgaggcgggattttgaagcggcgcctgaaacttttattttctcgttttcttctcccttttggcctttcccttccaccagctatcgtgcacctgtaatgtgtgtttcccaaattatatgtcacagcaataatataaacaaactcaaatattagtattaagttttccacaatgtgagcacattatatccaatatgatataatcttatttttactagaagggagagcgcggcgtgcgcagccacgaaaacaaacataatttacgtagaaaatttcattgaacacaaattagctaacattgattaaatgttcttcatttcatttaacctaaaaatacaatatcaaaacgtggtatgtatataattacagtgtgtaaagtatatgcttccttcattttctcaaaatgacgtccttatacaataagaaacgtgttttaatatttgacgtccaaatacaacttaaaaaccctttgacgtccgaattcgtgaggctatataaggcgcagcgatatgatatcgaacgaagtccggttgtcagtatcctgattcgtattctagtatcttatgatactacgatcctaccaagccgaaacgataccgatcccacctagtatcctaattttcatagtatctcgatcctactattcattactacacgatcctacgaaatcttaagtggtatcccgattctacgatccctacgttactacaaaatattatttaaaataagatggtttggaaataatgtaaatgaatatgctcaagtatatatagaaatcagttaaatatatcaaaaccaacgtggtttctcatgataaatgtctatatttgcataatatatatgtaattaatatgaatattaattaaacttaaaaaaagaaaatctcatagtattccaatattacgatacgataatacttggagcaaaacattactacctaatatcccgatccagacaaccttgcgaaggacacagtgctgcagacgcacgcagagctgttcctctgtcagcgccggcggcataagcaaccaggcaacggcagcgagcagcaacgattggtgacaggcacaagcacttgtacagtgcgtataaaccatacgagcacaggtagaaatgagtttctctgaaaatacctcaaagtgaatcagcagtagcagcacacgtcgtcgtcggggtgacctggatggacggtcgatggcgaggtggtggtgccctggacgggcggccggcggcgctgcccctggacggacggctggcaggccggcggtcccccggataggcggccggcggagccctggacggacggccggcagagccctggacggacgggcgctcgggacagagctggcgctaggagccccaaaaccctagcctggcggcgtggcggcgtgggcgctgttgtttctcgcgaaaaagaaaacggcgagaggagaaaggcgcgagaagggaaaggaagcgggcggaaaaaaaatttctcgaaaaaaaacggcgcgacgaggaaaaggaagcggacggaaaaaaaacttttggcgccgacagtaaaacaattggcgtgattcctgcgattaggacggcgttctgcttcccaaatttcccaaattctgatgagattggtatcgattttataggaggggataaaatttagaaccgtgattaacagacctagttttaaccaaaatcccaaaaattaatttttaggaacctgtttagccctttcttcgaaatgctcttacatcatcagtgctgccacttgcgccgctctccacgttagggtcaccagctcgccgcaccgttcatccatggctttctgcctcctccacctccattgcacctcctaactccctgcaccctgccgccgtcgcggagacaatggtggccgaccacgcggctggtgatgggtgacagcggcggcggctgagacagctacggatgtggcctgagacagccgcggcagcgcccgtggtggcagcggcggtggctaatgtaacgctccgattttcgttcgggattaaaaatcaattaataaatcattttctacaaattaaataaaagttaaagcaatttaatcaagtgaattattgaggaaattaaaagtttcctttaaaaatcattggccagaaatattttataatattctctatgccctaatatactctcttgatttttctgtgaatttttggagctcaacatctaattttaacatcacaaagttcatttaatcaattaaattaattgaaaaaccaatttaagatctcctccttcctttgagcctcctttcgaccctccccctccccctctcatgccagcctccccctccctcccctcctttcccggcccagctcaccgctcggccctctcccccctcccctaaagtctatttggcctctctcccgacctcctttgtccctccctcgccaacaggagggctcagcgactccacctgtcaactcctcctccttcctccagtcgcccagcttcagtcgccatggccgcccacatcaccgaaattccaagcatcatcccgctccccgcccgcatctaaccgcgcgcacgtggtcctcctccaccttgcgcccacttcccccaccccttcccgcgaaatccggccgccatttcctccacgtcggcgccccacctcctaccggttgccaccccgaatccgcctctctcggccacaatcccggccgccgagcgctataaaacgcatcccggccatcctctcttgtttcccctcctcgccgttccccacgctctcccgttcttcccacgccggcctgagctccgccgcccaccggcgtcctccaaccacgagccaccgcggctcctgtcgttgccgtgctacgccaccgccaccaccggcttccagtggcgggaccaaagagtagtctaggtaggcccaggactaccctataatttggcccagataagaacaggtatttatttttcttggcccataagaaagcctggcccaacaaaagaaaactctaactctcttatctcccctctccacttactctcctggcctcccactcccgacaggccacggcgctcccgcgagcccgtgaatccggtggccggcgctcccgcgaggccgcgactcacagcgccgctcctcctactgccttttcgtgccgcgtcggagcccgtgcggccgcgccctctccgcccctcgccggcgcgccccgcctggccacactctctctgtcccgcgtcggcgcgaccagccggcggcctcctggctcccgcggtcctgcccgacgtgcgtcggtggcagcacgcgcccagccggcagccgcccaagagcccagcgctagtgctctaccggccactccttcttcggctctccaccagtccgcctctccagtgagcaattcctcacttcctcagtccctcagtccctctcccccttctagaatctagagttctagtagtagtagaccactactagcatactacccccttcatatgacatttttgcatggttgggaaggtttcttaggaaaggttacatcattttgcatcaaatattccattgatattcccgcaatggatgctaaatatatgcctcatggaagatcccaccgtttttacctggaacaaacaattgatgaccactataggagagaagtgtacattggtgtcatcgatagaattcgtcaagagcttgagaatcggtttgatgaagttagtatggagttgcttctttatatgtcagcatttaatccgtccgattcatttgcctcatttgataaaaaaaatagttagacttacaagcttttatcctaaaagttaaacttatttgttattttctaattgtatcgaaccatttagagttatatacgtatcgtttaccatattttatatcgaatcatattgtattgtatttggattttctttggctaggcctaccctgggttcaaatcctgggtcctccactgccggcttcgccgctgcgagatcaagcccggccaccgctccgtttttccccaccaccaccgaaacatcgctcccaccgcgcaaccaacttccgcctctttccggcgagctccagccactcaccaccgttgccctagccacctctgctctaggccgccaccgccatcgccgtgccgaactccaccccgtccaccgctccattttccccaaaagccaccgaaacgccgctcccaccgcgaggctaagccatcactgtttctactgcctccagccgctccccgccggcgagcatcgcctcgctcggccacgctactgcctccacagcgttcgcagcgccccaccacaccccggcctccgttcatcgccgccggaactccaccaaaataccacttctagcgtgcacccgagccctcaccgccatttccctgtcactagccgccaattcccgctacttccgcgggccttcgtcgcgacgcgccaccaccctatcggctccgccgcccctctctgaacctcagccgctccaccgccttcgttggtcatcgctgaggcgccgccgcgtcatcttcctgagaaggcctcaccgctgcccgttgcccccttgccgccatggcgctcggtgagcactccccctctctttttcctccttcccccttcgttgcccacctcccgtgccatgcaccgccgctacttgcgtcgccggccatcgccgttggttgccgcgccgccacgcgccgtggctcggccgggccggctttgtgccgtgcccgtgtcctgtcgcgccgcccgtgcccgttggatcggcttcaggccaatctaggccgtcggtcctatggtccaggtccacggtgccgcccccgccgcggtgaaccgagtccaccgtgtgcctccccttatgccactgacatgcggggcccgcctgttggcgcgcctctccccttaatgatgtcagcgacagcccttttcttatgagaaattaattaataattgtgcaataaatcgtatttaattctagaaattgatttaaatggctcaaaacttctaaaattcatatctaattcatacgaactccatattggtccattcaacttgtaaaattcatctaaaattgagctctacatgtttgtttactttttatgtactatttacttggtttttattagagtttttcctcattttgcgtgccagcgtgtagactccgtcgttccggaagttcgcggtcgcgagggaaagagttcagaagatccaagtgaagaagcaaggaatgtcacacattccccttaagcatattgagcctaatttataaatattttactgtttgcaaataaatatgcatgttttgctaattacatgggatcaggtataacctatttgctcgcttttgccatgtttacttgttacccgtcctttgtcaaccttaggtgataaattatctagctcgtgatacttatgttgatctagctaaaatcatatatgcttagccatgcttaattaccactagctcacataatgggataattacattattagacctatagtaccttgacgagttgcgtgctcgagacatccgaacatgtttcattggtcgtaattatccaactaaaatgcgaccaaatggtgggctgtgggtgcatggttttgctagttgcacccatggcaattaaggaccggttcacaagaaaccctggaagacttactgtgcttaccacaagctggaatgagtaactacttgatctatattatagctcgacaatttcctaggcaccggtggcgaggctgggcgtaatggagttgggtcggccgggtgttcgtttgtccagctgctgaattcaccacggcgcacgaggggactgcccacctccggggtagggggtgggggtgaaactttagcgtggtgtggatggttaggggagagttatgcgaagggtcttatcacaatcactcgatatggtgacatgctcatcatgggcacatgatgacgcggtgacatgccgatggattgtgtcttgtgtgtacagttgtgcacctctggccagagtaaaactattcgaatagccgtgcccgcggttttgggcgattgaccaaattcaccgtgattagtcccatccttaataattggttaatgaaccggtgtagttcaggtggtttggttgggcctgttcaatgtggtgtagcattgatcagtggagatttaatattaccttaattaatcaactattttactattttgctcaataaaatgatttacaaccgcctttatgcaaacaaccgcaaacctccctttgtctccttttgcacgtctgcatcattggtgtggcttgctgagtacgatggttgtactcagcttgctatttccccatttttcagaactatagtgcttctgagctgaagacgaagttagaggaccaaggctcagaccccagttgagttctgcctatggagtggagctgaagccctgctaggatcgcctttttccattgctgctgcttttgtttcgatgtgaggactaagtgcctcttctataagtattttacgctttatttacgcttggatctatatattaatttgtcgtttatgtacccttgttggtcctggatagggatttaatacataaaatagtctggaaatttgggctaaattttttgtcgtgacagctgacggcacggaggcaacggcgcgaagacagcaactggacggcggcggcagcagtggctggccgacgtgcagcgactgttggctgctgtggcaacgggggcactagcggcgggagaggtcgtcgtggtggtgatagcaggcgcagagctcgtggtgacggtggcgttagcggctggccggcgacagcaggtggttggaatacggcagcagcggctgctgtggcgactgtggctgcagtgggaggaggcatggtggtctctgtcatgcccagggattcgacaacccgaatcaccggctatctgtgcatttaacctctgtccaggcatcaaccagagtacatagatgacaatttgatacagttccacgtcttacaaaaataacaagataaaactcatatgcggcggaaaaactagagaactaaacttaatcttctcagcaaagcgaagcttcctccaaaactccacaggcaaactcttgacggctggcacaagcctaatcttcatagaactcaccatttgaaccaacttctacttctgggggattggaaaaaataaagcaagactgagtacaaccactgtactcaacaagtcataccaaggggaaggtatgatgcaaggataattaaaggattggctcataggatatttttgcagtaaaagcaacatttgtaaatcataagttgaaagcagtaaaacagtagataattaagtagtattaacatcatcactgtccaacgctaaaccacgttgcgacaggcccagcaaaaatcacggtgagctggttgaccgcccaataactgcgggcacggctattcgaatagttttactctgatcagaggtgtacaactttaaccacaagacacgattctacacatgaaaccatacccgaagtaccaccatgatactgcaaagggggaaatcatgacaaaaccctccatataaccaccctaactagcacacccaccttcggtttcacccccaccccaaaatccaggggcgggcaaccccgctcatgcctaggtaaattcggaagcagcatagaccaaaatccaggtccatccaaactccatcacgcctacccttgtgttgatgcgaaaaacacacactggcctgagagatctgcttagctttagtacaggtccaaaggttgatgagatgcgggcatgccagtcagtttgaccctgcaactgacaagatatgtaaacaacggatcaaatagccgatcagctaacaagccgatagattaattccggccgatgccgatactagccgattgggatagggttttgagctatcggctataattctgatgtagattctaacgcttgatataaataacaatataaaggcaatcgactgttgataatataatataacaataatatagtccagtagaaaccaatcggctaacaatgatatgatagaacatgtaaagatccgaaggttaaagcatacatcggctgaaggtccgatgtcgtaaaatccaaacgattagataaacagtgaaagttttgctgcaattggataagccaacttgtatgtaatccttgtaagccgatgcaacgtccagataatttatcggctagcaccccgataaaacattagcatgaatctgtcagcttaacaaggtttatattatcaacaacaatctagtaggtcgaaactaaccgatgcagcacgagattggatatgataatctaatcctcgataagctgatagatctgtctaatgtgatggatataacaaatctattgatgaggggatgtcaggtcccgatcttccgaaaggttctgataaacaatgatttgggcggagttgcgacacaactcgatccagcttctgaacaaacacgctactgagccctgcaatcacagcaccacgtctcctctagttatcaaccatgccgaaacccggttgacctcgccgagaaggctaatccttgcatgcgaatcgaagaacacaatcaataacaagatagattgcaacacaattgcatatgaatgattaagcgctcgaatttggggttccacaaaccgatctagcggcaaaactgttcttgactgaataatctaagcaaaacctgactctaaacgatgacggctactgaataaatgtgattagggacgtcctagggttggcctagggcgcacacccgcttgggctaagcccacgacataattacaaggcccaaaacccaaatcagattcggactggatgagatacgtggcttgttttgcaaattctcgacagctcggtaggaattttgacgtgggaccaaatccatatgaaagtagactccataagctttccaacaagtactcatgggccccgaaattccttctagattagcggctagatccgtttgaagttgatgctgtcaggaggcccgaatccgaattcaaaacatgtagaactttatctcttgtcttctatggaccaaaagtgacatgttaagatggaagtggacttgaagaaggtcttggtttggtcccaatcaacttctttgatcatccatgaattcgttacgctcagtctcttttccttcgcccaagcgagtacctctgcaaacaaaaacacatgaaactcattgtgtagcaacgtttgttcaaatatataacaagtaaatctaatataaaacatatgcacctttagttgattaatacataaggtagtcatggttatatccgagctagttgtgtctttatatcggctaagacaaaagatcataccttaccgagacagtcctaactaaaccgatgtgtctctaaacacaatgcaattagggatagaattgagatatcaggtaagaaaatatatcaaccaaactagagcgatccaagagatcgaaagcaatgcagccttgaacaacaccaatttagccaatagattcactagggcggcggaacgtaggacttaccccttcgctggagatcgaactgacccgatgcagccccgcgtcaggtgccaaattccgccggttgataagtaaaaacctcaggagagaggatggcgatgcgccgagagtagtattgatcgagagataaattaccatgaccccgggtgtacatatttatacccatggggagatactagtccttgtaggacaagaaagaaactttcctaaagataaaaggaaaacataaagtccttataggacactaaacacactttcctaaagataaaaggaaactaacaaactatttctaattaatagataacttgccatgccgcatcctccttgaactcggtcatttctggatatgcatccttttattcgattaatttccttaaccgaatatagcaagaatttgactattggtaatgtgataattctcttaggggcttaccaaatttcattgttaacaccttgccaacggtgtgtcagctagaaaagattatacttaagattcagcctagagcccatctggcttgtggttagtatgagtatatcttccagagattctcgagaactggtccttaattgtcatgggcacgaccaccaaatgaaatcatgcatgtacccacaacccaccaagtaaatcatatttcaattaattaaccatatgccaagatgacatagcatcatcatgaaattaaggactttaaatatagtgaatccatcatacaaaaaacatgtatttagttatgatttagcagtactatttaaaatacatagtagcttagaactccaagaagcataaattcaaatggatatgaaaatgctattacttcatttctttgtatgcacatctcttgctttttcctaaaaaaagaaagaggtatgtccatatcataacttgaacaaataataccatacaaataaggactatagcatgcaactccaactaattcttgtttacacctaaatttggtacctaggattgaaatagggaaattgccaaagttcggaagttttgcccgttttcctctgagaaggccggtcagaccgccgtgtgttggccggtcagaccgacggtgtgtggccggtctgaccggcaaagttctagcccgagtctgttttgtcgggtctcgagatttccttgcttgggaaggcatgtttcgggtttcctttggtttttatcccgagttggacgtggaggagggcctgtagagggcaagaccaacccctatataagggacaaggccggttcaattgtaaagacaatcatacaatcaatcaatagaatcgttttttcatattgcttctagttctagtttagtttgtccatctttgtcgatttgtgctgtaaattgtccgccactgctacgagagtgcgacacctctttgtaggtttgtcctgaaaaccttccgttttgcccacgagacgggtaattatctaccgttccatctagatcggctccacaagccggtttagtttatcaaaactcatcttgatttagcgcttggtagattagggtggttggcaaatttaggatcaccgtaaagctttaggtgctgcaatcgtgcttgccaacttgtcacaaaaagttgccaacaatcctttcctgatttatgtcattgcgtggtacatcattagtttctttgaaacatcctaccgacgactttactacttcagaaatacatcagctcaatagtaagcagttagccatcatatctccatctgagtaagtatatttctacattccttcataaagggaagaagttagatgccactgtgactaatcatacatattttatggaacgaaaaggaataatcgagaagaagagcacattaaccttattctagctacatgcaactgatattgtgttgttttgcaatgtgctacaaacaaaagattaagggattaagggatcatttatatatcattgagcaacattttagaaaataaaaatctaccttgtagtaacaatatattctcttccctggcccaaaaggtgacttcactgataactttgttaccatcaggatcagactagaagtattccttagtgattctattatatagaaggctccatgctgcatgcatattgatagtatagaaatttatggtaacttagcagagctattttaaaatagcacacacgaatatggtgcactgtattattttcgatattaaaatggaaatagtctaattaagacattgagaacatttcgacagaaaggtccaaatagccatgaaagtgctagaagaaaaaaaaagagaaaaaggtaattcacgaatccacctccccattcttttaatcatgtcataagagcatgattacagctgatttggttcaattccaaacgaccgctacttcaaaataacatccattactaaatgccgcaaagatcacacaacaaaaaatttcattctccaatagcaataatagtagtgtgattggaaatagtagtagtgtgattggagtagtgttggtatttcttaacgacattactagaaatataatttccagcaatggcgtagaaacactcatggtatattatggggctaaatacggaggagtaccttccccaggaaagtaacctaggactatatacacgcgcgatggaatacccgtactgagctgtcagcatcagcagcccacctcgacgtattcgcagcatataacccaaaataatgatatccagtaatctaaacactacgcttaaattaccaaatactactctaatatcatcgtcatgacatagagcaatcgtatacacgatcattatacccacaccattgcatttcccagataagctagcatcataatcaatataacttgaatatataataaagttggtatacatatactcgaaaagtaatacaataccagagtagtataaagaagaatattctaaataaagtataagtcttacaaaagagagcagagctactagaaccatacccgaatccttctgaagacttctcgaattaagactcctattctattcctattctagtactaaactagagagagagcttgattcttcccgcttgaggtgtgtggaagaagtgaggatgagagccccttttatagcctcccaatgacggttgtgacggttggaatggtcagaaataccctccaaccgtcattggggtctaatctacaacgtccaggcaaagccctggatcaaacggctacgagaggggtttggccaaacccgaggtttggccgaaccaggggtcggcccaaccagcccaggttttggctggtggtctcctcgtgtgtttctccccgtagacttgtgagtatgttatttctgagttcttggcccatcttcctctaagtctgattcacgacagcgtcggattgattgatcgtctattttgctatcgattctcctccatttattctcattctatacaaaaggttagaaaacctagtgctagtggaatatttcttattctaacatgaatatgcattgtaagcataactagttctcctttattttagtaatattgacgggtgaaactgatcgctaactgtcacgcccagaaatttagcccaaatttccagactattttgtgtattaaatccctgtctaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccattccacaggcaaaactcaactggggtctgagccttggtcttctaacttcgtcttcagctcagaagcactacacttctgaaaagggggaataatagcaagactgagtacaaccaccgtactcagtaagccacaccaacgatgcagacgtgcaaggggatacaaggaggggtttgtggctatttgcataaaggcagttgtaaaacattttattgagcaaaacagtaaaactgttgagtaattaaagtaatattgaatctccactgatcaacactacaccacgttgaacaggcccaaccaacccacctgaactacagtgtattgagtcgatttgtgtattgagtcgatttgttaagatgggactaatcacggtgaatctggtcgactgcccataaccgcgggcacggctattcgaatagttttactctgatcagaggtgtacaactgtacccacaagacacagccccacgacacgtttccgtgcgacgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccatcgcagggcccatcgaaactccatcacgcccacccttgcctggatgcgtcggctagaggaaagctacactacaagcccagccgttgcccacgctggcttgtgataagtacgataagttcttccagggcatcccgcgaaccggtccttaattgccatgggtgcgactagcaaaaccatgcacccacagcccaccattcagtcgcattttagttggataattacgaccatgaagcatggccagatgtctcgagcacgcagctcattctgatactaaaaggtctaaaactgtaattaccccatcaactgagctagtggtaattaagcatggctaagcatatagttctagctatgtcatcaaagtaacacaagctaggcgatttattacccaaggttgacaaagaacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgatcttccgaactcttttcctcgcgaccgcggacttccgaaacgacggattctacatgctggcacacaaaacgaggaacaactctaataaaaaccaaggaaacagtacataaaaactaaacaaacatgtagagctcaattttagatgaattttgcaagttgaacggttcaattcggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagtggcacaagggagccggtccaccgtggaccgggaccaccgaggcggtccaccgccggtccacgggaaccgacggcctggattggcctaagccgatcggacggccacggggcgcgcggctggggcacggtcacggctcaaagccggccagccgagtgatggcgcacggcagcgcggccaccggtgatgacggccgacgacgacgcggggagcggcagcgcatgcgggcggtggcggcgcacgctagggagcggcggcgcggcgcggtaaggtgaggcggcagccgactgcccggcacagccggcagcggcgcggagcgcggcggcggcgacccggtcggacggccaccggcgacggcggcgcgttgtgagcaggcacaggaggtggccgacgaaggggaggaaggggagagggaggggagtgctcaccgagcggcacgacggcaaacgggcggccgacggcaaggaacggtggcagcggggctcctcgggaagacggcgcgacggagctccggcgacgggcgtcgctcaggaaggggcggacgggctcggcctcggtctgaggaaaatcaaggaggggctagggaggtgagaactggtgcgaggtaaatggaaacgactgccgaccacgacaatacgaggaggagctcaccggcgacgagggaggtggagctcgggcggatttccggcgaagagggccagtggccaaggatctccccgtccctgcggagccgaggaaggcgacgacgcgggtcggcaaggaccgaagcggcgttgcgacgcggctggaggtggccatggtgagggaaagaggtggtgcgtgtggcggcggcgttccggaggcgaaatgggaaaatggagtagggaccggggtggagctcggcggggcgatgccggcggtggcggtggcacggcgcagtggtggctggagcggcgaggagcggcggctggagctcgtcggtgagtggtggagagagggagcgcggtggggagggggttccgacgatggaatggggaaaacggagcggggccgaggtgcggcaaggcacggcgaagccgcaggtggcggcggaacagcacggcgacggctgtagcagcggtggcgagcggatggagagtcgccggtgagcggcggcgatgggagcagcgaggggagagcagtacagggcgcgagaagctcgggaaaattgggggaaatggaaaggggaggccggggatgctttttatgggcttggagcgacgggatcgtgctcgagagaggtggcaaccggctggcgagatgggcggggcatcgtgggggtggtggagaggttaaccggcggcgattttcgtggggagagtggggaaaagggtagaggacgtggggcgacggggtcccacgaccggcgggctcgcgcgcggggtggaggaggtcggaaacggcggcgtcgtggggtggctcgggcggccctggcggttgcagccggccagccagaggtaggaggaggagctgacaggtggggcctcgggtcccacctgtcggggagagagagaggggaaaacgggcgagggaggtaaagcagacttgagggagagagagagccgagcgggccgagggagaaggccggcccgagagggagagaagggggggggaaattgggccgaaaggggcccaaagagaggagggaggattttatttgttttctttttattttaattggttaaatgatcttcgtgactttaaaactatttctcgagctccgaaaattcacggaaagttccggagagtacattagggcaccaagaatattacaaaatattcccggccaatgatttttaaaggaaattttaatttcctctataatttcacttgattaaattgatttaacttttatttaatttctagaagatgtattattaattgatttttattcccgaacgaaaatcggggcgttatactaacgaccgtcaataagtagtaatggtcaaacctttgtcaaggtttaccatgttagaaagaagctccgcgtgatatggcctgtcgacgccagtgacttgcaggaaattagcgtagagcggctcgtcgagcacctccatgtcatccctttatcctcaattcaagaatcccccaaaataaaacagcatcagaaaacgaaacgggggaagcgagccggacgtgctgtcggatctcaaaactaatgattcggaaaccgacatgtttaactgtatcaaaccctggatcagtagactgatacagcttcaacaatctggatcttcattgcgtacatttgaacaaggctccaaaggagatgttattacataaattaataggggaatttacaagattgtggctaactattacagcagaagctatagagtgtctcaactctaatattttgctatagacttaaaccatctaactaatttagatttgtgaactaggttgaaataagactaacttatatgattgaactcctggcttcggcaagaacttcaatttaactctggaaaaaggggtttgaagcaagggtgagtacaacgtacttagcaagctattatattcaataatgaatgtatgaaaaggtaatatttgagtaggattacgattacttgcagaaggcagagaatatagaaatagaaagcctgatgttttaaatgcagcagcatttagtaaaatcttgaattaggtttctaaccaaagtaccatatgagtcccgatactcaattccgtgagcacggctattcaaatagattcatgtttattttactgcagtaaatgtacgctttacccgcaatctatgacataccaatattcattagcttagtcatggcaaagcttttcggttactgacatcagtggcacctgttccatgaactttcatcctcatgcactctgaacgtaacgttatcagcagcgagagaagttctggcgttcccgaggtttttagagagagaactggttgagagacccccgtcatctcaaccaggttttcacaatacacacacttgagctcaacaaatcatctacctgtgcctcggtaaatgttatatttgcccttcgcggcataagtttgcctcctgcgcgaggacttaaataagaaccactgtacagaggtaccacctttgctagacaacctactttgcaaggtctgtccccattctagaattgcggtcgtactcgttcgtttgacataagtacttggtaataactatatcgactgagacagtactagccacccgaaaatcaaccaattcctacgtactgtcccaatctaagttcattatatttttatgcagacttactaggcagggctaagcaaagctagcatatctggtttgctatgttcaggttatgcattcaaaatcatgaatgactaatgcatagaatagaaatataagaatatagggtaattatgctcaagggaaggaataataacttaccttgctccaacgcgaataatccaaggtaggcaacctgattatccgatccttaaaataccacaggttgccatccaaaataaaataaactctactgaagaagaggaagagccaaattcaataaaagccataaaataacaaaagatcgataagcggctaaagagagctagggtttagggtataatctatctcctttagggtatagggattattgggttaatattttatgtggaggttctagagggttggaggttgaggtggagaggggatcaatcctctcatgtcaattatattttatgtgtgggttttggttgcttggagagtaagggatatataactggttaagtgagtatgtggctagtattggctggtggtaggtttgggtagtataatacctagggtttggttatatttaagccgattgtggagtagggcaacatatcggctaggttctatattttatgtataggttctagaagagtaggtagttaatagtatggtggataggtgggtatggaatttggatggtagttggaatttaattaggaaggcatcggctagggtttggttgtttgctagtcgttgctacagttggacagtataacgactagaattggtatcttctctagccggtgtcaatagacagcataacgactagagggataggaggtttgtgtgggtttagtggggcggaagtgttactctgacaaccgtgagtagcggcggagcggctaggatcacacagagctcaagagctaactgtgcggcgttctgtggaggtcgaggaaatagtgaaactccgagcactatacgcatcgaggcgtggggtgccaggagcagcacttcaaccttaggtttggttttgccgggctttacaaccaacagtctgacgtcgaggatagtaaaccgcgaacgtccccatggaaggcgtaaagttccaaccggcggctttttagtggctaaagagtattctgggttaaaaagaaatatttgaaaaggcaaatataaattcaaacaatatttgaataaattcaaataaaatattaaaatagcaaatttggtgtcaaaagatagggtttgaatttagatgaatttaggtccaagtttcattggaatcggatctacggtttaggagatatgggcttctaaaaaataggatttgaattaaatctagaaaatatgaagtgtactgtgtaggggcccacctgtcagtctttctttttctttttcttttcctccttcctcccgtcatcttcttccttctcttcttcttcccgtgtaacaacagagagagagagagagaaagagagagagagaaggggcgccggtgctccgatggtggaacggcttcgacggcggcggccaagcgtgttcccgagcgacgcgcacccgggtaagtcggtggctggccgagagagaggaggagttggccggaacggcgagtagaagagcttctcttcggctgcaagggaggtggttgtggtggcttgatggagtggatagggaagaggggaaactagaaaaatggattcccctcgtcgaggcaagcccgatggcgcgagggtttgggttgtggagctacggtgaaggagatcggccgacggtggcggcagccggtcatgaggaagaaagagagagaaagagagggagagagagacctcggatatgtgggagaaaaagggacggcttgccggtatttataggctttggaggtcggttcgcaaaggaggtcgtcgtcttggtcacggcggcaatgtcgtgaagaagagaacgacggcaccggtccttccatccgattggccgatcatgtcggtttggtgcagtggctggcgtcagcggtgtgaggtggcgctgacgtcgggcggcggttgcttagcggcgaaggaaagacggcggcaaagctgcaggcgacggcagcggctgcgtgtgcacccgtgcgccacgcgcgcccatggcacacggcggcggcgcccacgggacagggaggaggatcggctgtgtggctgggaggggtagctgggccgacttgggccgcctgagtgggaagaagaattcggcccaaaattacaaggaagaaagtctaatttttctagagattcaaataattgatttagaggaatttggatggctagatttaaaaaggatttgaattcggagatattgatacatggtgagggattttaaaataaggatgttctaatttatttgagtgcaatcttttgagagatagaatataacggaatttatttgatgcactcgattgagagggaagggaaataaataggatgttagcctcaaattatttagcaaggatttggagaagtattcgaggctaatggggaacttggatatttggcgataaataagaataggtttgaaatcaaaggatgggtcgacaattaattctaataaaattggaattgcttcggtttaggttcaaaggtattgttggaggatttcttggaccatgattcataaaagtaaaaaggattttcaaactaaaattaaataaagaaaattttggtcgaaagaacgtttaagatgcaaaatcaaatcaaagagaatacctcaatttaacaagaccaatttttagaataaaaccacgaaagattttaaataccaaagaggggttttatgcatgttagttttaggaggtccctctaattataatttcttaagtttaggaagttattaaaaacataagaatcggcgtgatgcatatgtagaaaatagcaaattttcggtatgttacacgtgcaggcaatgcagctggttgcggtggtgcccccgtttgccgactcgccgccccggggatccccgtgtgcagcgggctgggcgaggcaagggactaggaggggaggcacggacctgggtgaatgagtacatgatgctggtgctgagggaggcgacgccgaacacgcgtgaatcaccaccggcttcgtcttcggctccagcaacggcggcatcggtctcctctgatctgcgtgaggtggggaggggcagcgagcctgtggtcggatccagcgccgctgccaagatcctcgccgtggtagttggccctccacgcgtggcttcctggttggctcccaatggctattgtgagtgtttaaccaccatacaaccatcataagtcacctataaatgtgcactagtgatgcttgcgtacgacttttgtgacgctcgggtagaatcattgagagtttccatggtacctggtgcaagttcggtgcaccgaattaccgtactctcttggtcattttcttagtcaatcatagtcgaaaatacccattcttgctgatagttcttgctctgcaagaggtagggtgtgcaccataaccttctaaatgctaacgcgcctagtcgtctagcatactcattcatgagagtagcttagaagcactggtgagatattgaaatgctggatcaaacttatcgagtcaatgcacatagcgcgattggattaacggtaccgtagaacttcctgctctatcgtaatttcgacattgaataaatatgtcggagatattctagatttagcaaattttctaattcgtgatgccagccattttcctatattcaaaacatgcgcaaaactacattcaggtaagaatgcacaattgttgcaaataatgatacacaaaagttcccgcaaataatttcaatgtattctatgcaattctatacattttactgcaaagatattaactaaaggcaataaagcattacaaataatcaataatcataaatgcgataaataaatttcataatcatatatatcagcaataaaggtacctgaaatgcaaagtcgaggtaaaaattcaatgtctcgtggcccctttcatgcgagaatatgattttcggtgatatttgcaaatttcgtacgccattcaaacaaatatcccaataaagagggttaattgtgtaaattatggaaaaatcagggtttaaaaggcaaaatttcctatgcaaaggaacatgcacttaatttctaaaaactacacgggtccttttgcaaaatcacatgagcatctttcctttctctttttcttttgaaagttcaagtgccattaatttggttttggtgattaatgacaaatccaattacatgagaccaacattgttataagcatttctttgtctactagtctcatatggatatgaaagtggaatatgtgagaggtgatatccggacttcatatgagtggagaaagaaacgttcattgatgatgtacctaaatcacaaggatgaaatgcatggagatcaagctatatatgtcactctttctctccgtgcacatattgctatattcatatatatatatattcatgtgattacataagcatgtgagactaatgctttgtttgagccatatcttgtttggtctctttacattgagaacatgaagatgataaatgtatgtttttattttaatgcctatatttgataaatgccttcgattcttgtataggataagctcctaatgtttcattcttttatgcatactcttgcttcacacaaacattttgtatgcatgcatttagggggaaaaatcctatagtttagttatgcttgtaatcgatctaagttattcactttcatttaattgggatctttacatttgagcatatatttgagtatatgacacttgtggtgttgataaatactcatcatttattcatatcattttatacatgcgattggttggtcaacatgtggaggttgacaaccggatcattgggactaataattttattgagttgaatgaaagaaataggtcccaaggattgcaaaggtgttgatgctcaagtgatataattacacgtaacgataccaagaatgacaaagtgaagatattgaagatgtgggatacaaagtggctactatggcaagacggtgaagggcaagcgatggtcggtcacgatggaccatgcggcggtgaagggcaagcaaggggcttggcaccgaagaaccaaatcggtggtgacggaagagtgacggctttgtcatgatggaccgtgcgagaccatttgaagctacaagtaaccgcatcaatcatttaaagaatatatggtgaaacggtttcggcattggcgtcccttaagacaatgaaagaaagatgtaaagaaggcatccctattggtataattctcttcctatttacatttgagtttaggaatgtcgtactattaagagggatgcaacgtcgaggtatttgtgtatgtctcggtgctcaaagtgacctatcgtagtgctaccttgagagaaacccaagctttaacctatcctttgagtggttttagaccttgtttttggttgagttgggtagtcctctgaatgagctttccatagagtccaagatcatctaaaatggactcccgagcgaaaagttatagtcattttactctgtgcttttcggaaattccgaaaaactaaaagaaattccgaaaatatttcggaaatatccgaaaattatcggaaattttgaaaatggctgcgaatctgagattggcttctgtaagtttttggacttatccgaaaatgcattttagaaattccgaaaattacagtgttggcctccaacggttagtttttgaggggctcgggtatataaactcctccactctttctttgagtggctgctgttcttgggcaacattagacaaattcaaaaccaaagagccatccccgttttccctaccttatgtggtgcctctttgtgagagggatttgagaaggggagagatttggattaagagattaagaagttgagagctagtgagcttcactccatactttgagcactcgagttcatagcaagcaaatctttgattgtattggttacccttggggactatggtctcctagacggctaggtgttgccggtgagcacccaaggttgtggtgtgccatgaaaagtttgtgaaggcttcgatttcgcctccgcaagggaagaaatcaagagtgaaaccgatgattgcatttgtgcaacctcgtgaagaaagtgttgaaatagacccggccttatggtccctcaacggagacgtaggatccttggatccgaacttcgggaaacaaatcaacgtgtctcctctcttggtttgctcgttctagccatctctcatatcttgatcttgtttttacctgatctacttgcatgcttaattaatatagttggtgaccttatatcttgcttagataccttatttgtcaccatttgattcatatacattttgtttattcgagctacgagttcatagctagtgttttatttcgttatccgccgaactttttgcttgagaccggaacttccaatcctatactggaagttccgatttgaaccaaaagttctcatctctccaatatgctatgaagtgtgataattttttaggaacgcctattgtaacgccctgattttcgttcgggattaaaaatcattaaataatgcaccttctagaaattaaataaaaattaaagcaatttaatcaagtgaaattataggggaaattaaaattttcctttaaaaatcattgaccgagaatattttgtaatattctttgtgccctaatgaactctctgaaatttcctgcgaattttcggagctcaagaaataagtttaaagtcacaaagtttattaaactcatttaaataaaaataaaagaaattaaaatcccctctttgtctttgggctcggcccaatctcccctttcccctcccagccaggccaccctcttccccctcttcccctcgggccaccggcccattctcccttcccctccctcagcccgcttggttctctctctcgagtctagtttgcctcccccagctgtctcctcctacctcctctcccctgagccgccgacaggtaggtcccacctgtcgggctcattcctaacctccggccacgccgcccacccctcccgccgatccgcgcttcccctcgtcccaactggcgtggacccgagtcctctccaccttgcgcccacatcccgccccactccccctctctccccgcgggaaccagccctacgccgagccgccactcacccatgtcgctggagtcccacgccactgcccgttgccgcccattccggccatgttctcccctccccgagcctataaaaatgctcctcggggctccctctctcttttccccatttttccaaagccccggctcacttttcctcgctctccccacgccaccccgcgcgccgccgcccaccggcgagctccagctgcatgctgcagtcgccgtagccaccgccgtgccgcgccgtttgtgccgtcggcttcacctcaccgtgctgcaccccggcctctgctccgcttccccattccatcgccggaaccaccatcccaccgccaactcgaaccaccaccgccattcaccgccaccagccgcccgctactaccatcctaggggccgccgtgccgcgccgtttgtgtcgtcggcatcgctgtgccaagctctaccctggcccctactctatttcccctcttcgcctccgtaacgccgccgccacgcgcaccacctttttccaccgctgccaccgagtccagccgcgcgccaccgacgcttcaaacgtcgctgcggctcatcgcttgcgccattggcttcgcagtcgcaagcgcaaggccggctgccacttagtttgcccagtccacctccgaagcaccactttcgccatcaacccgagaccgccgccgtttgccacctccggtcgctgatccccgccgttcccgacctcctcgcggtgcaccgtcgcctccttcggctccgcaaggatgaagagaccctcggccaccacctcctcacctccgggagctaccgtaatcgcctcccctcactcctcggtgagtcccgccgcaaacgccgtgctcggccggtgttcctcgccgtgccgcgaagcctctccctctcttaatccctcctctgtactccctaggtcccgccggtcctcggccgcacctccgccgctgtcagatcccaaaactaacgattcagaaaccgagatgtttaattgtatcaagccttggatcagtagattgatacaggttcaacaatctggatcttcatcgcatacatttggtaaagactccaaaggagatatctttatataaaataataggatatttacaagtttgtggctaactattacagcagaagctatagaatggcttaactctaatgttttgctatagacttaaaccatgtatctagtctatacttgaaaattaagttagaatgaaactaacttatatgattgaactcccagcttcggcaaaaactccaaatagactctgaaaaagaggggttgaagcaaggttgagtacaacgtactcagcaagctattatattattcaacaatgaatgcatgagaggtaatatctgtgtagagctagatttacttgcagaatgctgagaataaagaggtagaaatcctgaaatgcttgatatgcagcagtatttaagaaaatcttgaattatatttctaaccaaagtaccatatcagtcccgatgctcaaatccgtgagcacggctattcgaatagttttaaacatattcatactgcagtagatgtacgctttacccgcagtccataacttgctaataatcattagcttagtcatggcccagtattaagttattaacaattgtggcacctgttccatgaactctagtccccatgcgctctgaacgtaacgttatcagcagcgagaggagttctggagttcccgaggtttttagagagaactggaggagagaccccacgtcatctcaaccaggtttccataaaatcacacaaacatcgcgcgataatcaagatatttatgtgcgcctcggtaaatatcacatttgccctgctcagcatatatttgcctccttcgcgaggacttacataagaaccactgtacagaggtaccacattgttaattaacataatatctaggtctgtccccattctagaagctgcggtcgtactcgttcgtttgacataagcacttggtaaacttatatcgactgagacagtactagccacccgcaaatcaaccaaatcttacgtactgtcccaatctaagttcattatattttatgcagtctaactaggcagggctaagcaaaagctagcatataactggtttgctatatgttcagattatgcattcaaaatcataaatggctaatgcatagaatagaatgtagaatataggataattatgctcaaagggaggaataataacttgccttgctccaacgcaaataatccaagataggcaacctgattatccgattctcgaaataccatatgttgccatccaaaagacaatagactctactgagaaagaggaagaactaatttcaataaaagccataaaatggtaagaaaacgataaacggctaaaagggctagggtttaaggtataacctatatcttttatagggtatagggattatggggctagtatttgctagcggtaggtttaggtagtataatacctagggtttagttgtatgggagtcgtttgtggagtaggatagcatatcggctaggctctatatttttttgtggaggctctcgtggtttggacgataggaaatatactagatagttgatatggttaaataggcatgtggctaatatgggtgaaggttgagcttttgtagaatagtggctagggtttagttgtttaggccgatatcgaggtaggataaatattggctagggttttgggtgttcgctagtcgtcgctagagttggacagcatgacaactaggtttggtatcatttctagccgtgttgatagacaacatatcggctagaagaataggaggtgggtgcagttttagtggggtggaagtgttactccgtcaaccgtgagtagcggcggagcggctaggatcacacagagctcaagagctaactgtgcggcgtgcaatggaggtcaaggggatagtgaagctctgaccgctgtacgcatcaaggcgtggggtgccaggagcagcacttcgaccttaggtttggtttttgccgggctttacaaccaacggtttgacgttgaggtccgtagaccgcgcaaacgtccccatggaaggcgtaaagccggcggctttttagtggctaaagggtattttggaaataaaagaaaatatttggaaagcaaatataagtttaaattgtaaattcaattataagattaaatcaaatatttattcaaatggtatttgaataaattaaggaaattcaaataaaatcttaaaatagcaaatttgatatcaaaatgaagagtttgaatttagatgaatttatgtccaaatttgactggcgctcgcacgtaatagaacacgtgcgcgctttatgcacgcggtttaggagatatgggcttctaaagaataggatttgaattaaatctagaaaataagaaaagtcactgtgcaggggcccacctgacagtctttctttttctttttcttctccttcttcctcccgttcctttcttcttctctgttccagagagagctgggagaagagagaggagaaggcaatcggggcggcggcgcttcggtggctggagggcggtgacgtcggcgtccatgcgtgttcccgagcacgacgcacccggggagggcggtggctggcagagagagcgagggagatggccgaaacggcgacgacaagagctcaactccggcgagtaaaagaagtggtgatggtggcttataggatggctaaaggagaggggaaactagaaaaatgggttcgtcggaggggggcaagtatggtggcgcgaggatttggttagtgttgctccggtaaaggagattgggcatggcaagatggtggccggcatgggagagagagaagagagagagttcggtttgtgtgtagagaagggccggctatttataggagggaagggcggttgtgagaggcggttcggaggaggaggtcgaggaagacacggcaacggtagcgtgaagaaaagaatgacggcggccggtaacttcgcagcgagggaaggcgttgcggcggtgtgcgccgtgcgcaacacgcgcacgggaggaggaggcggctccgctggggtgtgggctggtttgggccggctcggcttagctgggccggcagcccaagaaggaggaggaaaatagaaaagaaaagggattgggccaaaaggaagaaagaatggagtttcgtcccgatgacaaaaagaaaggaagtctaatttgaatacttgattggataactaggtttgcgaagaatttgaattcggagagaattaataaaagagatttcttaatttatttatttgagtgcaatatttagagatggagttggagggaatttatttggaagcactcaaataggaagggaaattaataatattcctcaaaatatttttgagaatatagaagggaattagttgaaggcaataaataggataccgattctaaaattggtattatgtatatttgtggctaaaaagggtgaatgaagagtataagttggaattttcttagcacaagagcaattattcacaatatttgaaataatactattcttgtgctgaagaggaaatcaagccacagaaattaaattggtggctagatcaaaaggaggaatttggatatttggatcgagaataaaggatgggtttaagatcaaaggatgggctaacaattaattccaatgagattggaactgctttggtttaggttcaaggcaaaattggaggatttcttggaccataattcataatagtaaaaatggttttcaaactaaatttgaataaaagagttttagtcgaaagaaggtttaatattcgaaaatagaattccaacaagaaataaatatgtttttaaatgaaaaacacaaaagggattaaataccatagatgtttttatgcaagttagttttaggaggtcccgctaattatattttcctaggtttagaaggttattaagaacataagaatcagcatgatgcaagattagaaaatgatacattttcaggatgttacagccgcggccgggagtcatcggagcgtcatccccgactccaacccgaggagcgacgccgcctaacctcgtcgcaggccgccttcccgtcttcgcctcaccatcccgtccgctcggtgaacatcccccttccctcccagcctcactctgctgcatcccgtgcatgccgccgcgccagtggtcgttgccggcgaccatcgggccatgcgccgccgctcccctgccggctggccggcttgaagccgtgccgagcccggcagccgccaagcaccgttggattcacccgaggccgtcaacgtggctgtcgtggtgctgtcccacgctggtgccacctcggcgccacgtccttgccaactcccacgtcggtccaccgtggccaccgcgtggctgccacgtggtgtgcccacggacacgcgtgcgtggactcggtccacagtgcgcccaccccttttagccaccgataggtggggcctgcttgtcattgctacccctctcccctcggtgacgtcataaatgactttaaattgcgcaataaattcagttaataattatagaaatttatttgatggctcaaaacttctaacattcatatctaattcatatgaactccaaattgagccattcaacttgtaaaattcatctaaaattgagatctacaggtttgtttacttttttatgtactgtttgcttggtttttactaaagtttttcctcgttttgcgtgccagcgtgtagtttccatcgttttgaaagatcgcaggcgcaaggaaaagagatcagaaggttgttgtgaagaagcaaggcaagtcacacattccccttgagcatgttgatctcaatttataaatgttttatcgtttgcaaatacatatgcatgttttgctaattacatgggatcagggtttacctacttgcttgcttgtgccgtattatttgatatatgttctttgtcaaccttgggtgaataaatcgcctagattgtgttacttatgttgacctagctagaaccatttgcttagccatgcttaattaccactagcacagttgatgggataattgtagtattagaccttttaatatcatgacgagctgcgtgcttgggacatccgaccatgtttctttggtcataattatccaattaaaatgcgactgaatggtgggctgtgggtgcatggttttgctggtcgcacccatggcaattaaggtccggttcgtgggatacactggaagacatacagcgcttgccacaagcgggaatgggtaactgcctaacttgaagtatagctttcctctggttgacgcatccaggcaagggtgagcgtgatggagttcggataggccctacgacggcctatgcggcttttagattcacctaggcacgagagggaattgcccgctgcccgtggaaagtaggggtgaaacctgaggtgtggtgttctgagtgttttcaatggtgataaaatctttcttttaatgtcttgctattttaagattttgacaggggtgtgcggtgtaattccattgatttttggatttcgatcgtatctaagatcctagtttatctaggttgctaactcaatggtagagtactcggcttttaagtgcgactatgatcttttacacttggatgaagcaaaaaattcgtccagactcttggtagagtctataagaccgcgactgatcctcaagggtaatgaatggaaaaaatagcatgtcataataaaatcaatttcttattttggaattttggaatggaataaaaaaattctgattttctgggtctaatgaataaatggatagagcctggctccaattctggtaaaacaaaaagcaacgagcttaacttcttaattggaagaactccctgatctaattagatgttaaaaatagattagtgcctgatgtagggaaaagctggttttcctattagtagacctttgattttttcttttttttttagaaatcctaattattcttgattttggattgaaaaggatgttatggattgaatgtgtaaaagaagcagtatattgataaagagactgtatcccaaagtcaaaagagcaattggcctgcaaaactaaaggatttgttctcttttgtaataagaacaaacataaacaaattggatagaaaaggagcgggaaaagatccgtggattagactccttttcttccccaggggtttgtattaaaaaatgcaacaccttgttctgaccatattgtactatgtatcaccatttgataaaccgagaaatatttctctctctctgattcaagtagaaataaaaatggaaaaattcgagggttattcagaaaaacttaaatttcctagacaatatttcgtctacccactactctttcaggagtacatttatgtgtttgcccatgattatggattaaatggttctgaacttgtcgaaattattggttctaataacaagaaatttagttcactacttgtgaaacggttaatgattcgaatgtatcagcagaatttttggattaatttggttaatcatcctaaacaagatcgattattggattacaacaatttttttttattctgagttttattctcagattctatttgaggggtttgcgatcgttgtagaaatcccattctcgctacgagaacagtcttgtccggaagaaaaagaaataccaaagtttcagaatttacgatctattcattcaatatttccttttttagaagacaaatttttacacttacattatctagcacatatagaaataccatatcctatccatttggatatcttgcttcaactccttcaataccggatccaagatgttccatccttgtatttattgcgattctttctcaactactactcgaattggaatagttttattacttcaatgaaatccgattttattttgaaaaaagaaaataaaagactatttcggttcttatataactcttatgtatcagaatatgaatttttcttgttgtttcttcgtaaacaatcttcttgcttgcgattaacttcttccggaacctttctggaatgaatcatcttttctaggaagatggaacattttgggttaatgtaccctgctttttttcggaaaaccatatggttcgttatggatccccttatgcattatgttcgatatcaaggaaaggcaattcttgcatcaaaaggaactcttcttttgaagaagaaatggaaatgttaccttgtccgtttgtgccaatattctttctctttttggactcaaccacaaaggatccatctaaaccaattagcaaactcttgcttcgattttctggggtacttttcaagtgtaccaataaatcctttgttagtaagaaatcaaatgctggagaaattcatttctaatagatactcaaatgaaaaaattcgataccaaagtccctgttactcctctcattggatctttagcaaaagcccaattttgtactagatcggggcatcctattagtaaaccatttgggccgatttattcggattgggatattcttgatcaagtttggtcgnaatatgtagaaatcttttttcatnatcacaagtggatcttcaaaaaagaagactttgtatcgactaaagtatatacttcgactttcatgcgctagaactttagctcgtaaacataaaagcccggtacgagcttttatgcaatggttgggttcgttatttttagaatatttttttacggaagaagagcaagttttttctttgatgttcaccaaaacaacttacttttctttctgtggatcgcacagtgagcgtatttggtatttgaatattctccgtatcaatgatctggtgaatcctcttaattaatcattaaacaaaactaataaactagaaatgattgataaatgatcaaggtaaaactttcacagtttctattctgaaatgttctttgtactataataaatagtaagtgaatcaacttactactaaaaaaattagtagacttcctcttcggaatagaaatagcctatttctacatagggaaagtcgtgtgcaatgaaaaatgcaagcacgatttggggagaggttttttctctattgtaacaaggaataattatctactccatccgactagttccgggttcgagtctcgggcaacccatatggaaactagaaaggagcaatctgagttttgatttttcactcaattcatttacaaatttttttggtttggtaaattttgttgtatggatatacaactgtcggggctggcttggttgacattggtatatagtctatattatactgttaaataacaagccttctattatctttctagttaatacgtgtgcttgggagtcctgccaatttgaataaaccaagatcttaccatgattgcctttttagagagacgcgaaagcacaagcctgtggggtcgcttctgcaactggataactagcaccgaaaaccgtctttacattggatggtttggtgttttgatgatccctaccttattgaccgcaacttctgtatttattatcgccttcatcgctgcccctccagtagatattgatggtattcgtgagcatgtttctggttctttactttacggaaacaatattatctctggtaccattattcctacttctgctgcgatcggattgcacttttacccaatttgggaagctgcatctgttgatgagtggttatacaatggcggtccttatgagctaattgttctacacttcttacttggtgtagcttgttatatgggtcgtgagtgggaactgagtttccgtctgggtatgcgtccttggattgctgttttatattcaactcctgttgcagctgctactgctgttttcttgatttaccctattggtcaaggaagtttctctgatggtatgcctttaggaatatctggtactttcaactttatgattgtattccaggcagagcataacatccttatgcatccatttcacatgttaggtgtagctggtgtatttggcggttccctattcagtgctatgcatggttccttggtaacctctagtttgatcagggaaaccactgaaaacgaatttgctaatgagggttacagatttggtcaagaggaagagacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaactaatctgtagttgatagccaaggtcgcgttattaatacttgggctgatatcatcaatcgtgctaatcttggtatgggagtaatacacgaacgtaatactcacaacttccctctagacctagctgctcttgaagttccatctattaatggataaggcttttctgctaacatatagcaatttttgaagaaaggaaagctagaaatacccaatatcttgctgggtattttttattttgaatctttctattctgaattcagttaacgacgagatttagtatcctttcttgcactttcataactcgtgaaatgccgagttggtacgaattcccccaatttgcgacctatcataagatttgttatgtaaataggtatatgttcctttccattatgaatcgtgattgtatggccaaccattgcgggtagaatgctagatgcccgggaccatgttactattgtttctttctcctccttcatattgaccttttctatttttgccaataaatgatgagctacaaaagaattctttttttttcgtgtcacagctgattactccttttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggtttaattcccgtcgttcgcccatcccattattgcaaattccaaaaatgcaattttccatattcctagttacgtatttacttacaacgacgaagaataaaactatcactatattttttccttttcctagttcttcttccaagcgcaggataaccccaaggggttgtgggtttttttctaccaatgggggctttcccttcaccacccccatgggggtggtccacagggttcataactacccctcttactatggggcgtttacctagccaacacttagacccggctctacccaaacttttttggttcaccccaacattacccacttatccgactgttgctaagcagttttgggataccaaacggacctccccagatggtaatcttaaagtggccgatttaccttcttttgcaatcagtttcgctacagcacctgctgctctagctaattgcccaccccttccacttgtgattcctatgttatgtatggccatgcctaagggcatatcggttgaaatagattattcttttctctcaaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatatgccaaatcgttcatgttatgatcttctacatcctaggtctccacgttccgtcatctggcttatgttcttcatgtagcattcagatcgaatgactctatgaaattacgtcgatacttctacatattatgggtaacgtaggagacatccctattttcccccgagggtctcaattcgcctataaccatcaaattaaatgtgaataacccgtcctcctctctttgaaacaagggcgcttccggttctgtggtcagagggggttatatgaagggtcttgtcacaatcactcgacatggtgacatgtctagccgagcacggtgacatgccgatggattgtgtcttgtgggtacaggtgtgcacctctggctagagtaaaactattcgaatagtcgtgcccgcggttatgggtgatcgaccagattcacccggattagtctcacactcaataaatcgacccaatgcattgtagttcaggtaggttggttgggcctattcaacgtggtgtaggggtgattagtggaaatttaatattactttaattaatcaatagttttactgttttgctcaataaaaagttttacaactgcctttatgcaaatagccacaagccatccttgtatcccattgcacgtctgcatcattggtgtggcttgctaaatatggtgggtgtactcagccttgctattggtcccccttttcaaaagtgtagtgcttctgagttgaagacgaagttagaggaccaaggcttagaccctagttgagttttgcctgtagagtgaagctgaagcctcgctaggatcgcctttttccgctgctgctactttcattttggtgcgaggactaagtgcctcttctgtaagtatttttgctttatttacgtttggatctgtttatcacttgttgttttgtgtaccctgtcttgtcctggacatggatttaatacacaaaatagcttggaaatttgggctaaatttctgggcgtgacgcctattcacccctctctaggtgacatcaaggtcctttcaattggtatcagagcaaggtctctcattttgggctttactaccccgagagaagatgtcgataagaggtgaaatgttcctagaacctcttttcctagatggttcaaattacatatcttggagtattcatgtgcttaatgtgtttagggccatgggtcctcatatagagcgagttgtagatgtgagtatttctcctcctaatgataaagagctatcatttgaagaggaagagaaatgcacacatctcaatgctcaagctattaatgttttgtttagtgctttgagtgaatatgtgttcaaaaccatcatgccacttgtagatgctcatctcatttggataacactaaaggaaagatatgacaagtctaaatgtgatggagaggatactcttgtggaagcatcatttgggaattgctctacttcattacctcatcatgacaagtcccaagtgattatctcctccgaccaagaagatctcacctcatcatccatctcatcaacatacactatgagcaaggtaataaattggtgagtaaggttgatgatcttccaactctcccattggactcaaataacaccgataatgaaattgctatatttcatagtgttgttgactcatgcatatcacctagcactaaatgtgtgcatgaggatgatatggatggatgctctacttcctaaagtatttgtgaaactaaccttttgaaggaataagtgaatgaacatcaatggttaattgaagaatccacatcatcaatttgttcatcttccattgctgaagatcatatgtgctttatgggtgatgatgatgacttcgtggttgatcacttgaacaagaaggacacaacaatggtgatcaaactcatgagggttattgagaagcaacaagcatgcctcattaagaaaaatgaagaaatcaagggtctagccgataaacacaagaaactcaagggatctaattcttcattaattatgaggtataaaaaattggaaaaatgaatttgcttgtgccactaattctattgcttgtgtagcatctttggagaaggaaaattaagagctcaaatctcaatttgaggagatcactaaaaagtatatggatttacaagaaacacacgatgaacttttgtgtgtctcatgagaaccttgtagattctcatgccatggtagagatagctcatgaggtgataattgcaacggtaaaatcttatgagccacatgttcaagttgattttacttgtgctaacacttgttgctccaacacaaacatttccccgagcactacatgtgacttggattgtgtaggaaaaagagagaagcacatggatcatggacttgtgggcaatgctcaaccttctcaagatacccgtgggaacatggtgaaaaagcttgagaggggatcaacagtagcttgcaccaagttctatcaagaaaacaataagtccaacaacaagattaagggacaaattcaaagttggatcaaaactcccattacttgcttcatgtctaagaaagtgggacactatgccttgatgtgtttcaacaagattgatgaccaagccacacttccaaagaggagaacaagaagaagcaataggaagtgctatggatacaatgagaagggtcatgaagttgcatcatgcccccacatgaaggatgactctgtgtcatcaaagaagaagcttaatagcaaggtagcaagtaagatgcaagatgtggtgaagaagacaccatgtaaagacaagaatcgactttgctacaattaccgtgcaaagggacatattggtaaaaattgtcctctgagtaacatttctaaactaaactcctcatttgattatgatttgcttaggaaggcaaaaaatgacatttgtgctactagggtgactagttcaccacatgctagcacaaaattcatttgggtgcctaagtcttgtgtgacttacctttatggacccaatgttgttggggacaaaaatgtgctataatgagaatataggtatgactcatgcaagaaatggtggatctcaccaagttcggaatttggagccaaccattgcaaaattcacgtaaagaaccaatgtcatctcggtaacatgtatctacaatgaattatcttgtatttaaccttgtgtaggttacattgcattctcatagcatttaagaattaacatttcttgcatatgtgaaagtcatcatttatgcattcttaagcaagataggttgtgatgtatgactgtttaatgctcattcatatccatgtatatcacatctcatatatgtgttcaagttggctaagtgctagttggtaatttcaaaataaaccttttagccaaaaatgaaaattttgaaaactatggctttcctataaaaatctaattggaaatgatctcaatgtgtgtttcaaatatctctcaatacttttatatttcaaagaagagctaatttttttaaaaaaatgaatttcaactaaaaatgtagctctaagtatcttgttttagcttttaacttcaatttttttgtacaattaattctaaaaggaatttggaaatggtttcaaaacggaaaagatagggttggctaattcaaacatttatggtattcaaagtttctctgaaaggccaaccgatcaaaataaatttagatcccaatcttatccaaaatattatctagaccataaatggccactactagcacttagatgagttctcattgttggggttgcataaacgcatcatactagctcaaatgagtgcataatattcattcatagtcatttctcaccaaaaccatctcatttgtgtgtgtttgcatttttgaagaaaagtgtttaaaatagaagcttatgtagctttttgctcaaacttggtattttcttctaaaccttgacttcatggagttaaagtgtgaaatacatcaattgagagtggtcttaatcatgtcagcatgaaaaattccatatctatcaaggaacaaacaaaaatcttcctatgttctcagacaaatccaagagcaagctacttgactggcaaacaagatatcgcataatcaattataagcaatttgcgatgaagaagaacaaatcaagaaatagtggaagaaatcaataataaatcaagaaatcgtgtcctcctgtcttcccttgccgttgtggcagagcttccactgccatggcaagaggatgtgatacgccggtgtcctccgccacacctgccatcaccgtgtgttgttaccaccacagtagtagcgcgctcgcagaatccctaaccctaggagaggaggggagaggggaaggggaggaactcaccggggagaaggtggccaccggaggagagaccgtgccgtcgccgtcgtgtccgagtcacgccgcgtgctgcgctccgcagcagcgcctcctctcgttatgttgcctcctcccctcgagggtattttccacacactccggactagatgttttttttcagggctggggcgcaggggaaacaccgagatgggttgggttaaaataccgactgggcttaatcgaacacgtaattttctgtagtcggtatcctttccacgccgagatgatccatgagagttgggccgtggtcctggccattcccgccccaaccgaacaagcccttattggtgaaacgaaaagaggagatctaggggacaaaaacccctcaaacaattttgtaaaatctctaaggattcgaccgaattgggtggaggaaggctgcggctttagggtggcatcgtggtggagctaggactcccgtccgagcttgaagatgaccctgacttgttgggtctgggcccacatgtcagtgggaggagcgagggaggaggcccaaaagaaaaagagaagagacgagggaaggaagcgggccggcaagagggaaacatgtgaccggaaagatgaggagaagtgggccgggttcgccccagagagaaatgatggattttaattatttttcatttaaataaatgttaaaatgatctttgtattaataaaattaaaaattgagctctgaaaaatccgataaaatttcagactgtaatttatcacaaagaatttaataaaaattaagtccaaccatgtttatttgggaaattttagtttacacactttacttgtaaattaagtaaattaatgtgtacttagtacaaattctagaaataatttattaaataatttataaatctctgaaacgaaaatcagggtgtgaaaatgttgcagacggctcctccatcccccttctcccttcttcttgctagtgcctctgctaccgaccatcgatgaggcatggcatagggagctcgccgtccttccctcatttctccttttttttttaatctattttttttgactgacatatgaccccatatgttttgtttttatttttttaattttgcttccaatgccatgctcacatagtttgagaactaactcaaaccagtcacatcagctgaaaccaccatccagaccgttttaggatcttgtttgtactaatgagggatacgttagacgcaattcaacctcaacccttagatgagggacctgggtgaactttttcatttcggaccacgccaatggtctaccgggacgggcccaacttattcagtttcaccccagaaattagatcaaaacaagcccactacgcccatcaataaaccctagcagggtaccagtccaacacccgcacgcgtacagcacgccgccagctgctgtcgcttctcggctttcctcgcgagtcgaggctcgcgtcgcgtggtcggcccctccgccggccgttccctacttccttcgccgccagtcgcccggaaagaaggcgcatccacccttctcgctgagacatttccatcgagccacccgcaggcggcgaaggaagggattgcgcggcgcgatggagggaggcggagaggatacggcggcggccatggcgatggaggtggagatagaggcagaggccgtcctatgcatggggacatcctcgcccgcgacgtccaactcctcgtctccaagccctaacagcggcatctcctcgagacgtttgggcctcaagaacagcatccagaccaacttcggcgacgactacgtcttccagatagcttcttggtaggcgcccttcccccaccctggttcatttcagactgcaaattctttacccgtttaaatggatttcactagcttcagatgatacttgtcgaccactttagctttggtttgggatgttaataactgtggtgtgctattaggtgtatgcttttatgttattacgaattccatgacatgcaaaaaggaccattcagatttcaagaccacattattcctgtctttgttgttgctgttatattatcatgagtaaatttcacaaaactacatgttttgtggtccaagttacagaaaaccacacacactttgacacttggcacttgagtatatatattttggttgtgtagtttcacaaaactacactatcgatgtatagattcacccgcgagatgatgtggctgtttcacctaggacgaggatatggcatcctattaccagccatcgcacgaaattaatatgatgccacgtcctcatcctagatgaaacaaccacgtcatctcacgggtgaatccatccatcgatagtgtggttttgtgaaactaaactaccaaaatatatgtacttaagtgacaagtgtcagaatgtgtgtggttttctgcaacttgaaccatgaaacatgtagttttgtgaaatttactctattatcattattatttatccgtaataacacttttctcttttcatcacaaattatttatccatactcatccttttctcttttcatcttttttatgtatgtggtatgtactgctgatattatgcatgctttaggacttatgccctctgcatcttatttcatatatctggtaacaagtcaggagaactctacgctcgcggtttccttgtcaacaaatgcactaaaattatattctccagcaactgggcaatttttgggtgaatgcactggacacagcggatcaatccatgaaatttccttttcagccccatcatccccacaagtaatctgttcttgttcttcagatggaactataagagcttgggatacaagaagctttaagcaggtctgttttcctaatctggttatcaaatgcataattaagggaataagtatactttactcttgccagctgatgtatttgattaattttcaacttctaactatggaataactgacaccccttaactatcaataccaaacaaactcccccctggtccaattccacctggtttgacgccacatcaccctgctcttgttggtcaggccagctgccgccgtattggaggaccccataattagcttcggcctagcatgagaagcaggccaacctttactgtggccaggagtcatcaagtgtgtcaatgactacacaaatggcactgtgtgtgggcgatggggatcctcacattcagaaactatggcagttcattgtttaggggcagccaacagcagggacctgtggtaataggagggtgatgaagaatttgaggctggcatgtgggaatcaccatgttttgctgattggactgcatttttagcacctaatcagctaaaccacctttggatagtcttagagatatgcctgctattgatagttggcagtgctatttgtcctgcttgatagttggagggaaatgagagaactgcagtacttgagatgggtacagtagactgtccacactattcattatgttaatgtgctgacaaatcacatacttagttctgttacttaaaaggagttagtgatgatgttgtggtctgcaaccccccgacacattctcctaaaggatcttctattaatgggtcaacttagacctgtctacatattttgggtgctggtggatggttggtcagatatgaattatacatgttgagttgaggacaatcaaatttgattcttttaagttccagttttttggtatatctcttcgagatacggcccaaagcacaaccactgtgctagcttatgcacttcttgctcagtagtatttccatgaaatcatctttttgagtttatcttttacatggtaaaatgtaaatgcatggccttttgttacacataaagaccttcccgaatgcaacttttatatctggtaaattctaatagtctactcaatcttgtgcaattaagtttgtctctgttctgctgataattggatcacaattgatgttgccttttcatggaactaacatcaatattcggtgtatatggctataaattgtcatgatattgtttttgtgcttatgctaaattatacagacaattttgcatctactactgcttttcatactctatttgttgtccatatcttttcaatataacattactaggactgatttaacattattaagcagtgcgattggcttaattgtacgaccagtttgttagctgttttcattagtattataattggtttaagtaattatatatatttctaaattcaaccatcactggttcaaatgttttgcatagatatctttgctaaggggttctcaagaattgttcagcttctcctttggtggatcaagtggtaacctacttgctgccggttctaattcccaggtaattgagttgagttttattctttcacagatattaggactgtttacattctcacttaactgaaaacactagagcaaaagtaatgaactgcaccatccactgttcggattataagccacaaattctaatcccggaagtctgtttgtttggcaaaaactggctaaaaccataataaattgatgaaactaatttgttgaatgcttcaatctggtgttcaaatagatcaagatgaaacatcaaagtaactgagaattgagaatgatggctagatgtacaatttctgaatagtggactattgtttgctcagccattctgatgcttgtgtgcaccgtctcttgcatgaaaggcaattgtagctgtagatcggtgtctccagccattgcaagggaaggggagcatctccaatagcctctctatttcagcccctgtagctatatttaccaattatctccaaaaccagttccaactatgaactatctcaatctcaaaattcatctgattaacataccaggatggtttacttccatatgtttgtgacgtgacttctagaaaaaagaatcttatgatgttacactcgttttgattcttgttgtctcattctaatttggtggttgtaggttctattgtgggattggagaaattctaaacagctagcatgcttagaggaatctcacatggatgatgtgactcaagtatgtattgttctacgtcatatattttactttgcattctttttgttactcaggactgtttgttccttctctacattaatggaacaatctgttcaagaaaatatgtgggtgcaagtagtccgcaaataaaattggtcatacatttttatgttattgtgtatttatgtaaagtagctgactcattgcattattagagccatagtacaaaaaaccggacaggccagggggttaaaccgaaaaaaccagaaccagaggtctggatggcttggtttgctataaagaccgcccctgcatgtgaagtggaacaaaccgtctaaaccggatggttttcatgtgaaccggtgaaccaaggcaaaccgagccggccggttaatcatgccaagagaggatgagccttgatgggccagtcaagggccttgtgcatgcaaagatcacaaggcccacggttcatgtacttattgaaaatagcaagaaaaaggtagagaatgggggttcgaacacaggtcagctggttgaaagctctacgcatccactgtccagctaactttcgcagtgacaaatggagaatatgcatacaatatagcacttccggttcaacattcgaaccatgtgaaccggcagttgaaccgctcatgtttagagcataactatctcaactaaaagacgccttgcaatagatagctcttgtttagtgttgacttgaatgatgcagcctcaggctaggtacatgaatcagtttcacctgttaaaggaatgtaatgtttaacctaattggaggaataggaatcatggaccaagcaggatcaatgttaaagcttgtttacttgctgttctgtttcatagctgcttcatttggtagctgcatttgtggaatttggagggctctggtcctggtgaatggagagtattcacaatttaagaggtattggacacctggctgcatcaatagttatatcttatgtgcagaaagatcatttgtgcaattttgatgtcatgctaatatgcatgctgctgcctagtcaccgactagtcatctgactaattacccaaactgaccttttgtgagttgactcgacttgatggcttaatgctgtgagcaactgagcattacaccttgtgacttcatcttttggagcagacactgaatgtgttcatctgttatggacactaattcatggatgggttaagggtctaaagactgggatagaagtgagatcactctcatcggtactaggcttgtcctcattgccagtagaccctgatcaagctacacctactttatgattctttattgcttacttacatgggttacatgggtcccttatatgggaggttcttttgctgcagtactggaggcacttacgtgaacagtaccatgaatagtatctctaccttaacacaccatatttctaatttctaactgaacattcctaactactacctccgtcccaaaatacaaggagttgtagacttgggcacgggtattaaagaaagtaggtggtattaaatgggagaatgattgattaagaagaggaagtaggtggaaaaaaattgaatggtggaaggttgtgttttgttgaaaaggaattgtaggtgaagttgttctattttgggataaattttgaatgctagaagttgtattttgggagagggagtaatagatataataccaaataactaagccatattgacacaatagatgtgattggttgaggcaatagatttattatggaaggtaaatcctaaaccttaattgtattgctacactgctacagtacatgatactgttcgtgcactacatctgttgtggcaaggcatctcaacctcaagctgtggcagtaactacggctgaagtctttggtgacccatgtcgatgaaactgtatgccaacggaatcttgtgtagacgatcattggctctccaatgaacagttgtgaaggaacccttccataacatcacctttatataaaaacacttaggctgtgttcttccccccattttccaaacacatctctcgttttccgcgcgcacgcttttcaaactgctaaacggtgggatttatgcaaaaactttctatatgaaagttattttaaaaaaatcatattaatccatttttcaaaaaaaaggttaatacttaattaatcatgtaataatacaagctttgttttgcgtgctgggaacctcctcccgaacacagccttaatcaagtgagaactgagtcatcctgctggcatatttgaaggcattaatgctggagactacatgtgtatactatcaaaatatgtgagcatgcggatatccaatcgaaatggtcctagaagcaaacagtacttttatataaaaatcatgatctaatgatctgctgtctccgtaccatgcattatcagcatttagattgatggactagatatcaaatatgcaccattatattttacaaagtgatgcttggatggttttgtatgttttctactcttcatggagacaactatttttatatcacaggagacaactactttcatcacttactctaaacattttgataatgtgcttactgaatcacttgaatgcattttattgtgaaaatatcttgtatttgctactgttcctctcatactatttctgtattctgggtgattataaatttttatgttgtcaccttttttggacaggtaaaatttgcaccacatcagcatagcaaactcatttctgcagcagttgatggattaatatgtgtttttgacactgatggtgacatgaacgaggacaatcatttgctatctgtatgttttagttgtttcctgtgcccaaatgccttgtcttacatatcctgctatgtcaggttatggtttgatactttgatgtttgttgtttactgaagtatcccattagtacttcaagttatgttcctttgttgtttcatatgacgatgccaaatgcgcatgatgttttttcccctttttgtaacttcaataactggccatgtgtgtaatatgctgttatttgttcgtgaagtacatgatagagcttacaattttattcctcaccgcttcttataacaatgctactgttaatctccatagttctttgttaatcttcatacaatagagcttacaattcttgtatgttacggatgcagttctagttttgcctattcttttcttggttgttagtactattcaattgtggtattacaatatctcccttttgaagtattttttttttaattttaatggttctgcatgaggttatttgtatgaagatgtcaattttgggtgatagttctctgatatctgatcttccctaggttatgaatgtggagacttctgttgcaaaagtgggatttttcggcaacacataccagaagatctggtgcttgagccacattgaaacattaaggtagtttattcggtttgctttctctggtttggcaatgccatgtcatctgacttatatttcaaagttcaaataaataaataaggacaaaagtctaattgtgatttttgctgttgaattctcacagtacctgggactggaatgatgggagtagagaactgaatatagatgatgctcgttccttggcaactgataggtggaaccttgaccatgtgagtttctaatatttgcctttatacattctagctactcagcatttgttggcatgtagtgtggtatttggtaattgacagttttttttatattaatattagagagttatgatattcaaacaatcacacctcattagttcattgctttcttcatttggctcatggtacaaaaagattacagaacttcacgaaatgaatgatattgtagcaccttatatctgtaatcgtcttcatcaactaactccagaactagccaaattttagatatactccctctattcttttttacttgttgcttaggacattgacataatctccaatgcacttgtttagggtatatagagtgcgtgaccgtctttctttactccttgcacagttccactgtggagacactatagggaactctccattccagtcaccattcttgctggctacagaaacctattctctccaatcatggagccaatccaatatcctcatgcatcattttatgttgcaccctcttgtcattttctcatatgaacccaaaatttgcttgatctttatttttcacagcttactgaactgactatctcctctagatgccttgtcactgttgttgcaagtgttacattcccgtttacgggacctcactaccatagtgaaaaaccggaccggcctagcgtttgaaccggaaataaccgaaaccagaggttagctcggttcggttcaatagaaagaccggccatgtaatcgaaccggtttgaaccgcttgaaccggctggttttgaggtgaaacggacaataaactgctatcggttgaaccgggctaagacatgcgagagtgtaaatgggccacacgaaggcccatttagttcttcagcctaccaagacgattttttgttttttttgaaaaaatgccaaatcgctcacggaggagattcgacctttggtcaccaggttgtaagccggctgcgctgaccatcccaccacgtgcccttatgtgcaagtatcaaaagttcaaaacatataaactagatgaccttattaaaccgcggttcaaccgtccaacccgtcggttcgaccgctggaccggtgaaccgaggtgttcaccgggtcatccaccggtccggttttttcaactatgctcactacgcctccattgctgtccacctacttagtctaaacgtcaactcagcttttcctgctctctagattggttgatgtggcgaaacagagggattgctgccacaatgtgaaactacacgatgtggctgcccatgatgcttcattgtttaattagcgtggttggcaatgcaatatagcagtccagggaggcaaattacctagacaatttattctcaacgtctaattctgtttactatattttgtaggtggactattttgttgattgtcactactctctgcccgacgacaagttatgggtgattggcggcacaactgcagggacaataggttacttccctgtaagagctggtcttgaaggggcaataggttccgcggaagctatccttgaaggaggccatacagacgttgttagaaccgtatatccagccgcaaacactcatactgggcaaaacaggggcatttttggatggacaggtggcgaagatggtcgtctgtgttgttggcgctctggtgaaattgctgagatgaacaagtcttggatctctagttcattagtgtcaagggttcaaaagaaagctaaatgccgacaacagccatactaactgatgcgatatatgtccgacacatatgattaacaaaatacagctgttctcctatattaggaaggttgacaattgttaatccgtaatgtttcccttgtatgtgctatatagattattttcgtttcaaatgaagtaatggttgtgtttactaccttcgttccaaaatataacaacttctagctatgaatcttgatatagatatgtccagattcattgttagaaatgcttatattctttgagaatgtctccgtcgtctcttttttaaccttattgccctcacaactacctaataatctcctacaagtggatcgctgtcaattttacatttgatagggtcactaacactgtcatcgccgctatcgtgtgcttgttattgtcatctcctacaagtgctatcttgtggtaccgtttgtatctaggcttgcgcgtatagtattttctagcctaggaccaacatggtactgactttgaatgatttttcaactttacattatctgatttgagcatttgctattcatttagcacatatttgagcctacttgagctattactttgggcgggcatagtgaggtggcaccgggaggccacatggatggcccaaattcccccgagttgaatcggatgaccggtgcaagtgggagtggggctcgacaattggctggctgggtagcggcagcgcgtagccctatgatcactagtgacgaccaactggcacgacggcgcacatgggaagcggtgaaggtgggaaggagtgtgacggtgtgcttaccgagggaagaagacgatgacacggcacatgaggtggccggcagcggtcaacggcggtgagagaggtggcgcgggagtagacgaggagaggattctcaccgttcgcacgcgacgggtaggggagaagggaaggtggccgacggcggtgctcctccggacggggatggccgcaacctcgggaaggtgaaggagttaagggagagagaggagtcgcggcgcagcgagaaacgctagctggagattgagtttgcagcggaactcactagggagtgtgagaaagcaggtttgggccccgatttgaggttgtggatgggtggccaagctactgctaggcgcattttagcgaaaggtggaagcactgcagcctagcgtgatgccaattgctgacagtgagcagccagatgctacaacagtggcggtggttcggattggcggtggaagaggcactctagcagtgatgatgtgaacccgcgagggtttgtgtcccgatctttctatgggaggcggggataactcacttggatgaagaagacgttcacgacccgactacaaccatctaatgacgctgcgccttagcaaccaatacaacgtctgttgtcgcgagcttgtggtgcacaacaaccaggcaacgaggtcactcttcctgcaagcaatcgaagaacaagtagaacaaacactaaatgaatatgaaagtttcactatgaagaaatcacaatatggtggggttccgaagacaaacagacagacaatttagccaacacgcgcgctgaatgcaagtatcaagttgctaactctaataaacaaaaccccattgttcttggtaagagggggagaacgatcacatgggtgttggggttgttgacggtcgttaccgacaaatttcgaccatcaatataactaaaataatggagaattagctatgcttacaatgcatgtttatttccaaaataatatatttccgtttgtacttggagaataatatgttgcaggaatttatcaaataaaataaagataaaagttaagagacctcactcctaagcaagcatatggataaggagggcccacatatcagaagcaaccgccggaaaccgacttttaactaccacaaccgcctaagggacccacttgccagcgacttgccaaagctggaggcttgctgggccagcccaggttcggccgaaccttggcagctgcggctcccgctggccttacacgtggacgtccaggattgcttctcaacgatggttgtaatggcaaaatcgacatttcgtgtttctacaaccgtcataccagctctataaaaggaggagttcattcactctctcaacacactcaagcaagctaaagtcctcttcatactttagtattagtagtatagtactaagtggagtagaatagaatagtgttcggaagtcatcggagtcttcggaagagttttcggtatggctctagcggctcttgtaatctcttctgtaatactttccaaattaatggaatactcttctttatatatcttcggtactttacttagttggcaaaatttgttacaggacatccaaaaaagtgtaattagctaggagacaccgcaagaacgtgttccgctgtagggcaccacaaaaaactggtaattagctgctggacacccgcgtgattattttattatatctggaagaattgaagagtgaaacacatgtgtaagtacgtttctaccctttgattttttttctttttttcttcattatccttttctccctctctcattctttcccgcgatgctcaccggcgccgtgcgcgccgacgacgtcgacgccattgcgctggtcgccaacgacggcaccgggcgcgtgagctggtccggctgccgtgcggcgctgctctaccggtgatgctcggggcgctcgagtacgaggtgttccatcaatgccatcgcagcggtaccggagcaggctccaaacatctcgaaacatcaaaaacctaagctcgctacttggcgagctccaaatccacctgtgtaactcaaaacgacgcacagacagagcagctagcaaccggagcaaaccaaacaatgcagctgcgactgcgagcaagaggggacatgacgcggtgtagccgccgcctcctctgcagcctcttcctcgccgctgcggcgctgtgcggcgtcacgtcagccgcggcgccacgactgggacatcacctaccagttcacgtccccggactgcgtccgcaagctggccgtcaccatcaacggccacacgccgagccgcaccatcagcgtcgtctagagggacagtatcgtcatcaacatcaagaactcgctgctgacggagaaagtcgccatccactggcacagcatccggcagatcagcaggccgtgggcagacggcatggagggcatcacccagcgatgctgttgaggagtgcgctgtcaacgccaccgcagccgctgtgccactcagggtgtgcggttgcggccgtttcgatgcctacttctcgcggaggctagcgagctgcacgctcgatggcgccgacgtggggttcaccacttcacctacgatggcgacacgagaaggacatactcatagtggggcccacattggattaatttgagccaagggcaaactggtctttaatgattgtttctctctcctatccctctaaaaataataaaataatcccgccggtgtccagcagttaattaccagttttgttatgatgccttacagcaaatacacgttcttacaatgtcctctagctaattacatatttttcggacgtcctgtagcaaattttgcctactttgtttaagtactagtcttattttatatctgtattgtgttaattgtgtgggtagcctaccagagaggtgtaatggtgcgggtttaatgtctaatttatcagttactctatgtctagcatgcgggtatagagtagtatttaataatgtaagtatggtgcttagattattaagcataattaattaggtatatatgctacaggacagtagaggtgggccgctgatggtgacagctcagtacgggtattcctccttgttagtatatatttctaagacaatttcctggggagagtactcatccgtatttagccccggttggactaccatgacaggttgtcttaagaaattcggcaacccaaggtagtctctcaaagtatcaggaggacactgttagggggtatcggccacataattgtacattaacagatgtaagttaggatttaagtgtatactagaagtataggaattgagtgctttctatttcttcttccacttagtagaattattcgttatgaggattggatagctttgcttcgtgtcactctacccttatattatacttaaaccctgtttaggctctgacaattataagtaatatatgtataaactgcattagtaaagttcactcttattatctttccttgggataaaaaatacgatagcttgggataaaaaatgctacaatggtatatccgtgcgcttgcggattatttctgtaactataaatataccaggactatttctggcgccattgctggaatgactatttttagtaatgtagttaagaaataccaatacggaccgcggcagccgatgccgtacccgccaacgccgagtcgctcccgtcaaagtcaagctcgggcagccccttctatgtcgcgtccaacccatcctcctccctcctccccgccagcggggtgggaaccacggtacaccgcgccgaagctaccggagccgatgcgttgctcggccagaagcagccggtggcagcgcggagtgccaccatcgggaacagctccaccgtcgtgttcgggcccttggagagcagcgcgctgagccgccgctccacacgcggtgtcgtgtcgtcggctcggcgtggatgcgcccgaagactggtgagctgcttctccaatgccagcccaactcgtcttctttaaccgaccgaagggtattttggtcagaccatgtgtggaaaatgatgaaaactttataaaatggtgaatatggcaaaaccaaatgtttggcattcattgggagtggcattttaacgatactgatgaaacccactctttacagtggcgtaatgtccaatttgtcgcgcacaagaagcgagaagcagagaaagaaacgagggggagagagcaagagaagataccgacaagaggaaggaaggataagagagagaagaaaataaaaagaagaaaagaaaaagctgtgggacccaccggtggggcctactgtgttgtgactcctcgggaccttgacgctgccgaaaagtctatttcatctccctattacatcccctgccgagcccacttgcggcctctttatccactacaagttcatactacatccccttacaacccgagttcctctctgtaagtttgaaacatctccctaattcttctttaatcccactgacagagcggcctcacgaagaatattcattgaaaggaaaccttttcctcggattattaatccgtataaccttcggaaattcatatcttgcaaaccgtgactccgattgactccgttcaacttccggaattcttttaaaatcgagatatatccaacggcacttctggtttgaaatgtttggtaccttatttggaggattttgcgtattaactgcgtatcggatattgcggatattcaacagatgtggatttctcgaagatatcgatttctaaaagcaaggcatgttgaacccatgttacaaatgctttgtttataaataaagttgcatgctaatttccttgatattgttacctttatatatatctttgttgcccgagtctatttgttatacgtggtcaaatattgatattgcttagtactgcttatttatagacgattgtacactccatactagttggatatgaatgtgttgggggtggtcacttgtcgagagtgattgccaaagaaggcgggtggagacatgagcgccactcgcaggccgcagcacaaaaagctttgcgaaaaccaaaaacctaataaaacaaatgttttcgactggggcggcacgaatggaatatgggtggttctggaaacgactcggcgcaggccctggtcagttaaggaccaattcaagaagctatgcaggagatgatcagagtacgaccacacttctcgagtgggtatagaaccggtggactaagaaatcctcgtggggcagcacccctatcatggtggttctgcacttgtgatgatgtaatgttgttgcagtgtggtggattggtttggttatgctggcaaaacttaaaacacacctaacctacatgtaatgtaacttcttgtgatatcgggagcgccaggactcccctcaccttccgactcgaggtagggttgggcgtcggggtgcaatgggagttcatagtccttggagtgggtgccataatgcgagggtttactgaaaaactgggccgtgacacgtctcatttgttgggactaggctcattcgttaggcaagtcgcggagtgcaggattaaaagcgtacatccattgcagtgtgagtaaatcaaatctattcgaatagccgtgctcgcggttaatgagtgccgggacttgtactactcttgattagcctcatagattttaatcttgcttagattgagaatgaagtgtgactttgctcgttggacaggaaggtggaccggaccaatcgaggcttggggaaggtggatgaaccctcacggattaatgacaacatcaacttaatgttgtttttcacttaaaattgctaggtcataggtttgtgaaatgaattgtgaaaactagctttatgtaaatataccaagccatccttgaacccctgtgtgcactaaatgcatcctgtagtagtggcttgctgagtaggttggtactcacccttgcttaactaaatcttttagaaaggagttggagtcgaccatacgggaacaatgttgatgaagagatattgaagacggtggagtcgggacctaggttcaccagtcgatgcctatggagtacgttggaccgccgctgcttcgcttccgttatctcatctacttcttttggtattttgtaatgtatatgaccatgctcggtctatttgggtcccatttgggttatccttgtattattaatgtatagtttaacctgtataatgatgtcagcttttgatatacaactgtgccatgtgtgtaccatttactggtccagggaatggtattgtaaaacatatggggtttccggtgcataaaatcgagggcccacaagcttggtatcagagctagacgactgcaggacctaaggacccttgcgaccacccttaagacctaggatcagctaagcgtagcctattacacataaaccacatattttcaaaacctattttgataaaaccttagattcttactactctcccttctcaagtattattgaaaaatttcttttgataaatctcgacttatccccagtattcgaatactcctatacagaccataaggattaaggttgaagagatagaaggtatgctagagctatcctaaccactgactgaactgactaaaaacgttagatgtgtgttgtagacgttgtattaagccgctcactagtgcgagttctcgcaataaggggcagcgatccattatttgtgtattgttttccttgctatgtagctgccaccttttgggcaatctttgtgggttagtttctcatccccttttcaaactcaaatccttatctttcctcccggtggattctttccccaattttctaaatctggtgctgcttaagataaaggacaaccactaacaagtgggcactcagaaccagctgcaccaagatccaaccaggcctaattatgattagctgaccgcgaagaagccattcgtatgcttagcaacctgaggcaacagaagcatgggaccaacatgaagcttcgaccgtaaggaataaggaccagcacagtgtctgaccgttcaaggaccccggaagacctggaaccactgtgtgctgacggcactcgtgggaacgcaacaggaaccctgatcgacaggatctacaggaactctgactgacgagatctacagcagagcactatccattaccagtaaatgggaccgaccataccacaggataagcactggagctactgaccttatcacaggagccccagtggttggtgcctataacaggagccccaagcgaccctgagaaagtgcaccagtcctcccctcccctctcctttgaactaagctagccagaaaaaccctagctccatggtagacctcgcagtaaccatggctgcgccccctccagaaccacctcagcaaccacctcaggtactcccttaggtgtgtacaattgggtatgcctggcagctgggtcagctgctccagcacctcggtttcttttctgggccaatctatcgtggcgagcaaatcgtccggggatcccagaagtactggaaggtgaagctcttcctccccttccccagagaggaagagaaagagatgatcatgatctctttccagactcgtcaccctcggatcatcctggacgccgccatcctacgatgtgtcccgtgacaccctgtatcgattctgcaagctctccgtccccctaggtatagtcaatgttttgagcttgtacccattccgctccgaggacgacaaccgataccacctccgcttcaccggaccagcccaagaaagtcggtgcaccctcctctccgagctggcccgcagcatcgaggatgcctacgagcaggcactcgaggagctggacgagcttcgagagcagtacatggatctggaagcccgctaccagaagatgaatcgcaggaacacctccgccctagtcgcacaggcaagcgttaagtccggtatgatccaatcccacaggttgggaaggattcgcaggaagccccccacttccggtcgatccacttgcgcctccaccatctctgtgagaaaggctaggtgtgtgagcccctgttgggtgttcgttgttaagcttggtagcctctctgtcccccttgatatgtatctcgttgtgccctgatgtgagatgaaatggaatggaatgaagcctgatggtccgacatgactctatgtgctgcttaggtcactgaacgggttctttccgtttgtgctccaggcaaaccttacgtttctcgggttctttgcaaattccgggtgtagtgcatcaaagtttttccactgtcgagcatcggcagggtgttgaatcttaccgtcatttttcctaccctcctggtgccatctcatcaactcggcatcggtacggttcgaaaatgtcacaccctaaaaatcctaaatttataaactattgtttaaatggaattattagaaatgattttaaaagcctagaagaaaagatctaattttaaataacaaattccaatataaaagtgggctagataaaattttattaaatacttctcttgattctatagttcctagatttttctgggatttatttgagccaaggaagtatttttaacaaatggaattgcatttcatgaataatttaaatagaaaaaggttttaaaatccctcttatagctttgggccgaaagtcggcccaaaacccctctctctctctccccggcccaagcgcgcctcggtccagtccgcccgccgagccgagctgccgctcgctctccactctcccgttgacaggtggggcccacctgtcagggttgtcgtcttcctcgcgccgccgcagctgcgccctagccgtgcaagccgccgtcgcccccttccaaatttcgtcgcccctttctcgatccggtcaaattggtagaggggaaatgatccccttgatctcctctatcttttcccctatagaaacttcatctaatttcatttggtaatcgccggattcgagctcgattcggattcgtttttcttcccgaaccctaaactttccatcgccgtcgccggccgccgtgggcctccatcgccgcccctagcccctatataaggacccccgggacctcctctatccgccgccaccctcgctttagctcgccgccgcttgtagcgcaacctccgcgtcaagccattcgccgccgccgccggagggagtccagccatgcgctgccgccgctccggtcattgtcgtcgctcgggaaggtcaccgtcgggatcgccaagtcaccgccgtcctcgtcccgccctccgttttcgccgaagaccgccggagcaccgccgtcgtcgtcgacccgaacgtctccgccgtttcaacctcgccgccgtcgccgtccgttgccgtccaccgtcgtccaagccctcggtgagttcgccgcgtcgcccgctacccattagtgccctccgtttgcgccgccgcgccatcgttccccggcgagcatgaggtgccgagtcgccgccggtgatgatgtcaccgctggcatcagcgccgcgtcatccgtagacccgcggtagaccgattcaatctcggccgtccgttttggattaggttagatctcggacgtccattccgtagaccgtcttcgtgcacccggtccaccataaacctgagccgctgacgcaataactcctttttccttttcaaaaataattctttattgcgtcataattcaattaaaatctatataaatgatttaatccgatttaatctttaaaaattcataactaattcatcttagctcggatttagttggttcaagtctctaaatttttctaaaagtgagatctacatgttaaaaatatccacatgtactgttcatgattgtttatgtgctgttatggtgattttgatcttttatgcttaggttccgacgttcccggagagtccgattttgcaggggaagattttgaagaattccagggccagcaaggcaagtcacacagatcccaaacgaccctttgagcatgttgatcccgtttaaagctattgtttctattcaactattgcatttatttttcaatgtcattgagtggaaataacctattgcctttgttatatccttttgattattgattacctattctttgtcacttggttaataattggattagctagaatattatatggttttagctaaagtgctagaatgcttagccatgcttagagacactagctcgtataaatggggtatcttatgattcactattatttaatgatggcttaatgatagctcacgatggttgatcgtgattggttaattaatcaatttgccaactaaaacctgacaatggtgggttgtgagcacatggttttgatggtcatgctcatgacaattaaggaccggttcacgattttcggttgtgaaacattaaccgtgccaaccacaagccagcatgggcaacggctttactttttgtatagtatggttcactgtagagcaccagactgtgaagtggcggagataagcccacaggggtcgctggggagtccatgccttgtttataagggggtgattatgatccaggaacggagcactgctttgaattgtgttatgcagagggtattatgacaatctctattcgggtacttgttaagtatcgcgacgcatggttgacatgatgttgaggttgtgtcttgtgggtacagtggtatacctctggccagagtaaaactattcgaatagccgtgcccacggttatgggcgggtgtaacaatgtttttcgtgattagtttcacacctctcaccataataaatgatgttgtacttgataataatttgtttaactcctggcttggaatggtatattcctggtttggagatagaactgtgcagccgggattggttgttcagaatggttgggcctatgcaacgggtatgttgtatagagatggattaatattgcttaattaaatacttttctgttttattaaattctgaaatatttattaaatgccatttatgcaaatgagactatattatgccatcctttgttatcccttgcacttgcatatttgctgcgtggcttgttgagtatgtcatatactcaccttgcaatcattcatcagaggaggagttctacagtgatgccgaaggtgtggaggattaggcgtagccctagtcaagctgcttgtggaatggagtcacctgcgccgtttatcttattttgcactacttagaactttattgtttgagaggaattatctacctctgtaatgactttatgttcgcttattaattagagtaataattgtactctattatcaatttgttattgtgtgccttggctgattcctggacgatggtttacacacatgcaagcgtttggaattttggatagaaattccgggcgtgacaatacattagaccaagttcgtctccatggggagctccagtcatttttgtggaaaagaaagatcatactgagaggatgtgtatggattatcgtgcactaaatgatgtgactatcaagaataaatacccactgcctagaattgatgatttgtttgttcagcttaaaggagccaccgttttctccaagatcgatcttcgatcagggcagttgaggattaaagaggaagatatacctaagacggattttaccactcaagatgggttgtttgaatgtactgttatgtcttttggacttaccaatgcccccgctttcttcatgaacttgatgaataaggtgtttatggaatacctggacaagttcgtggtggtttttattgatgacattcttatctactcccgaaccaaagaagagcatgaagaacaccttcgccttgcactagagaagctacgagaacatcaactgtatgccaagtttagcaaatgtgaattttggttgtctgaagtaaagttccttggacacgtcatctcagccggaggagttgccgttgatccgagtaatgtggaatgagtaaccaactagaaacaaccgaagacagtctccgagattcatagtttcctgggtcttgcaggctattaccggaggttcatagagaatttttccaagattgctaagcccatgacacaactgctttagaaagatgtgaagtacaagtggtcagaagaatgtgagcagagttttcaagagttgaaaagtcgcttaatatcaacacccattttgattttgcctgatccaaagaagggtttccatgtgtactacgacgcatctaagcttgggttaggttgtgttctgatgcaagatgggaaggtggttgcgtatgcatctcgtcagttacatccgcatgagaagaactaccctagtcatgaccttgagttagccgcagtggttcatgcgttgaagatttggcgtcactacctctttggtactcgtacggaggtgtacacgaatcacaagggtttaaagtatatctttactcagccggatctgaacatgagacagcggagatggttggaactgattaaggattatgacatgggaattcattatcacccgggaaaggctaatgttgtagcagatgctctcagcaggaaaggctattgcaatgctacggaaggacggcggttgccgtgggaattatgcaaggaatttgaaagattgaatttgggaattgtcagtagaggttttgttgcagctttagaagcgaagcccactctcattgaccaggttagagaagctcaaatcaatgatcctgatattcaagagattaagaagaacatgagaaggggaaaggctatcgggtatttggaagatgagcaaggaaccgtatggttgggtgagagaatttgtgtcccagagaacaaggagttgaaaaatgcaatcttgaaggaagctcatgacactttatactccattcaccctggtagtaccaagatgtaccaagatctcaaggagaaattttggtgggcaagtataaagcgtgagatagcagagtatgtagctgtgtgtgatgtttgttagcgagtcaaggcagaacatcagaaacccacaggtttgctgcagcccttaatgataccagaatggaagtgggaggaaatttggatggatttcatcactggtctacccagaacgtcatcaggccatgactctatttgggtgatagtcgacaaacttaccaaagtggctcatttcatccctgtgaggacaacatattccggaagtcgtttggcggaattgtatatggcaagaattgtgtgtttgcacggagtgcctaagaaaatagtatccgatcgaggtagccagtttacttcaaagttttggaagaagcttcaggaagagatgggttccaagctgaacttcagtaccgcttatcatccgcagacagacggacaaattgaaagggtaaatcagattttggaagacatgttgagagcttgtgctttagacttcggtggaagttgggataagaatctgccttacgcggaattctcatacaacaacagttatcaagctagtcttcaaatggctccttatgaagcactgtatggtcggaagtgccgcactccgctgttgtgggatcaaacgcgagaacgtcaggttttcgggactgatattctgagggaagtagaagagaaggtaaagatcactcaagagaggttgcgtatagctcagtctcgtcataagagttatgccgacaatcgccgcagggatttaagttttgaggaaggagatcatgtgtaccttcgtgtcatgcctctttggggggttcatcgttttcacaccaaaggaaaattggcaccgcgttttgtgggaccttataagattgtcagtagaagaggtgaggttgcttatcagttggagttacctcaatgcttggcaggtgttcataatgtgttccatgtgtcatagttgaaaaagtgtttaagggtacacactgaagaagctaatcttgagcagattgaaatccaagaggatttgacatatgttgagaaaccaatccgtatcctggagacagatgagagaagaaccaggaatcgagttatccgtttctgtaaggtccaatggagtaatcactcggaagaagaagctacctgggaacgagaagaagaattaaagtcagctcatccgcatcttttcgccagctcttccgaatctcgaggacgagattctgtttaagacggtaggtttgtcacaccctgaaaatcctaaatttataaattgttgtttaaatggaattattagaaatgattttaaaagcttagaaagagaagatctaattttaaataataaaatccaatataaaagtgggctagataaaattttattaaatacttcatttgattctatagttcctagatttttctgggatttatttgagccaaggaagtatttttaataaatggaattgcatttcatgaataatttaaaatgaaaaaggttttaaaagtcctcttttggctttgggccgaaagtcggcccaaaacccctctctctctctccttggcctgcaagcgcgcccggcccaagtcagcccgccgagccgagccgccgctctccctcctctctccctctgacaggtggggcccacctgtcagggtcgtcttcctcctcccgccgcagccgtgccctagccgcgcgcaagccgccgccgcctccttccaaattcgaccactcttttcccgatccaatcgaatcagtagaggggtaatgatccccgggatcccctcttccttttctgttttggaatcttcatctaatttcgtttggaaatcgtaggattcgagctcgattcggattcgtttttcctcccgaaccctaagctttccttcgccttcgccggccgccgtgggcctccgtcgccgccccctagcccctataaaaggacccccgggacctcctctatccgccgccaccctcgctttagctcgccaccgcttgtagtgccgattccgcgtcaagtcgtgcgccgccgccgccgaagggagaccagccgtgcaccgccgccgctctggtcattgttgtcgctcaggaaggccaccgtcgggatcgccaagtcgtcgtcgtcctcgtccagccctccgtttccgccgaagaccgcaggagcaccgccgtcgtacgccggcgagcgtgagttgccaagccgccgttggtgatgacgtcatcgccgacgtcagcattgcgttacccgtagacccacggtagaccgattagatctcggccatccgttttggattagattagatctcggccgtccgtttcgtaggccgtccgttttttggtgattttgctcttttctgcttagattccgaccttcccggagagtctgattttgcaggagaagactttgaagagttccaatgccagcaaggcaagtcacatagatcccaaacaaccctttgagcatgttgatcctgtttaaagctattgtttctatttaactattgcatatatttttgaatgtcattgggtgggaatgacctattgcctttgttatagcctttttggttattgattatctatcctttgtcacttggttaataattggattagctagaacattatatggttttagctaaagtgcttaggatgcttagccttgcttagagacactagctcatataaatgggataacttatgattcactatgatttaatgatggcttaatgatagctcacgatggttaattgtgattggttcattaattaatttgtcaactgaaactgataatggtgggttgtgagcacatcgttttgctgtcgtgctcatgacaattaaggaccggttcacgattttcggttgtgaaacattaaccgtgccaaccacaagccagcatgggcaacgactttactttttgtatagtatggttcattttagagcaccagactgtgaagtggcggagataagcccacgggggtcgctggggagtccatgccttgtttataagggggtgattatgatccaggaacggtgcactgctttgaattgtgttatgcatagggtattgtcacaatctctattcgggtacttgttaagtatcacgatgcatggttgacatggtgttgaggttgtgtcttgtgggtacagtggtacacctctcaccagagtaaaactattcgaatagccgtgcccgcggttatgggcgggtctaacaatgtctttcgtgattagtttcacatctctcaccgtaataaatgatactgtaattggtaataacttgtttagctcctggtttggaatggtatattcctggtttggagatagaactgtgcagccgggattggttgttcagaatggttgggcctatgcaataggtatgttgtatagcgatggattaatattgcttaattaaatactttactgctttattaaattctgaagtatttattaaatgccatttatgcaaatgacactatattatgccatcctttgttatcgcttgcatttgcatatttgctgcgtggcttgttgagtatgtcatatactcaccttgcaaacattcatcagaggtggagttctatagtgttgctgaaggtgtggaggattaggcgtagtcctggtcaagctgcttgtggaatggagtcgtctgtgcgtttatcttattttccgctgcttagatctttattgtttgagaggaactatctacctctgtaatgactttatattcgattattaattagagtaataattgcactctattatcaatttgttactgtgtgcctcagctgattcctggacgagggtttacacacatgtaagcgtttggaattttggatagaaattccgggcgtgacacaattgaagatggagagcccaaattattattttgagggcatcgtggtgggttcaaacgtctacaccaaggatacagtagatgatctcgatgacaagcaaggacagggtttcatgtcagctgatgatttggaagaaattgatataggtccaggtgatagacccaggccgacattcatcagcaataacttatctccagaattcagagccaagctgatagagcttttaaaggaatataaagattgcttcgcttgggagtattatgagatgccaggactcagccgatcgattgttgaacatcggcttcctattaaaccgggggttagaccataccagcagttgccgaggagatgcaaagccgatatgctcgatgctgtcaaggctaaggttacacgtttatatgatgctggttttatccgtccatgccgatatgctgagtgggtttctaatatagttccagttatcaagaaaaatggcaaggtcagagtgtgcactgattttcgggatctaaacaaggctaccccaaaggacaagtacccaatgccggttgccgataaattggttgatgctgcttcagggcttaagatattaagttttatggatggcaatgcgggttacaatcagatctttatggcagaagaagacattcataagacagctttcaggtgtcctggtgcaattggcttgtttgagtgggttgtgatgacttttggcttgaagagtgctggagctacatatcagagggccatgaactacatattctatgatctgatcggctggttagttgaagtttatattgatgacatggtcgttaagtccaaggaggtagaaaaccacatagccgatttgaggaaggtttttgagaggactagaaaatatggcctgaagatgaatccgacaaagtgtgcttttggagtatcggctggtcagtttttgggatttcttgttcatgagagggggattgaggtaactcaaaggagtattaatgcaatcaagaagattcaacctcaggaggacaagaagaagttgcaggaaatgatcggcaagataaattttgttataaggtttatttctaatttatctggtaggttggaaccttttacacctttgttgagattgaaagccgatcaagaattcatctgggggctaaacaacataaggctttggataatattaaagaatatcttagttctcctccagttttaatccctccacagaagggtatacctttcagattatatctatcagccggtgagaagtcaatcggctgagttttgattcaggagcttgaagggaaagagagagctgtattttatttaagccgcaggctcttggatggagagacaaggtattctcctatggaaaagttgtgtttgtgtctatatttctcttgcacaaagttgaggcattatctattatccaatgaatgcgctgtgatatgtaaggccgatgtggttaaatacatgctatcggctccgattttgaaaggaagggttggaaaattgatatttgctttaacggaatttgatcttcggtatgagtcaccaaaagcgattaaagaacaagctatagccaattttattgtggatcatcatgatgactcaatcggatcgatcgatattgtgccttggactttgtttttcgatggatcagtgtgcactcatggttatggtatcggcttagttataatttcccctcgggggcaagttttgagtttgcctatacaattaagccctatgcaacaaacaatcaggctgaatatgaagcggttctcaaggggttgcagttgcttaaggaagttgaagccgatgcagtcgaaattatgggtgattccttgttggtgatcagtcaattggtaggagaatatgaatgcaaaaatggtacgttgatggtatacaatgagaggtgccgggagttgatggatggatttcggctggtaactttaaagcatgtatctcgggagcaaaatgttgaagctaatgatttgggggatgctatacaactcgttcaagagtatattatttaccgatttgggattcctcaaacaattacaaccgatcaagggtctatctttgtgtctaatgagtttgttcagtttgccgatagcatgggtatcaaaatgttgaattctgcgtcgtattatgcacaagccaatggacaagccgaggcgtctaacaagagtttgatcaagttgattaagagaaagatttctgattatcctcggcaatggcatactaggttggctgaagcattgtggtcttatcggatggcttgccacggattgatttgaggcagttttaccatgggaacagatttgcagaatgagtggtcagctaatgaatattataatctcatggccgatgagaaggaagatttggttcaatccagattgagagctcttgcaaaagctaccaaggataaggaaagggttgctcaacattataacaagaaggtggtgcctaagtctttttctgagggagagcttgtttggaagctaattttgccgataggaactcagataacaaattcggcatgtggtgtcacgcccggaatttctatccaaaattccaaacgcttacatgtgcgttaaatcctcatccaggaatcagccgaggcacacaataacaaattgataatagaatactatcaaacagctaattaatattcgcaaaataataaattattatagaggtggatagttcctctcaaaagaataaaattctacgcagcggaaataaacataagactaaacagctatggcgactccactccacaagcaacttgacccgaacaaagcctaaccctcctgatcatcaccttcactaaagtactcctcctctaatgaatgaatattgcaagaatgagcatatgacatactcaataagccacacaacaaatatgcaagtgcacaggataacaaagcatggcataatacagctcaattgcataaacaacatttaataaacatttgagagaacagtaaaacagttgagtaattaagcaatattaaatgaacactatacaacacacccgtgttgcataggcccaacctcacctgaacaaccaaccccggttgtacaaatcaaacctccataccaggaatataccattccaaaccaggagtcaatttagttatcacaaactatcaccaataatgagtagtgtgagactaatgacgaaaaacattgttaaactcacccataaccgcgggcacggctattcgaatagttttactctggccagaggtgtaccactatacccacaagacatagctccacaacatgtcaccatgcgcctcaataccaccatgatatctcggataggaactgtgacagtaccccttacacaacacaatccaccacagcgcaccgttcctggatcataatcaccccctcaataaccagaggcatggactccccagcgacccccacggacttctcgccgcttctcagtctggcaccccgtaatgaactattctatacaaaaggtaaagctgttacccatgctggcttgtggttgtcacggttaatgtttcacaacagtagctcgcgaactggtccttaattgtcatgagcacgaccatcaaaaccatatgctcacaacccacctttaataaggttttaattatcaattaattatcataacatgattaaccatcgtgagctaccattaaatatataaacataaataataatgtaatatgattcatcccattgatgagctaatatttctaagcatggctaagcaattatacatatagcatttagctgaaccaaaccaatatataaggttctagctaatcaaattataacccataggaaaataaagtcatcttcgaccattaattaattgggaaaggttcaccacccgatgacattcgaaaataatgcataagttaaaataaaacattagctttaaacaggttcaacatgctcaaaaggttgtttgggatccatgtgacttgccttgagcttcttcaaacgcttctgaaccttcctcaacgaaaacgctctcctccagaacgtcagaaactaaagcaaatgaacaaaatcaacaaaacagtacaaaaacaagcataaacagaacatgtggatatttttaacatgtagatctcgattttagatgaatttagcaacttgaaccactcgaatccgagttacgatgatttagttatgaatttctgaagtttaatcagattttcatcaaatacagaaaattattacgaattaaataaaagatttatgacgtcattacgacatcatcgccggccatggtgcgggatgacgcgaccaccggtggtagagggctcggccgggctatccaaggacacctacgcgtagaggacgacgacgcgaactcaccggtgcaaagaacaacgacggacgacgacgaacaacggccggcgacgaggaccgaggacggcgcggctcggctcgacggtggcgacggcgctctggcggcttgcgacggcggcgaaggggttgccggggtactcctcctccgcacgcacccgacggcggcaatgggaagcggcggcgacggctacagcggcggcgcggcgcggctggaacggcatcggcggcggcggcgactagttcaacgcggcggcggtgctatgggcaacggcgacggctaggacttcgggcaaacagaagaggatgactaggggatgctatttataggcttggattagagaaatcggactccaaacgagaggaatcgaagccggaaaatcctagggttaggtggaaagataaactcgaaatcgagtttgattcggataaaatacgaagcaattagctccaattcttggggaaaggatagaggacaacaaagggataaaaacccctcaaccaatcggactcagagatggccggttggggcggatttggcggggaacggcggcggcttgggctcggcaggccggctggaggttgaagacaaccccgacatgtgggccccacatgtcggcggctaaaaggaggggggcggtggcggctcggcttgggccggcttgggccgcacggccgcgcgcgaggaaaagaggagttgggccggaaacggcccaacggcctagggaattttaaagactttttcaattaaaataattcgtgaaatgatgtttcatttattaaaaatacttcccttgctcaaataatttccaaaaaaatctagaaaatagataaacaagcaaagtatttaataaaattttatctagctcaattttatgttgaaatttttcctagattattagagtttaacttgtaagcttctaaaataatttctaaaaatgatttaaagaatgaattattaaactaggcgattttcatggcgtgacaagtggtcaccaaattgggaaggaccgtttcaaatccataaggttgtgtccaaaggagcttgtatgttgcaagggtttgatggagaagtttatggacgagcacttaatgacaagtacttgaagaaatattacccaagtgtctgggtcattgcatgatcggctaagtgttgccgatgcatgttagccgatgtatttagatcgccttcagatggccgatatagttatatcgcccttagttttgttatcataatcggttgtgtcttgccgatgtatgacggccgatatggttatatcgcccttagttgtttttctgtattattataatcgatggtgttttgccgatgtatgatggccgatatttgctatatcgcccttagtacaagttataattttatcaatgccttcgtcattgcaaaattaggggggcagatatatgaaaaaaaaagtggattttcaacgcgaaaattatattaatcggcagatggattaagagttagactacaaatagccgattacaaaaatgagtttcaagctaagtcttattacaaagccaatcatttagagaggtattgcaggatagccgatataggtcattgtctaatttcctctacttcttggatgtcttgggcatcggttcctgggataaccttcacagacttggttaaatcagcaacatttttgatggccgatttaagtcatgattttttctcttcgattgcttttgggagattggctagcttctgtgtttccaaggccaatttagcattgcattcttcaagttgtgccatgagatcaatctttcgggcctcaagccgatctatgttggactggatcggaccttcagataatttatcaagcttggacttctcttcatgcacgagttgccgattggcttggattgtggcttcgatgtccttccgctctcgccattcgggtaatctttgtttagttttttctagcttgaattgatgttgctcgaggtatgcagctggagtgatggtgttcgaaagatcatccgggatcagagcgtgaatttctcgaagtcttgcccgaatggaaccacaatcaaccacaaaattgtttaaagatgcctctagccgatgagatatatcttcaagagttcttttgacatcttcgtctagaggagctagggtcttgcttgttgtttcatcttttgcctcttgatcaagataatccttgatatcaaaggagaacatatcagctaatacctgcaaaagtggaaattgaagataattgaatatcaaaatatgttatacagccgatctgggaatttttagaatgagacttactaggatggcaggagctgctggttcttcttcttcctcaatgttgtggctgtctatagccgatggactacggtcacttgacatcagctgtacaggaggtgaaggaggaggacgctaaaagagacaagtgttaattatcatcggctacgagcaaatttaaaagattttacagaagaaaccttaccgatggaacctgtttagatggtgctagtgtcaatttcttcttcacagtagttttctttttctgcaaatacaagacttacaaataatcggctctacaattttttcaaaaaggtgatcaagatgagttatttaccattgaaaagtgggctggagaagcaggagttggaggagtctgtttgggtaaagccgatggtgttttttctcctaagtcactcagttcggttgccgcttggtcaacatcttcctcgatttcctcttcatccaaggcttgttctatggacgggtctatggcaggcaaatcattggtttgcttggatttcttctttttggcctttttctttggtgctagagttgatgaatcaatagctgatgccttagttttcctctttttgccaacatcggccgattctcccagctgcccttggagtaaacttgaggtcctggggcatggtagccaatgacagggggagctagtccacctccatttgggataaggcctggagcatattctatatccttgccactattgcttttgcgaggaggacaggattctgttgtctgcaaaatagaagaagagattagtcaagatatacctgagggatgacatccgggaatagatctgtcatgtacatggaagccgattgttggaacaagtgttgcttccattcaccccaccatctgtcaaagttcctgctcttgaaccttgctagctctatattttcaatgctgcccaaaggaggtcctgggatgttgagcagccgatccatcatcagtgttgatgagatttctcctctgcattggatcttatcagtgaagtacaagccgattgggacctgtcccatcccaaactgcctggccgagctcattgggtgatagaactcataggatacttgtatatttcttccttgatgaatgccaataggaagaatacacgggctgatagcagctgaaaagacttctctagacttatcgtacttctcagagttgatttcttcaaaccggaagtccgatggtagctcaaagtctactgtatcctcatatgcgaactagactcgagcatctttcttgaagccatcgtagaagctagagaaccagtccttgagcagttcagctgatagctttgctccagaattggctggtgttgatgcaacttctccataggacatgcatctgcgatgagttagttctcccccatcttcattggcgatcggctttagacttggaaactaggactctgatagggctggctgattcacagctttcatgacgactaagttaagccatgtttgcagtaaccaccatggtccacttgcagctactatcgagcttgtggctattttagtcgatgcgttgttcaacatctgatacagatagccgaggaggattttgcctaaacagatttgtttctttgcttcaaggctttcggctaagaactgccagttggtggtagggccacaactcgatccacagaacaggaatttctcaagccacattagcagaaaggttgtgtgctcttggggggtgacagatcctttgcccatgtttgcagcgacatagccagaccagccacctatggtttttgttttaaactcaaactggttcttggagttcagggtcatgggattggttgaagaggtgacatctaaaccagtaatcatgatgacgtcaagcagagtgggggtgttgacagaaaacacgaggcctgggagatctgcttaactccagtgcaggtccaaacctcgcctttggatgtataagcgtgccagttgatttgattctgtaatcaacaagaaatagagacaaatagaccgcggttaaatctataaatgatagccgatcggctaggtgccaatgacatatcatttatctttgagccgatgtcatatgtgaatcgatcggcggttgtaaatagacaataaagaactaaatatattcgatcggctgtagatattaacaatatatagttcttatatcgatatatacttaaatcaagtgactgggatagatcggttgccatgccgagacagtataaatcacttagatcgaaatatatattaataacagcattatatatgtttatagcatagccgatcagatagatctagcatgtatcggctaatactccgatactactctatatcaagatatcaaaacaagtataatatatcaaacaaaagcctaatatacttaaatgcagtaagatcttgacgtaaagggtggatttaacatatcaatgaagcatatagagcgaatatggttaaatcagataagatcggatgaaactctgatactaccctaatcagcaaccagaaagcaggctagagattgaaactctaagcacgacttaatagatcaaactcaactgatgcagcattaagtatgaaaagaagaacaatatatagacaatcaagccgctggatgtttcataaagtggtagatatcttatataatctacgtcaacgccgctatttaacctaatcggctgccttctgtcgacagatgctagccgattgtaggttagatgacgatattgtcgaagattatgtaagatatatgataacttgacgaattacatagacaagattagagtatcgtaaagatggaagcacttatccctagaacacaatccatcataacaagttttaccttttgttgaagatcgaaaccaacgcagctcaacccgaaagcaagaactcgtcgaaataaaactaaagcaaaaggtggcgatgcgccgaaattgtattgaacgtgtgtgtgtttaaaattacatagggctcaggtctatttataccccagaattacaagacatgtccataccagacacgactattatctctaacaaactctaagataccataagtctttgcggcagacttttgcccaagcatatctctaaggaaattacataaaatatcctaattaatagatacaattgccttctcaagactctatccatgcgcggcaatcatcttgaaccacctcaattcaacccaatgtcatacatcaagtcgtattgtcggaatcggctgcatcggcttacctagtccaactcagacccagccgatcctaatcatagccgatctggactccagccgattcctactctgttttcggattcgatctccgccttcgacttcacttcgatctaatcttctttcccgatgccgatattaccaaatttggttgttaacagggggtcatcggcccttgattgaacataaaggcattgagggtgttggaccagaaataagctgcagaggccatcagaggttcatccttagccgaatttgctattgtgagagcaagcgcttggccgattccgagttcgtcccagtgaacttgtttgctagccgacacgcgcttgtaccaggcgggccatcttttctcaagggaaggccaagatttgaaagtgtttttccaatgacctagatttgggttgccaatctaaaaggtatcctattggtttcggtgataatgaactcaatggggtcggaatcgccgataggaccaaggaaatactgatgctcatgggatagactgggaatcgcaaccagattggaaagatgctaccgatgcaaaaaagaatagagaagaagaaaacaagatgagacagaggaaaaccgatctactgcacaaaggagaggatctagccgatggatacgtacctctgcatattcggctaatggcacagcagacgggctggcagaaattgacattgccacgggcggaagtttggtcggagggaaaatcatctcaagatcgccttatgcaccgaggggatcgccggagagaaaaggcaagattttcttaagctgtgaaaacagaagtaacggtgtgaagtttctcaggggtgacggttagtatttaaagcgctgtggtaacggtaggaaaaacggcaatgagcgattttcttggagataaaatatggcaaatccgaaacattaccaaatattccagacttggggggcatttgttaacgaccaaatttggtaattcaagtatcggagatgaagataaaattgaagcagaatccaagagaaagattgttccggaaacagagcaagaatcggccgaagtccgaatcggctacgatcaggatcggcagagttcgagtcagacaaggtagccgattgagccgattccgacaatgtgactcggtacacgttgtcgaattgagttaatgtgcttcatatggattgccacgcacggattaagtcctgaaaaggcaattgtatctattaattaggatattttatgtaatatccttagagataagtttgggcaaaagtctgccgcaaagactaggacatattttttatgacgggtataaatatgacccgaacccatgaaatcaaacaacaatcgttcaatacaatctcggcgcatcaccactcttttactttcatttattttcgacaagttcttgctttcaagttgagctgcattggtttcgatcttcaactagaggtaaaacttgttatggtggcttgcgttctcgggattagtgcttccatctttatgacactctaatcttgtttatgtaattcatcgagttatcatatatcctatataatctctggcaatattgtcacgccctaaaaatcgattaaattaaaaatgcatattttaaatcatttttagaaattattttaaaagcctacaagctaaaccctaattttctaggaaaattttcaatataaaaatgagttagataaaattttattaaatactatgcttgctcctctattttctagaattttctgggaattatttgagcaagggaagtatttttaataattgaaacaacatttcacaaattgttttattcaaaaaagtttaaaaacccctccctaagccgttgggccgttttcggcccaacatcctctctctctctcgcggccgaaccggcccatgccggcccaagccgacgccgcccgctcccctttttcgtggaggccgacaggtggggcccacctgtcggatccatctcctacctccagccgccggccgagcccgagccgctgccttccacctccaaattcgccccaatcggactccgattccttcgggtttttaaggggttttggtcctctcgttctcctctttctttttccccaagaatcaaaaagaatcgttgaggatttgatccgaatcg

SEQ ID NO: 4846 - DNA, 6457 bp, Oryza sativa
ttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcatttaccagcaaaagttttacaatactgttttatttaatcttgctgcaataaaataaatttagtatgttgattttataactttcttttgaaaccagttattcaaaattacaaaatttgtgacctcgtttccaactgttttaatttatttcgcaaagcttggtttactttatttacttacctctttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgcacgatgtcctttgtcattggatttgggactgcccctttttatgcccagattcctcatgatcgtcatgaagagaagtgccgagtcagagtcaccttgaacagcaatagtgaagaggtcccctcagtgatgtttgaagctggaggaagaaactacatccatgcatgtcaggaggtggcaaggatcgccataggagagctccgtgatcgctacagtgatcaattggccgacactgagtatcgctaccatcctcgccaacctcagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgctccagctcaagcggatcctccggtcatcatcataagtagtgatgaagaagaagaatctaagcgcaacaattccaagattgagtgggtagcaactcaagatgatgaagacgagccttcaatcgacctccgatgcttggaagaactagagtgacttgttaagtcgttgtcttagatcgttgtgttagtttgcttgctttaagtttgcttgtgtgtgtctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctgtcctaagtagtttccccggtttctcttcttgtgccctgtccatgccagatggtgaacactcgtagcaatgggaatggtcccaacaaccccaataacaacaacaatggagagaatcccactctggcccaagttcttgctcaacagacacagcttatgaacatgatgatgcagcaatttcagaatcagcaaaaccaagggaataatcatgcacctccccaaaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcaacaagcccgtggtgtgtttcaactgtggagatccaggacattatgctgacaagtgtccgaagccccgacgtgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcttatctacgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttaaaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcaacttaaaggtgccactgttttctccaagatagatcttcgatcagggtatcatcagttgagaatcaaagaggaggatatacctaagacaacttttaccactaggtatgggttgtttgaatgtactgttatgtcttttggacttaccaatgcccctgctttcttcatgaacttgatgaataaggtgtttatggaatacctagacaagttcgtggtggtctttattgatgatattcttatctactctcgaaccaaagaagagcatgaagaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggccttgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgcattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcatcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcgatagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcaaaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtcttcagatggctccttacgaagcactgtatggtcggaagtgtcgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagtacataatgtgttccatgtgtcgcaattgaaaaagtgtttaagggtacctaccgaagaagctaatattgagcagatagaagtccaagaggatttgacttatgttgagaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatataaattgttgtttaaatggaatttttagaaataattttaaaagtcttgaaaagaaaatctagttttaattaataaattccaatataaaatgggcccagataaaatttcattaaatactttgcttaattctataattcctagatttttctgggatttatttgagctaagaaagtatttgtaataaatggaattgcatttaagaaataatttaaattgaaaaaggttttaaaaagtcttcttttggctttgggccg

SEQ ID NO: 4847 - DNA, 17036 bp, Oryza sativa
  unsure (1)..(17036): unsure at all n locations
tttttcgtgattagtctcacactacccattaatggtaataatgtggtaattaatttgatgcctagtttggaatggataattcctggtttggaggtttaatttgttcaactggggttggttgttcaaatgtggttgggcctatgcaacacgggtgtgttgtatggtgtttatttaatattggttaattatacaactgttttactattctcttaaatatttattaaatgctgttttctgcaaatgaactgtattatgccatcctttgttatcctgtgcacttgcatatttgctgtgtggcttgttgagtatgtcatatgctcattcttgcaatattcattcatcagaagaggagtacttgagtgaaggtgatggtctggaggattaggcttgtcctggttaagttgtctgtggagtggagttgccatagctgttccgtagattgttttagtttaatttttccgctgcgtagaatgttattttttttgagaggaactatctacctctgtaataatttattatttgcgattgttaaatagttatttaattgtactctattatcaatattgtcattgtgtgcctcggttgattcctggacgagggtttaacacacatgtaagcgtttggaattttggatagaaattcagggcgtgacaagttggtatcagagccaccttgaccttaggataagccaaatggtaaaccttaagtagccttcaaaatattttgaaaatagaactgctcttctctattctcttataaattaattaagttggcaacacatgcaaggttatgcacaaaatttatttaattcaacttcttttcttttaatagcaaaaagttgttcttctcaaaatatttcttttttcttattgattagtcggcactgtacatctattatggtatcgacataatcatggtagcactagtactactcatctttcttgtggtgacactgtaccgtgcttaaaatagatcataagtattttagttttgttttagttatttgtcaaaaaaaatatatttgtctctatctaaaaagttaaattctaaaaatatttataaaatagctttttatgtgtcttttcttttattttcttcctttttggtcaaaaatcagttaagtctagttggtgcagctaacttagaaaaaatatgcattaattcttctcttccatgtttctttagatgccgccccattcaccgagaaatttgatcgaggtgttaggattcgtcagggagctgaggttgatggcttttgaggtaggttatgaagttgctcctgagtatcgccagatttcccatgaccccgacgaggagaagtgtcgtgttcgtgtgacgttggctagtgatagagaagaccttccgtctattaagttcgaagctggaggaagatcgtactgccatgcttgtcaagaagcagctttggtggccattggagagttgcgtcaacgttttgaagaagagttggattcatcagctttccagtatcatcctcacaagcctcatggtcaagactatggaacctatatctgtcctgatggtgaagagagtgccactctgatgcatgtggtgcatatgcttagtgctatggatgcagtaagtgtggagcgagacaaagcagctcatgacagggaaaactggaatcgaggcaagatttgcaagttggagagcaaggtgtaccgtctacagaaggaattagctgaactcaaaggagaaacgccgccgccaacacccaagcttcgcctcgtcgcaagaaagagaacctgtccgccacctcgtctccagttagcttcgaagattcgcgtgatgggtgaagctgtgcccgatcgtgctgaacctgtcatcgacatcataagtgatgaggaagaagaggaagaccctgaagaaagagagccagctactccagaggaagaagatccatcgcttcgttccgacgcaaggcgggattagtcgcttagttagatcgttgccgtagttcgctgtgttagattgcttgtttaagtttgtttgtgagtgtgtgggttttagttgttgcttacatcattggtgggatgtaacagcatgagtctagttcttttgcttgtcagagtgtaagatagttggtgagatagtgttaatgccacttaaatgtaatcatacacagttaagagcaatatagaatttaaattaattaagtaactccgttctaagggtgtctctctgtcgttctttcctgttgtctctgcttatcatcagatggtgaacacgcgcactggcaccggaagtggaagcggaagtggaagtggaagtggagctactaacaatggaggagatcccacgctagctcagattctggcccaacaaacacaactgatcaatctgttagtgcagcaggcacagaatcagcaggcaaacaatcagaatcagaatccacccccacctccccaaaacaagttggcagatttcttacgtgtgagaccccctaccttttcaagcaccaccaatccagtagaagcaggagattggttgcatgcggtggagaagaagttggatttgatccagtgtactgagcaggagaaagtttcttttgcttcgcatcagttgcatggacctgctgctgaatggtgggatcattttcgccaaggcagggctgaaggagaacttatcacttggcaggagttcacgactgcttttaagaagacgcatataccgtcaggtgttgtagctctaaagaagagagaatttagagcactcaatcagggatctcgttcggtcaccgagtacctccatgatgtcaaccgtttagctcgttatgctccggaagatgttcgcaccgatgaagagcgtcaggagaagttcttggagggactgaatgatgagttgtcttatgccttgatgtctacggatttccgggatttccagcagttggtggacaaggcgattcgtcaggaagacaagtataaccggatggagcagaagaagcgcagggctgcccaattcaaggcacaacagggcagtaaccagaggccgcgtctcgttactggacctcaagctccatcgtaccctcaaggaggatcttcatcagttgtccgtccccaacgccagttctacaataacaatactggtaatcgtggcaatgacaaccgcaacatggttgctcgtcctgcagcaactccagctcagaatcagcccgttaggaaggaacagggaagcaagccagtgatatgcttcaattgtggtgatccaggacattatgctgataagtgtcctaagcctcggcatgtgaagaacgctccagccccgaacaactccaatgttctagcaccgaaggcacgtgttaatcatgttgcagcagcagaagctcagaatgcaccagatgttgttttgggtacgtttcctgttaactctataccgcaactgtgctttttgattccggtgctacacattcctttttgtctaaaagttttgcgagcaaacatgggatggaagttgttagtcttgggagacctttactagttaataccccaggcaatcaagtattttcgacatagtattgtccttctgttactatagaaatagaagaagttcttttcccatcctcgcttatcttgctagaatccaaagatctagatgttatcttagggatggactggttatctcgtcacagaggagttatagattgtgccaaccgtaaggtgactttaaccagtagcaattgggaaaccgtttctttctttgtgtcctcccctaaatatcatggtgtgaacttaaaccaagttgctctacaagagattcctatagtacaagactacccagacgtgtttcccgaggatttgccaggtatgccacctaagagagacatagagtttcggatagacttggtgtcacaccctgaaaattcaaaatatataaattgttgtttaaatggaatttttagaaataattttaaaagtcttgaaaagaaaatctagttttaattaataaattccaatataaaatgggcccagataaaatttcattaaatactttgcttaattctataattcctagatttttctgggatttatttgagctaagaaagtatttgtaataaatggaattgcatttaagaaataatttaaattgaaaaaggttttaaaaagtcttcttttggctttgggccgaaagtcggcccaaaacctctcttctctctcctcggcccagctggcccagtcagccgcgcgcgcgccctcgctgtcgctgacaggtgggtcccgcttgtcggtcgtcgtcttcctcgggccgaaaccctagtttcgcgccgccgagctgccgtcgccgccgctttccaaatccggccgttcctttccttctccggccgatttgttagaggggaaatgatctccgggatctcctctaccttttctcctttggaatctttggttaaatcgctttggaaagctttggaatcgagttcgattcggatcggttttccctctctccaagccgcgagtttccttcgccgttgccgtcgccgtgggccttcgccgccgcctccgagcccctttaaaaggacccccggtgtctcctctacccgtcgccaccttcgccttcgcctctcgtcgtcggaaaagccctagcgccgtgtgccctagctttgccgtcgtcgccgtcgctccagccgtgcgccgccgtcgtttcagccgtcgccgtcgctcgggaagaccgccgtcgtgctcgccaagtcgtcgccgtcctcgtccgccccttcgccgtcgccggagatcaccggagcagcttcgccgccgtcgacccgaagagcttcgccgcttcctcctcgtcgccgtcgccgtccgttggtcttccgccgccgtttaggtcaccggtgagttcgccgtgttgtcctctacgtcttggtgccctccgtttgcgtcctagtgccgccgttcgccggcgagcgtgcgccgttcgagccgtcttctccgccgagccgccgccgctgtcggtgacgtcaccgctgacgtcatcggggtcgtccgccgtgagccgccgtggacccgatcgatctcggccgtccatcttggatcggttaaatctcggccgtccgttcgcgtgaaccgccgcccgtgcgcccggtccaccaaaccctagcccgctgacgcaataaatccccttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgcttctttttgcttagattctgtcgtttccggagagtccgttttcgcggaagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattgttatggccctttcgtacttgattaccttattccttgataccttgggttatattaatttgactagttgagctttatttatattggttcaactagatattagatataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgggcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactgataataatttgattagctcctggtttggaatggtacattcctggtttggagatagaactgtgcagccggggtggttgttcagaatggttgggcctatacaacagggtatgttgtatagcgttggcttaatattgtgtaattacttaactgttttgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacacttggtacctggaaccaacccaatccataagagaccatacagaatggcagctaatgagttagctgaggtgaagaaacaggtggatgatttgcttcagaaaggatacatcagacccagtacttcgccatggggagcaccagttatctttgtggagaagaaagatcatactcagagaatgtgcgtggattatcgagcgttgaatgaggttactatcaagaataaatatcctctacccagaattgatgacctgtttgatcaactggaaggtgctacagttttctccaagatagatctccgttctggatatcatcaacttcgaatccgtgaggaagatataccgaagaccgccttcacaactcggtatggtttgttcgaatgtaccgttatgtcatttggactcactaatgccccagcctttttcatgaatctgatgaacaaggtgtttatggaatatctggataagtttgtcgtggtgtttattgatgacattcttatttactccaagacgaaggaagaacatgaagagcatcttcgtctagctttagagaaactacgtgagcatcagctttatgccaagttcagtaaatgtgaattttggttgtccgaagtgaagtttcttggtcatgtcatctcgtctggaggagtggcagtagatccaagcaatgtggagtcagtattaagttggaagcaacccaagacggttacagaaattcgtagtttccttggacttgcatggtattaccgcaggtttattgagaacttttcaaagatcgctagaccaatgactcgtctacttcagaaggaagtgaagtacaagtggacggaggattgtgaacgaagtttccaggaactgaagaaaaggctagtgactgcgcctgtgttaattttgcctgattcgaggaaaggtttccaagtgtattgtgatgcatcccgacacggtttgggttgtgtgttgatgcaagaaggaaaggtggttgcctatgcatctaggcaattacgtcctcatgagaataactacccaacgcatgacctagaattggcagctgtggtgcatgcattgaagatttggcgtcattatcttttcggtaaccgtactgaggtatatacggatcataaaagtttgaagtacatttttactcaacctgatttgaacatgcgtcagcgaagatggttagagttaattaaagattatgatatggaaatccattatcacccggggaaagcaaatgttgtagccgatgcccttagcaggaaaagttactgtaatatgtcagaaggtcgacgtttaccttgggagttatgccaagaatttgaaaagttgaacttgggaataatcagtaaaggttttgtggctgctttagaagctaaacctactctgtttgatcaagtgagagaagctcaagtgaatgatcctgatatacaagaaattaaaaagaacatgagaagaggtaaagccatcggttttgtagaagatgagcagggaactgtgtggttaggagaaacaatttgcgtcccagaaaataaggagttgaagaatactatcatgaaggaagctcatgaaactttgtattccgttcaccctggaagcactaagatgtaccaagacttaaagcaacaattctggtgggccagtatgcgacgtgagatagcagaatatgtggctctatgtgatgtatgtcagcgggtcaaggcagaacatcagaaaccagccggtctgttacaaccgttgaagattccagagtggaagtgggaagaaataggaatggattttataaccggtctacccagaacgtcggcaggacatgattctatttgggtagtggttgatagattgactaaagtcgctcactttataccggttaaaacaacctatacgggacataagcttgcagagttatacatggccagagtggtatgtttgcatggtgttcctaagaagatagtgtcagatagaggtagccagtttacttcgaagttttggcagaaattacaattagaattgggtactcgtttgaatttcagtactgcttatcaccctcaaacagatggtcagacggaaagagtaaaccaaattttagaagatatgttgagagcctgtgttctagattttggtggaagttgggataagaatttgccgtacgcggaattctcatataacaacagttatcaagctagtttgcaaatggctccgtatgatgcattaaatggtcgaaagtgccgtacgccgctcctttgggatcaaaccggtgaacgtcaagtttttgggacagacatattgcgacaggcagaagaaaaagtaaagattatccaagagaggttgcgcgttgctcagtcgcgtcagaagagttatgccgacaatcgtcgcagagatttggctttcgaagaaggagattatgtatacctgcgggttacgccgttacgaggtgttcatcgtttccaaaccaaagggaaattggcaccgcgttttgtgggaccttttaagattgtgagtcgaagaggtgaagtagcttatcagttagagttgcctccgtcaatggcgggaatacacgacgtgttccatgtgtctcagctgaagaaatgtttacgtgtacctacagaggaagcagatcctgatcgtatagagcttcaagaagatttaacttatgttgagaagccagtcagaattttggaagtaagcgagaggaataccaggaatcgcgttatacggttctgcaaggttcagtggagtaatcattcagaagaagaagccacttgggagcgagaagatgaattgaagtcagctcatcctcatctgttcgccagttcttctgaatctcgaggacgagattccgtttaaggggggtaggtttgtcacgccctaaaaatcgattaaattaaaaatgcatattttaaatcatttttagaaattattttaaaagcctacaagctaaaccctaattttctaggaaaattttcaatataaaaatgagttagataaaattttattaaatactatgcttgctcctctattttctagaattttctgggaattatttgagcaagggaagtatttttaataattgaaacaacatttcacaaattgttttattcaaaaaagtttaaaaacccctccctaagccgttgggccgttttcggcccaacatcctctctctctcgcgcggccgaaccggccaatgccggcccaagccgacgccgcccgctcccctctctcgtggattccgacaggtggggcccacctgtcggatccatctcctacctccagccgccgaccgagcccgagccgccgccttccacctccaaattcgcctcaatccgactccgattccttcgggtttttgaggggttttgttcctctcgttctcctctttctttttccccaagaatcaaagagaatcgttgaggatttgatccgaatcgagttcgttttgattttatccctaaaaccgagttttaatcttttccgagccgattcctctcgtttggagttcgatctcttcaatccgagcttatataaagcttcccctcgtcgtcctcttccgtttgccccctctcccgagctctcccgtgccccgtagcgccgccgccacgtgcgccaagctcgccgccgccgccggccgtcttcggcgtcgtcgtcgcgccgtctccgccgtcgccgccgcttgccgtcgccgccgttaggtgcgccgtggtgagaggaatctcggccgcccgttccccttcgccgccgaccaccggagtcccctcgtcgccgtcaagccgagccgccgccgccatcctcctcgtcgccggccgccatcgttcgtcgtttgaagtcggggtgagtaccatcgggttcgtctcgatgtcctctacgcgtaggtgccctccaatcacccggccgaccgccctagctccggcgagctcgcaaaccctagccggccgccattgccgacgtcagcatgacgtcagcatgacgtcatcatctccttttctttttctttttcccgattttctaatagattaaaacttcggaaaatcataactaaataaccgtatatccgtttcaggtggttcaagtttctaaatttttctaaaatcaagatctacatgttaaaaatattcacatgtgctgtttatgcttgtttttgtactgttttgttgattttgtttatttgctttagtttccgacgttccggaggagagtgtttccgttgaggaagtttctgacgcgtttgtggaagcccaaggcaagtcacacagatcccaaacgaccctttgagcatgttgatcatgtttaaagctattattttattttaactatgcattgttttcgaatgtcatcgggtggtgaacctttcccaattaattaatggccgaagatgactttattttcctatgggttataatttgattagcatgaaccttatatattggattggttcggctaaatgctatatgtaagtttgcttagccatgcttagaaacattagctaacaaaaggagttaaatataaattatattacataattgttattattaattagggttatattcaatggtagctcacgatggtaaatcgtgtgatgttaattaattgataattaaaacctggataaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgcccgactgagaagtggcgagaagtccatgggggtcgctggggagtccatgccttgttttaaagggggtgattatgatccaggaaaggagcactgtaatgggttatgttgtgcgaggggtattgtcacgactcctttccgaggtaccgtggtggtactgaggcacatggtgacatgatgtggggttgtgtcttgtgggtacagtggtacacctctgatcagagtttaatctattcgaatagccgtacccgcggttatgggtgagttgagcaatatttttcgtgattagtctcacaccacccattaatggtaataatgtggtaattaatttgattcctggtttggaatggataattcctggtttcgaggtttaatttgttcaactggggttggttgttcaaatgtggttgggcctatgcaacacgggtgtgttgtatggtgtttatttaatattggttaattatacaactgttttactattctcttaaatatttattaaatgctgttttctgcaaatgaactgtattatgccatcctttgttatcctgtgcacttgcatatttgctgtgtggcttgttgagtatgtcatatgctcattcttgcaatattcattcatcagaagaggagtacttgagtgaaggtgatggtctggaggattaggcttgtcctggttaagttgtctgtggagtggagttgccatagctgttccgtagattgttttagtttaatttttccgctgcgtagaatgttattttttttgagaggaactatctacctctgtaataatttattatttgcgattgttaaatagttatttaattgtactctattatcaatattgtcattgtgtgcctcggttgattcctggacgagggtttaacacacatgtaagcgtttggaattttggatagaaattcagggcgtgacaaatattgttatttaacttttaatcgggtaatatctatcattggaaggcagccgattaggctaaataccaacgttgacctagattatataggatatccaccaccctatgaaacattcaacggcttgattgtctagatattatccttcttttcatacttatagctgcattagttgagtttgaccttataagtcgtgattagaatctcaatctctagcctactttttggttgccgattagggtagtatcggagtttcagccgatcttacctgatttaactcttttatatcttatgtgcttgattgacatgttaaatccgctctttatgttaagatcttgtcacaattaggtatattaagcttcctgtttgatatattttgcttgctttaatatcttaatatagaatagtataggagtattagccgatgcatgctggatctatttgatcggctatgccataaacgtctataatcttcttgttaatatatatatcgatgtaagtgatttatactgtctcgatcacttgatttaagtatatatcgacggaagtattatataccattgatattgatgtgaccatggctactacggacacaaccattgctcacatcatggatgaacagcacgatattaagttcaagtcctccaagtgctggaatccaattcggccaccagctacactgctgttttcaaatggccgccgaatctgcatacgaccttcgtttttggcccgtgagtacttgatggaaagctcttggagccttctttccaacggatctagcctcatcgccagattccatgtcgtttggccgcaatcacataaacaaggtgctgcgtcacctgtcttgtgcctctgggcttgtaactttgtttgggacccctacccaagtggggcccatgtggggtgcgccccaaccaggtggaggacgacccttggcaccccttagtcgtcctcccacccctataaataggtaggtaccccttcagggtttcttgggttttgtttggatgaaagtttagccattgctacttccttgcagcgcgcgtgtcggctagactgtccgtctgcttgtatttgaaaccccaacttatcattcgtattcaactcctatttgcatttcagattgcttttatcttgttcttgcttgtttcttcgatttgcttgcaggaataaggttgatttgcaccggcaacatcaacaacccacggaaaggtgtatcgatcgctaaggcgcaacgcaacgtcttgtatggttgtagtcgggtcgtcgacgtttctcccaaatcgtagttatcatcaactcaccgaaagatcgggccaacaacagccgtgagtgtcgagaggaactcagggttcatcagatatctacagccggtcgaatagatttagttctttcttgcctatttatgactgctgatcaattcaaatatgacatcggctcaaagataaatgatatgtcatcggcggctggccgatcggctatcgtttatggatttaaccactatttttctatcattatttcttgttgattgcaggatcaaatcaactggcacgctgacgaacctaaaggtaagatttttggacctgcactgaagttaagcagatcttccaggccagtgtgtatttttcgtatcaacagtcctggacttgttctggttggtagccatgtcgcaaacgtcgcactcagtcaaaacgagagttatcctctcaccagaagatcgggccacgagagagagcgtcatcagttggtatcagagcttcggtagcatggtgaggatttttttttatagatttattttccatacctatcaatatacaaaattaccgcaccacttttccctttaccaaacataggtttgtgatttgcaaatttcattcagttttgtgtctttgaatgctggtccgttgtcgtctctagtgctggcttcgtttagttcttagttgtggtttgagttttgcttttgattgcatgcagatcgggtcccgtttatcttggtagcatattatttgttctaatcagattgtgtcgtcgtccttgttcctgtcgcttgcacttaagcccagaaaaatagaagatctgtggtttccttctgatcggtggatttgtttctgaaattacgaggttgttgcacgaccgtttccctctggccgcgatctcctgtactgcttgctattttactggacaagcatgtatatctcttgatttatttggttgatctactcgattgtctatgcatgcaacaaatccttgttttcctctccagatctgcatgcatatccactgccgactgcctacatgcatgcacgatatttcctctatccattgccactgataacttctaggaattaaattctatgcgctgcaccagctccactggttttttgagttttagtcttgtttcacgtacagccgccgtttgacgggctgccataaggaactcggcactcaggtgtggcttgtcgaagtaccaggaggacatcggctatagggtattagctagtgtattagttaacaagaatgtatgtatgtatattagaagtatagaaatagatttccttttctaatttctttccacttagcttagataatatattctcagtagctgatgcttgtttatcagtctacatgattttcccatgggataaaataaatacaatacccttggaatactctcgagtgaaatgctacaatggtatatccgtgcgcttgtggatgaactctgtaaccataatataccagaagtatttctgtgccattgctgggaattatatttctagtaatgtcgttaagaaataccaacaaacatttctggcgccattgccgaggaagattcgtaatagagattacctgaactaatagcaggataaccttggttgttttcgcttttattgtgaaaacagggtagtgcatgactggtttcaacttgtcggaaaacttcaaagaaaatccaaaagctttcgtccgaagcgtcagaccgcgagtcgttgctctgcagaaaactctacgacatagaaaccagtcgtaccagcaccaccaactttcaggactatggctgacaagacccttcacgagttcgctgctccctctactgacaatgtggccattgggccgcagatcaacatgggagacgtggatttcgacttgaagtccaatctcatcacgatggcgcaggctagcccattctatggcaagcctaacgaggatgcctgttggtatttcttacgaccacagataaatccgcaagcgcacggaatactgctgtagcacttcactttcgggtgaccccaaaaggatatcgaactcagggaatgtgtgtaatctacctaaggctaagacgatctaaggacaacaaccgatggtcggcaggcttgagaggactttctatgtggcttaactatctaagctaagcaaaggtaatttcctatctgttgcatcaggcaccgacccctgctggtctgccagcgtggtttcggctatagctctatgatgcatccgaacgtggagattactaggacgggattcagggctgtcaccacctgccgtctacctctgacaaatccatgggatacacaacaaacaaaggtaatctctaacctagacaccacgcctaagttattaattactactctaatacttgcgcaggaacttccttatttatctagagtcctagtactagagcacttagtataaatactaaacaatgaacccgcaaagatggaaatctatcttactcaaagaaagtaattaaataacataagaaaggaacacgaatgcttactttatagaagaagttctccgaccccagagcagagtgtatcaaaagctccggtactcctccagaattcctcctacgaagctacactcatcgaggtagaagtcagataagtgccaaacttccgggcactcctccaaagctccccctcactctctaccttattctaatgtataaaagatacaatagagtctcttgtaattcagctcaaagttgtgtgtattggaatgagatgaagatctccttatataggctccaaatgacggttaggggtatgggaaatggccaaaacaccctgcaactgccataggggagaaatccaaaccgtccacatgaagccagatggcgggaggcgccaggattggttcggncnnnntnnnnnnnnnnncnnnnnnnnnannnnnnnntnncgnntntnntttnnncnnnnngttnnttattgggtcccttccatnttgcccatggttttgcccaatccttcagggctttggttgacatatgggccctccaatccgtgttaatgcgtcttgaatgcgcagaggtgcattttgtcgcatgacggatgtgttttctcctcaaaatacctgcatacacatatttcaccaacactagtggaaatgattagtaataatacctaccactaagttggataccatgttttattccattatatgtaggcattgacggtcaaatattatgatttaaggaccgtcaacagggtactcctaatgggcggt

SEQ ID NO: 4848 - DNA, 6502 bp, Oryza sativa
  unsure (1)..(6502): unsure at all n locations
ccctcccctttactactttacctccccttcttctcttactactacaccatataaatttgaattaaaattcaaatttttaatgtgtacgtaaactttttacttataaactttgggtctataaactaatatttgaattcaaattcaaattcaaattcaaatttgaaacgggtatgtaaacttttgacctataaactttgggtctataaactaatatttgaatttaaattcaaatttgaatcgggtatgtaaacttttgatttataaactttgggtctataaactttaggtgtataaactttagatgtatagaaatactatatatagaaaatatttaattcaaattcaaatttgaacggatataattcaaattcaaatttgaatcaggtatgtaaatttttgacttataaactttgggtctataaactttaggtgtataaactttagatgcataaaaatactatatatatattttaatatttgaattcaaattcaaatttgaatcccgatataattcaaattcaaatttgaatcgggcatgtaaacttttcacttataaacattgggtctataaacttcaggtctataaactttagatgtatagaaatcctatatataaaaaaatatttgaattcaaatttgaatttgaatcggatatataaacttttgacttataaacttttggtctctaaactttagatgtgtaaacctgaggtgtataaactttaggttcataaatttactaaaataggaaagtaatacggtgccaaaaaaggaaaccaggtggagggagggagggggaagggggatcgatcgctacccttgtcgccgggcgatcgatcgcccattagcacttccgccgtcaacaatgccaacattcatctgcaacagttcctggagatctgtagcacatataccatcaagggcgtcagtccagacgccgtcaggctaaggctgtttccattcttccttcttgggagagcgaagcagcggttctatgccaaccatgctgctgtcaacacatgggacaagtgctctacggcattcctctcgaaattcttcccgatgggcaaaaccaatgcccttcgtggaaggatttctagtttccagcagacaagggacaagtctattccggatgcatgggaacgactgcaggagtatgtggccacctgtcctcatcatgggatggacgattggctgatcctgtagaacttttacaatggactcaccccgatgtcccgcgatcacctggacacggtgtcacgccctgaagttttcccccctttgcttgctttaaaaattggctaaataaatcgtccgaagaaattatcttaattaacctagagctaattccttaattaataaatgcaattaataattgaattcggcgtggtggaatttttcttgagttccccatgctccaatgcattaacaggatttttagtggaattttcagagccttggaaataattttttaccaattaaaaatcaccaaagtgcaatttttaatcccaggaaaatccttttttctctttttcttttcttttccctcctttttctttgttgggccgtcggcccatccctctcccgcggtcccccctccttgtgggccggcccaagccgcccctccctcctctctctcgggacgccgacaggtgggccccacctgtcggtcgtctcccacctccggccgctagagccgaagctccaaccgcccatgtcgccgctgcctcctccgctcttcccgtgcccacgccgcgccgctcccgcgtcctccccacgtcgccgcctcttcccccgcatctcccggcccgcgcgcgcgctcgagagggcgggattcgatttcgaatccacctctctcactctctctcctccccacgtcgccggccaaatcggccacctccccggccacgtccgccccctcccgcacctataaatcgctccccgcgtcttcctctctcgtttttcgcactcgccgcgccctcccgtgcttcctatcgtcgccgcgccgctcgccccttgcgccgccgcctaccgccgtctccggccacgcgccgccgccactatagccaccgccgcgccgcgcagtcgccgccgtcgcgctcaccgagcccgcccgcacctcggccgccgcttcattgccgcgaatcaccgccggagcccttttctcctcgcgcgccggtgagaccctctctcccctccgtctccggccggcaattcaagccgccatggtcgccttcccttccctaacccctctatgctctctcctagggtgccgccgccgcccgttcgcgccccggcatcaccggtcgtcgccgccgttttcttccttcgcgccggccgtcgtgctcgccggtgaggaatcccctttcctccttcctttcctctcccccgtgagcgccgccgccctccgcgcgtgcgccgtcgtcttcggctgccgccgccgccttcgcgccggccgccgccgtctccccgcgccgccggtcaccgccggcggtcgtgcgccgtcgtcgccttgccatggccggccggcttgagccgtgccgagcatgccgccgcccactccttccccctagagccgctgccagtggggcccgcttgccagccgccccctctccctcccttagtgccgctgaccagtggggcccgcctgtcggcgccaccccctcccttccgctgacgtcagccctgggctttattgcgcaataaattgattaaggacttttctttattagtaaaaacgcagtttatcttctaaaattcataagtaattcatccgagctccgtttaagtccattcaagtctcagtaaatcaagaaaaatgcaaagaatccattaaaaatagttttgtttcctgtttcagtagtcttatagcatgttttgcttgtgtgctttgtttgtcgcgtaggtttcggccgtttcgtcgatccgcggtttctcgaagacgttgctgaggtctcgtcagttcgagagcaaggcaagtcatgcaatacgtttgatcatattgtacccaatttacaaatatcccgcatttctattaaatgttgcatccttttacaatgtcatgtaggatgggtcctattcctcagccatttattgtttaccttatgccattgataacttaggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcaacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgttgagtacagtgggtagtactcagtcttgctctcttttcccccacaccagagctgaagatcttcctagttgaagctgttttgtcaaagttggtttcgtcgctgccgtcaaggattgcctgtggagtggagtcgctcgctgcttaagtcaagcttcccggtttatctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgactttgaccgtaagacaagccaactggaaaccctaagagccctctgaaccccttttttcatctgcatatgcctttttgcacctggaattgtttcgggaaaatttggagttttgcctctttggtttgcgggaaaaatcttggtcgttcattcggatcggattttttttttaaaaaaaaattattagctcagtctagggctttagaaaaattttagttggagtttattcgacagtcagtcgggaatttattgggggttatgcattaggtcgtgtctatattcgatgggggcaatgttatgcgcatcattttctatgcaactagtctatgcattaatttattgtttagttgcattagtgtctttatttgagttcatgaaaaatgttctatgcataaaaatcatcatgctcggttatttatttgagtcttcttttgcttggtttaatttggatttgagcatgaattggttcctatcccttgtctactttagatgtcggtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccccctgtttttcctccttttctcatatttctacctatccccttcagatggagataaggaatggttcacgcgactcgaacaacgccagtggcagcgaagagccgaacaatggagcacgtgccaacggtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggtcctccacctcctcagtccaaactgttagaatttcttcgtgtcaagccgcccaccttctcaagcaccaccaacccaatcgaagcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccgagaagcaggagaagtttctgtctggtcttgatgatgaattgactaaccagttgatctctagagattatgaggactttgagaagctggtggataaggctatccgtcaggaggagcacggtaacaaaataaaccgtaagaggaaggcagctcagttcaggactccccaggggaagagtcagaagcctcgtttcacgatgggacgtcacggtggaccttccaccatgattatccgacagcaccgtccctaccacccgggtagcttcaacaagaaccaccataatggcagtcacaacaacagtgagcagcacagtctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattcctttatttccaagcgttttgctggtgcacatgggttatctttagtgnnnnnnnnnnnnnnnnnnnnnnnnnnnnnnnnnnnnnnnnnnnnnnnnnnnnnnnnnnnnnnnnnnnnnnnnnnnnng

SEQ ID NO: 4849 - DNA, 499 bp, Oryza sativa
tccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgccca

SEQ ID NO: 4850 - DNA, 621 bp, Oryza sativa
aactgcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaata

SEQ ID NO: 4851 - DNA, 822 bp, Oryza sativa
cagacagccatgaggatgatgatgatgctaaacaagttgtgccctgacgcgtagtcagtcctcaccatcatcacctcatcggcacgtagttcatcaaggtcactggagctcgagaagaagcttaatagagcatggatcatgaaacagatctgattttttgtcgaatgtacgttagcagaggatggtgaggacgggtggtcggtgaggcacaacagcggcgccgaagtcgtgagcatggagaagggcagtgggcagattcggcattggaggcaaaggacgtcatgtgtctaggaggcggctcaggtgggggcggcgacagcggatccagtggtgcagctcaccagacatagggtaggggaggtggggcaggggaagcttgccagagttactgaagagggcgatgtgatcaacatgtaggaggagcaggagaagggagggacacagagagtgtgtgtggcgggattctcacccagccaatggtgatgctggtcagttggtcaggcagcgaaggcggcacggattggcgatgggccaatgggcaggaggagaggagaggagatagggttatgtgatttgcatgaatcttgatgagatcttggccattcaaaaatcagctgagggatggagaaatatcaagtaactgattacggcccattttcttaattaaatattacagcaaatatggtgttcctatatgatggagactagaggagaaaacccacgcagctgactgtgtatggtctttattaccacccttcttggatgccgaaattatgtggtgtccacacaaatagaaataactgaagcagaatcaaggtaatt

SEQ ID NO: 4852 - DNA, 2386 bp, Oryza sativa
agattattataagtaatatataagttattagtatagttttctctattataatcttcccacaggattaaataaatacgatacccttgtaatactctcgggtgaaatgctacaatggtatatccatatgcttgcagatgaaatgtgtaaccataatataccacaagtgcttttgcgccattgctgggaattatatttctagtaatgtccttaagaaatagcaacaagcatttctggcgccgttgccgggaaagatttataaaagagattactataagctaatactttatatttacccttgtatagtccctgtcctttgcaggctaaccttggttgttttcactgttgttgtgaaaacagggtagtgtatgactggtttcaacttaccggaaaatttcaaagaaaatccaaaagttttctttcggagcgttaagccgcaagtcgtttctccgcagaaaactctcccgacaaagaaacccgctatcctagcgtcaccaagcttcaagacaatggctgaaaggactctccgcgagttcgctgccccctcagctgagaatgtgctcgttgggccgcaagttagcttaggagacacagactttgatctgaaatcgagccttattactatggcgcaggctaacgatggatgagtcgatccccaaagcttgggaacgactccaggagtatgtggccgcctgtcctcatcatgggatggaagagtgggtgatactccagagctgctacaacgggctcactcccatgtcctgcgaccacctggacgtggcagctggaggagctttcttctctaagacggtcagaggagccgtcgacctcatagagaagatagtctccaacatgggttggagcgaagaatgactccagacccgtcagcaagtaatgcacaccatcaaggatacggagatgctcgctgcgtaactagacctcctcaataaacgactggacgaccatgagaagaagccccaaggcaccgtctaggccttgcactcgcacatcacgtgctaggtctgcggtagcacaggtcattttgggaacgactgctcggaaacccgtgaggaggcaatgtacatgggcaacaaaaacaacaatgggttccgtccacaaggaggtcaagggtggaaccaacccagcccgtattaccaagggggcaataatggtaacttctctaaccagccctccttaaaagatctcatcttttcacaagctaaaactactgatgctcttagcaaaaagctggctgccaatgaaaagatcttaaaaaatataaatgtcaagctagacggcatttcttccgcattccaaaatcagctaagctttaataagatgatagagacccagctggcgcagctagctgcctttattcccgctaatgaatcagggaggattacgggccacctggtacactctgttaaaaatgttaaggcgatcacaacaaggggaggtaagtccactcgggatcctccatatcctaaccctgcaggaacaaggagcagtagcagccaggaagcgctgcctaacaacacggctgagacagaggaggtagctcagcccaaaggaattgtgccacaagagtactgcgacacgaggttgctaccattcccacaaaggtacagtaagccgtcggtggacgagcagttcgctcgtttcgttgaggtgatccagaatatccacattcacgtgccactgctggatgctatgcaagtgcccacttatgcattatatcttaaggatatcctcaataacaagaggccactaccaacaaccgaagtggtcaagctgacggaagaatgcaacaatgccatactctacaagatcccgaaaaataagaaagattcgaggtgtcccacgatcacttgctcgtcgggatacagaaattcgaccaggccctctacgaccttgaagctagtgtcagcattatgcccaaagaagtcttcgacaagcttaacttcacggtgttggctccaacaccgatgcgccgggagctggccaattcatcggtccgttactcagctgggatagcggaagatgtgccggtcaaaatacgggatttcttcatcccagttgattttgtggtgctggagatggagtcagacaaggagacgccactcatcctgggctgtctgttccatagcaccgcaggcgccaacattgatgtgggaacgggaagtatccatttccgtatcaacagaaggaatagaagttcgagtttcagccaaggactaagcaatgctccatggtgagaatcaaatacgggccaaacccatagaacatccaagtgatcgaagtggagcgacctcagacgaatagcctagtgaagttcatatggaacttcctgtagaagggaacaccagtacctagatcctgtgaaaggaag

SEQ ID NO: 4853 - DNA, 5947 bp, Oryza sativa
tctaactaagcaactaagttatgttttgcaatcctagggtgaaagtggctcaattatatcactaggaaagtaaatcacactttctaagtctagtttagcaatcctagggtgaaatgatctctagtatgtctctaggaatgtaaattgcacaaatgtaaatgcaacaagtaaatgagacaaggtgacaagagatttttcaccgaggttcggaaactcgccggtttcctactccccgttatggcgagcccaactctaccgctcaaccacgaagccaccgcacgcccccttcgtcaaggggtgggcaaggcgggagccggcccacggagaggactacccaagcttcgatcgctcggggtagtttttccttcactccaaaggtggtgaactccaaaccactcacaaaccggcgccgggcctccttcacaatcttctcggagaggtcaccgggcaactcctccacaagccgtctaggaggcggcaacctccaagagtaacaagcgatgacccggcgtggagatgatcaagtgccacactagctctacaatgaagcaatgcacttgactcttggctaatcaaccctcaacactacaatggatgaacactaagctcaaatatgtgtgagagaggtgcaaggggtgtatgcaagtgaatttggtgccaagagagtccccttgctgctggtgggggagtatttatactcccaccaaccaaaactagccgtcgtagggctgtcattgggccccacagccctggccggtcagaccgacatggggtggccggtcagaccggcctcggctaggtcagaccgccctcagctcgctctgaccgaatacggctccagccgctcgggatcggccatcccagagcatgccatcccggctatatggccggctggtcagactggacaacacttgccggtcagaccggctgtgtggaggcggtcaaaccggccgtgaccctgtggtcagaccagctgcactggccggtcagaccggcacttgggccgcggtcagaccggctctggtcaggccacacagtgaatgcacaaattgaaatatggggagagtctaaatgcgagcacaagtctaaatacataatgacctaatgtggcaattaaaatcatctctttgctaggtcattacccctcttaatagtacggcgaggttagaatttaactagcaaattcgatcgccctacatctcgatcaatttaaatataaagcactagtttaccatcttctcatccttcgtttgcgctgtcaattttaatccttcggtgatcatccatgtgcacacaataagtgaacctaactcaaataaatatctcaaagacaacggttagtccacaattagtgcttgtcattaattaccaaaatcaacaacgggggcctagatgcttcaatcttcccctttttggtaattgatgacaaacatctcaatcatatataatcaaatttatatcacatggatatattgcaatgaaaagcaaaagctccccctaaacatgtgcatatcaatcacaatcaacaaatatagagccaatgcacatttcaatttcacatttcaacaagcacaaacacataagcaatatttcaatgttaacttcaagaaatattcatgagcataagatggtcacacatatatcaatatcacatttaccatccatcatagcacaagatcacatcactaaccattcaaaacacataagtcacaaatgatcctaaaaagggctcacaaataaacaagggctattacaagaccacgaagggtccaaaagacatagagttcaacaaaacaaaaaagaacacataatatagagtaatagcccatatccatacataatatagcccaaccgccttaacctattagatatgaggtaactaacctcactaccactagtcccaacccacaggacatgaagcacaccaaatgacatttttctccccctttcggcatcaagtaccaaaaggtcttcattcctgtggaggagaagaaggacgtgccgaagatgaaggatgaggagcatcacggtggcgatgatatacaaaagcttgggtgctctccaacacttggacccgagaatccaatacacccactctagtgtgcaatcttcccacggatgcattcaaatttccatcatccgttcgcaaaccacgaacattctcatgcatcgcttcatgctcggtggtcaagcgttgaatgctctcacttagggtattaatagccccaagtaccgggttgaagtattcattgagttacattccaaagtaagcatattgtggatggaagaaagcattggtatcatacccatgaggaggaggcggggttgcacttgagcttgcgccttgatcaaatgttggttggcgcacacgaggagctctaggagtggagagttggagacgaggcttgtactccttgtgttcttttaagttgttaccaacttgtcccaacttgctttgaatcaacctcattatgtagggagcatagtaaattccttgtccaattgtccccttggaaatggctatctccttcatcataaggttgatgaaatgaaaccgacgaccatccatgatggcatcaatgacatgccatgcaacgccgcgaatgtcatcattgttgccacatcttgggagaatggtggccttcactatgcggttgatcacactagggatgaccctcaaacccgccacctttccataggtgtgcctccccccttcttcataaaactgagaaaagtgatcaatggggaaggggttgtggttgtgctcatcatgtaggtcatccccgttgttgaaacagatgtgcaagagctccttgaattcacggcggttgatagatcaccgaatggtccctgacatccacttcatagcatcacaatcgccggacacccacacggtggcatagaattgccagatgaggtcttcatcaaagggttgcttcatggtgataatcctatcaatgccaacggccttgaacaacccctgcaaatccacaaactccggtgtctcaccaatgtgcctccaagaaatccacttgtgttcggtgaaggctttgtttgcgtatacttgctcatacacggccttttgataccgtgtatggaaccttgaatcattacaatcattaggcctccggaattgatcgtgatgacggaggatagtgtattgctgggcattccttaaattgagcacaaattggatggtgggatcgagaggactcccatcatcacttgcctcatcatcctcaccatcgccactgccagtgtcatcaccacttacttccacctcatccccctcaacattttccgtaatttcatcctcactactttgagcatactcctatccgcttgattcctcatgcgcacttggctccggcgtgggctcacgacgaccatgacgagtgcggggaggcatagctgagaaacaaggataaaaaagatatgagcaacaattttagaagacactaggttaggtggaaggaggttgtatgctgctgttaggagcggtaagaccgagtaccacagaccggtcagaccgccggccacttgccggtcagaccaccggccatcagccggtcagaccggtgacatgcacccggtcagaccggcggcatgcgcccggtcagaccgccctttgggctggtcaagccgccactgacaggagctaaaacaaccctcttaaaccatcacacaaatgactctaaaaaatatttgctacatcaagattgcacaagatttgagcatggatatcaaggtgtaggtctattacattaagattggaacaaagggggaaaactacccttaaccctagagattgaaatagatagatttgagagcaatgcacaagagggagagtgatttaccggttgaaggagttgaatcacaccaagaaactaccctctattggtgcaaaacgaagaacacctcgtgcttcacctagggttccatgccatggatcaaaaactcaatcaaaacacaaatcaatccatggcatacagagaagaagcaaaggagaatcacttacggtgtaacctgagtgattttgacggttgaactggatggattttgtggagggaggtggctagggtttgggagaggagagagaggttgttctcgagttgaggaagaagagggctgaatgggaggaggaggactcggttaggagaaggaaagagaggaaaaggaacaagtcctgggcccactagcttggccggtcagaccggccatatgcggccggttagaccgcgcatatagcgccgatcaaaccgcctggcccccagccgactgtgcacagcccttgcacagttcggctacccccacacaataaaaattcaacaaaaattgtatttttggagcaattttgaaatgtgtgagttgaaatattgccaaccgttcataacatttgaaaattatgaagatttgcaacaaaactcacttaagtgctaggaggtgacctattatggtctataggggtttttgggccaatttgattttcaaacaacttttgaaagatttggtttttgaaataggtttgaattccaaaaacatttcaaatcttcttctctaccaactttgttttgaaacttttctcaaattccttctcaatctcattttggggataaatctcattttggccaaaactaataatctagtttcttcaaaagtgggccaaaagggcattttcatccaaaattcatttttcttgcaatgtgaggcttggaaaacatataaggaaccttttgacacattttccaagagatggctttcaaattacattgattttgcaaacgttttgacttatgttgacttgggcattttgaaaatactactagcactactagttgatttgctcacatataaaaagaagtagagcacatgcaagagttaaaaactcccccttaatgtgacatgctccattttcacaaagaagaaccaaatggcaataaatccaaagcataagagcaaataggagcaaatatacaatatgcaaaagaagcaaccatggtgcacaatgtcaagccacatttgagaaatctatgacatttaactcattcctcaacttgcaaaagcgggtttcatcaagaggcttggtaaagatgtcggctagttgatcctcggttcttatgtggctaatgactatgtcactcttggcaacatggtctcttaggaagtgatggcgaatgtcaatatgcttggttctagaatgttggaccgggttattggctatctttatggcactatcattgtcacataggagtggggttttggtgaaggatatgccatagtccaacaagatttgtttcatccaaagcaattgggcacaacaactacccgccgaaacatattccgcctcggcggtagagagggctacggagttttgtttcttggatgatcatgacacaagggatctaccaagcatttggcaactaccggatgtgctctttctatccactttgcaaccggcataatccgaatcggaatagccaacaagcttaaacttagtaccttttgggtaccacaagccaatagttgaggaatgctttaaatatcttagaatccttttcacggccactaagtgacactcctttggagcggcttgaaatcgtgcacacatgcaaacactaaatatgatatccggcctagatgcggtaaggaaaagtaagctaccaatcatggaacgataaagctttaaatctaccggtttacctccctcatcaaggtcgagatggccgttggttgctataggtgtcttgatggacttcgcatcctccaagccaaacctcttgagtagatccttgatgtacttggtttggctcacgaacgtcccatccttgagttgcttgatttgaactccaaggaagaagctcaactctccaatcatggacatctcaaattccctagacatcatattaccaaattccttgcaaaatacctcattagttgaaccgaatat

SEQ ID NO: 4854 - DNA, 521 bp, Oryza sativa
gcaacaataccttcagcggcgagatacccataactttatcaaatctaaccaacctggctattttgtacctatggggtaatgaactttcggggcctatacccccaaaactatgcatgctcgccaagatgcaatacattggtcttaacaataacaaacttactggtgaacttcctgctagcttaggaaaccttaccaggctagtgacactatccctccatgataatcagatatctggctccatcccccaagaaatcggaaatttggtgaacctcaatattttggattttgaatataataaaatttcaggctcagtaccaaaaacttgtaaaatcaaaggtgtttttgattattattctgtgatgaacaattggcatcggaggttattggttttgttatttggaatttattcacgaagtgttttgagatgattggatttacaggtgaatcgcacgttctattatttcatgtgaccggtcaaaccgggcagtgtgtgccggtcagaccggcgtgtatcgcgcggt

SEQ ID NO: 4855 - DNA, 1688 bp, Oryza sativa
aattattatcgccgattatctgctccacgtctataagaatatgttttctcaacacactttcttatatgtaatagtttggaccaattataatttatttctcaaaatatttaatgaatcaagataattaagtagataatctatagtaataatacggtgattaatatgtctcaattgggccatataatatcagtatgactaattatgggctaggggtgaacacggattgaatattatccgatccattccactccgaatccatccaaattgaagacatggtaaaggtttttagatatccgtgtgatatggatgcaggatgtagatatggagtcaaatgtggtatcggtggtatccaacggatgctgattatctgatagtttaaacgaattatccagtatagagtttggcgcggatagtccgcacatttctcaggctatacaaccactcaatttgaccaattttacatcaggcagcccatctctttgttaacctaatctcctacctctcattctcactctcgtgctcttttttttcaaacggtcaggctgttgccgactttttatataaagaaaaaggtgtcccattttaaggagaaaacgggaccaaaaccttacaatgcacagttaattaggggaaactgcacgaaaaccacaaccacaacactctaactaacctaagctaacaagaccgtaaaaatggcggagctcaaaatagccatcgataaaaagcttgttgtaagcgacacaaaggcttcgacttcgcgaggcgagtgttatcattgccgagcttgtcgcctagcgacacaacaatttcgactccacggctatcacattattgttgccaaaaacatcgtagaaacaagcaagacaccgactcgtgctctcacagtcccgtgtgcacataggtggcggagcgagcaggccgatttgtgcacaaactcaaggaatctctgtaccctgtctccacgcgttgctgacaaggaatcatattatgaagttgtgttgtgcagcaaaaagtcacacaccacatgccaaatgacacgtggaagtcactgtcttatattgacttgctcgggaaacttgtctcgttcgtcatatgcggtctatgatttgcgaaaaaagttatgcacatgaattattgtatcgcatatctctatctagagacgaagttaattaaatttgttctatgcacatgcgcatgaaaacaaatacaacaaaactccaaccgctgacgtgatatataattgcaattatcgcaatctatatttgtttctttatcgtaatctatatttttttattcttgtgttaagttaaatttgaccttatatggatgtgaagacataagagagacgtaactatattatctttttatctgaattttttataattatttgaatcttgtgcgtgataatacctgcaacaacgagttaaaataatttttatagaaaaatatgagcccactctttctttattagaataaactttctaaaaatatattttctataaaacaaactctctgcacgaattatggatataaactttcactagaatgtaagaaatttcgacatgaaactgaaaaactttgatgtactaaataaagtgcatcttttgaagatcgtaactttctcttcaaaataatttctctacctagaaattgataaatgatattaagatctcacatgaggtatatga

SEQ ID NO: 4856 - DNA, 1530 bp, Oryza sativa
tcacatattgtgccgccccaaggaacaaggggattgggaattcatgatttagaaattaagaatatggctctaattagtaagtggttgttcaaattgctctccacggaaggggtttggcaacaattcatacgtaataagtatctaggtgataaacctctttctcaagctcagtagaaggccagggactcacacttttggtctagtctcatgaaggtgaaatgtgactttctccgttttggatcctttataattaaagatggctcccaaatcaggttttgggaagacaaatggttgggcaattcaaccttgaaagcacaatatccttgcctttacaacatagttaggcgtaagcaggctacagttgcacaagtcttcaaaaacaatcctccatctttttcatggagaagagaccttataggatcaaaactagtggcgtggaataatttattaccacgtgtaacactggttttcaattaactcaggaacaagatgagtttcattgggacttaacctcaaatggggagttctcggtgaagtctcattatctagctctaattcacagcatgttcctaacattaataagcgtctttgaaaattaaatatacccctaagagttaagatttttctttggtacttgcgtcgtggagtggtattaacaaaggacaatttgacaaaagaaaagggtgaatagccaaagtggtcctccaagtttcatgcaaggatcaatttagtccttaatgtttcaatctgtccatattagtccttcaagattttattttaattcaaacttatccttgaacccacataaccaacaactctcttgataaatgacacttataccccctcattcacatatataagagaaaaaaatgcatgctatgaattctttttatagatactgcatagcaatttatgtaaaacaaaaacaaattatgtacttgcaagtgtattcgatagccattaggcccaagtttatgtgcacatgttgaaataatgggaagtatacttacaatgttgcttattcattttggttttcttttttctagtgtatagtggtatacaaattaagggcaaaatggatattttctaatagaattgttgactagaaatagccatatggcacattaagtgggcccaaggatgattttaagccaaaacaaatacttagaggacctatgtggacaaaatgaaacctgaaggactaaattgagccttcggtgaaacttgagggactaaattaactattcatccaaagggaaatggcaaagcaataagaaccgttgtttttgttgcaatgatgagataattagacatcttttcttcgaacgtcgttttgcccattctgtttggtccatcatccaagtggcatctggacttcctccaccacattgtgtagcgcatatgtttgggagttggctcgatggaattcataataatttgaaagcacatgttctgttaggagcggttgctactatttggttgctttggctatacaggaataatgtggtttttgattaaaaaaatagtcat

SEQ ID NO: 4857 - DNA, 989 bp, Oryza sativa
ccatgtcattctttttttccttttgagtgtggttttgtatgttcggttgtgtgcatcttagttacgcagagactgaaagtgttctcaagataattgtatcaccttaatgtaattgactgagttcaatcaaagcttccattatctaaaaaataccgtaagtacgtcccccataggcaccaatcaaaatgttaatcttcgtgatatttttattatttttggaaattttaatattaaaagtgaaatttatgttttcaaatgttaaattttgcaatatatttatatttcatttataataatattagtgttgaatatgtgcaaaccaaaaactctaagacactatataaatcaaagtagatcatactgaaaaatactgacagtttctttcactgtttgcgacaacattgatgagtcacctattttccatccagctggtcaaatttgttataaatgacaccaatttttattaattcagttattccaatgtaccccaaaattgtttctctgattatcattgcaaagatgcacgagatggagtaggacattgagccaaggtcacctgtgtcttcctcagattggatgttattttctaatctatatattttcattgtgttgctattgaattattttcgatttttattgtaagtatacgtggttgttgaagcatgtgcttcatccaaataggaatcctagttgcccccacctctcttcccccgccaaacacggggaggagaggtggagcaagggaagcttggcggagttgtttaggagggcgacgtcaccaacgtagacgaggagtatgagaagggagagaggttgagagtgtgtggtcggtgagtcttacctcgctggcggcgatgctggtgacatggatggaggcgcttgcgatggattgggtgtgattggcagcgccagaatggatcaggagaagaagaggtagggttacctgatttccgctaatcttgatgagatcttgttcattaaaaaatcga

SEQ ID NO: 4858 - DNA, 381 bp, Oryza sativa
ccagtcgggggcagggacccgttcattctgggacggggacggacctgcttttcgacccggggatagtgaggcgacggggacccacatatatgcggtgccgggcccgggggaaagtgtccaccacacaggagcccatggagccccacgaattaataaagatggaaatattattaatggccagtaccttaaatgccagcgaaagaatggatatacatgatcatttgacaaaggccgaacataaaagcccatgcagtacacataggggatgaaataaaagcaaaaaaaaccctagctctaccgatcctactgagccgcctggacggcacccacacatgactgagtttgggtgcatgcccaaccatggccacaacgggttaacgt

SEQ ID NO: 4859 - DNA, 1264 bp, Oryza sativa
acccgagcgtagtttgtgcttgggaagaaaagagaagagaaaagagggcgctgacaagcgggtctcacatatattttgtgttctcactttttaatttccctgtggtgtctaggatgccacgccagtggaactagacatctatactaccatgggacctaaattatatagtttttacaatttagggctgaagatttctactattagagataatggatgttaaacaaaactcaacataaagttcaaggacggcaactggatttattccttttgatattcccgttgctgcccaagctatagactactccatatctttatcatatcttatctcatcttataaaccaatttcagggatggaaatgtggtatatgattgggccacatggctcattgagaatttagggttagctcctccaaatatcagcaacgtgcccatgcaatctctgattccattagagtgtcagtcatgcattgttccttgcaatcgccattgaactttcagataaatctatgagtaaaaccatcgactaaaagaaaatacgaagcagtaaatatagaaaaacaccagtatgcgtagtagattatagaggtttctgaaaaattcttcttccttcgtcatcaaaatcaaggaaaaaaaattaagcaagagattccagaggttgaaaaagaacattggatctgtccctttgctactaaagaaattccttctctcaatcatgaacaaaaaacaataaaggtcaaagtggaaaaatagaaaaaaagccataattaagttacttcgcctacaaaggcacctagcacaatcgccatcttccgcttcctgttggttgttacccccatagccatgtcgacgagccacgtgacattttgagtaccgccggcatcttccaaattatttttatatatgcaattttgtaaaataaaatggcagttgaataaggtgaaaagtattaggccaagtttggttgtttgccaactttatgcccaggtgggcaaactaggttgttgctaacgtcgcccatgttgctttaccgagctgtttaggctgagttcgttcgaaactaatatctcgcgcacattaaaaaaaatagaaaaatagagtaaattattagcgcatgattaattaagtattagttattttttaaaaataaattaatagaattttctaaagcaacttccgtaaaaaaaaataaattgcaaaaagtacatcgtttagcaatttgaaaaatgtgagtgtggaaaccaaagaaagtgagttgggaaagtga

SEQ ID NO: 4860 - DNA, 17286 bp, Oryza sativa
  unsure (1)..(17286): unsure at all n locations
gccaagccaggcctaagctcaacctgggcgttcggtttaaaccgacaattcggttcggtttattcggttgctataaaattcggtttacaggcttcaccacccgatcggttctccaaaaaactgaaaaccgcaaaattcggtttcggttttttaattttggttttcggttttagccgaattaaccaaaagttactaccaccagccacaacaatacagaattacataaaaatgaacacaagcaacagcatatatgatattatagatatatcaaatccttaagcaagcaataaccagcagcacagctgcatagaattacacaaagtagtcacacagtacacaaatcaacatgtctcaagagtacagttacatagattcaagagttcttcattattcaaatagagaaatataaagtcccaggtagcaccgtagcaggcacccaacaggcaacaacagcattgcatacaccaaaccaagtgtccaagactccaaatgatcactgatcaggactgaattactgagttgcagctggagtatcttccttggaaatagataggtcaccaagttctaaaataatagatgatctcagttagaacagtcaatagtgtatgaatcatgaagcacattagaatttggaaggaaataaaaattttctatgttaccttcctcaagcaaagccatttgttcgctgtcctcttcaacactaacatagtttcctccacgaagccaatcattagcacaaacaagacgctcaaccattcttggggttagtgaggtcctaaagtcatctagagttcgcccaccagcactgtaggctgattcaaaggcaactgtggtgataggaattgccaaaagatcacaggccaaatgagataatattgggaatcttgttgaattggccttccaccactttagaatgtcaaattttggtgtgtccggctcattatcttctgatagatacttgtctacctcagatttgatagttccacttccaccctcactgttaagttgctgagtaattactgacatccacctacaactcactcttttgctggtttcagctgtagattcagattcagtaggttgtggtgccttatcttttggggtatacatttccttgtactcttcaaacaaagcacgaaaataggtattcactgtttcccatactttttctcctactgtatccccaaacatcaccttaattcccattctaatgcaatttgatagtttgtatctaggatcaatagcaacacagaagaagacagtgaagttgagtagttgatcccccttatctttctctcctctcttctctctgtccccttgcctctcaccatacttctctccccaatacttgtagtacttcattagcattcttgtacccatttccttgctcaacttgtcttcactatgagaccattctctcaacagaagtaatacatcagcaatctcatggaaataagtgtgagatgttgtacgactttgtacagaaacacggagagtgaggtcataaaagtgttcaagaaaatcagccatcttcctagccttctcccaatctgctcttgttggtacccctggaccattctctccttctaattctaatttgtagtatgggtcttcatcactatatctttcaaatgctttttggtacttctctgcagcatttaacataagataggttgagttccatctagtgcaaatatctaagtttagaaatgctttgctctgtaccttggctaactcagcacatttcttaaattttaccaacctagatgttccacatctgataaacttaacagcagcacggacacgttgaattgatgtaccaatttccttcaagccatcacctactattaggttgataatatgagcagcacagcgcatatgaatgtactctccttcagcaacacaaccttttgactcattcaagacccttctcatatacttaattgcattattgtttgcactagcattgtctactgttattgtaaaaaccttgtcaatgccccactcagccaagcagttctctaatgattttccaatgtcctcccctctatgtcccttaaccaaaaaaaaaccaataattttcttctgtaggttccactcattgtcaatgaaatgggctgtaacacacatgaagttttggctgttcttagcagtccatgtatcagttgtgaggcaaactcttacacaattgtccttaaaaaatttcttaagcttttctttctcatcttcatatactttaacacaagctctagtgattgttcttctagatggcagaacaaatcgtggacatgctaaagtcataaatttcctaagaccagaacgctcagataggacaaatggttgttcatcttcaattatcatctcagcaaaacaccttctaagtttatctggatcaaatttccaagtggtcacagtaccaagagtactattgccatcacatggtgtcagttgcaaagttccttgattatcaactactggtttgttaggattctttttgcaaatctttagatgagctttcaaggatgacgtaccatttgttcttgagccgcaatgaaatagcttggtacaccacttgcacttggccctctcgtccccattagcaagtttgaccttgctgaaactttcccatacatcagatcttagagccattggttttctttttctggattcttcatcagctttctcttcatccttggactgctgctgctcctccttgtccttgcttgcatctaccactccagtagttgacactccggttttagtgtcttgagattgagtgtgattaatctcacaagcaacagtttcatctgtgtcccccatctagatcaaatgtttcaaatcactaaatcagaacttaccaacatagaacagcaatacaacactcattcactcaacatggactcaactagaacaaacgaacaagaagtgaagaacttacataggaggactgctcggtccgcgccgccgttgtcttggtcggagaactccacgagggtgttgccggcccgccgccagcagcccgtttgccggccgccgagttagggtttgggtctttgggcgcagggggcggtgtgctcgcgggcggctcgccggggcctacagctgctgctcaggggaggggagtgtggcgctgcggccgtgcggcgtgccgcctcgagcccgcgacggcgaggtagggcagcggcagcgctgcggcggcaccctgcgcggctggcggccgggctagcggctgcgccgagtgacgagtcgggggcgtgacgactgacgagtcgggggcgtggcgtagggttggccttgcccttgatggcctgatgggctgcgaactggtgggccgtgggctgcgctgccgcgggatatgtcggtttaatcggttgttcggttcggtttctctataaaaccgccgccgcgggatatgtcggtttaatcggttgttcggttcggtttctctataaaaccgaagctgaagccgtacaccgaatagcacaaaaacagaaaccgaactgacaaccgaaaaccgaaaaaaccaacaattcggtttggttcggtgcggttcggtttgcggtttgcggctaaaaaatgcccaggctgacctcaagctaccttagatccaaacgtcttcttactgtttcttttttttttttaccatacaacaattttgcaaactctaaatattcttccctctaaatattcttcccccaccatttcctttatccttgaccgctatctgtttgaaataaaatataaatatcaaaaaatgatgcaccatcaaaatactttgcatggtaaatataacaatacttatcaaaacatcattaaaaattcttactgctcaactagaaaatctcattggattaaaaaaaaagctaacgaataaagcatcagccattttgaatatatatatctttcgtttcaaatacgaactaaataattcctataaaaaacctgataatatttgtatgctatagaggatcgatgaatagtactaatgggatataaaatatccagcgtgccacgcgccattttctaatcataatgttagaacaagctcgaaattgttacaactcacatgcaaattaaatgccatcgactagtgaactttggtttagtgatcgtgctagtctgcaaattaagctgcatttttgttaatatctcgatggaaggatggcagccacgacgacagcaacgccgaacatgaggatggcgagaccggtgaagttgacgacgaacgcttcgctcggatagccgtggaaggggaagatgaagcgtgctatgccggtctcggcggtgcagatggccatgaggaagatgacgatgcccaacaaaatgtgccatggcgcgtagtcagccctcatcgtcatcaccgcccccgggaatacaaagtagacaaaacccaccagccactgcaaataattttagtcaccggatttagtgaaatacaaccgcctcaccatttcgcttaatacttattataagcggaaacagcttatcaacggtcaaaaaaattgtgaatttagtttaaaaaaattgtgaataaatcttttatatacgtgttattagtattttaaaaacagatgctgaaaaaaaaataaaccaatatgaaaaaaaacccttaaaatcaactctgaaaattgagtcataaaattcattgcctcaatcaatttgaaagtcctctggctcacctgaaaggcatagagtgctgcagtggttatcccaagccaagcatggagggagcggatgtcaggggcgcggagatcatggtggaacttgaaggcggcgtacaggccgacggcggcgaaggcgagggcgaccagatgcagcagcaggtgcaccgccttcttcacctcccttgaccccagcatgatcctgtacgccattatcgctgcgagcaaccatcatgaagtacttccatcactgcacagctaatcagtactactaaagctatttcttcacatatctcctctcgatcaatcacagccattttctttcatttactttgtcttctcaacgaatcacacacttcatctaattattctcatctactacctccgtcccaaaataattgcaattctatgttatttagcatatattaaggtttgaaagaaagactacggtgcccctcattaaatggtgtttatgtgagagtgggaagatggttgagggtaaaatagggagaaatttgaatgagatatgattgatggggcaattagtactctagaattacaattattttgggacgaattttgaatcctagaaatacaattattttgggatggaggtagtatttttttaattcccgtgccaacctcaaaaatactccctccttccaaaaggctaagtcctatttcttttttcaccaaaaccaagaagcaattaatttgtttctatgtgacaaaaccaatgagcatgcaatcaataagcactaaaatagcttcttgggtttctatcaacaatttaatttagcacataataactacaaataggacttagacttttggaaaaaatcaaataatgaaataggttttatacttttgacaaggagatagtaatgtatactcctactccctatgcccgtggattactagttcattagctgataataattaatttaccttctcccgtgcagatgacaaggccaatcaccatgaagagaggatgtgcctgaaaaaaagcacagcaacatataacgttggttgcttgtaattgattataattaattaagtaagctcaaggtttggtacaaacacaactacacaggtagattagacaatttgatttgacatcaccgtgtaaacgagctgaggggtagagctcctatgccaggaccaggagacgccaccccggaagtgcagcacccagacgagcgtgagcgtcagcacggcggcggccagcagctgcgcgaccaccaccaccggcagcgcggtgagccggaagctggcgctgctcttcaccggcatgactatgcctctctactcttcttccccgacccgccgcccgccggctgacacccacgtcgagctcgccgccggcaccaccaccaatcaccaccagcaaccacggagagatggcaatggcatacaaatgatacaatgctgcagtacacgggttataagggctttgttctggtgatgcaaccaaggagtgctcaagtaaataagaaccgggtcaatgcaatcgtaaatttatttgatagttttcaatcctgctaagctagctattggaggagatgaattagggtgcgacaaagccaaggaaaggatgataaaaccggaggaaaggtctaagttttggactgtttcggatttgtccggacggcagaggaaacagcttagattgaaatcatcccagctgggacagatttagctgaagttactacaaattgcccattcatcagggatgctggagtaaaaaacaagggacgttattatgattttatattcgtatcaacctgcgcgtcgccggcttgcttcaagcacatactaatagcttgtccgttcctgctggtccatatgttgtgttgttgtgttgtcggtccccctcgcaagcttgaaaagtacaccacaccgggaaggcaaatcaatccatcagctcaaatgcggccgtccgtctggactactttgcttgtcattgcaagaatttctgcttgtttgcgccgagcaggttcttctcatctccagccaaactgaaactgaaattggtccacaaccacctcaagccccacttctcttcttgtagtatgtacgtccaagacctgatgattataatccatgcttctggtgagaacagaaaatggataatgtaccaaaaccggttgcatttttttttgtttcaacattcaagtatatacagtataccaaaaggatataaacgcagccaagaatatgtatgaacataccaacatagccgtcctatcttgtcctatgtcctggcatcgaccttggtaaccactgcattcaccaatagacagttagacaccacaggccctgcacataccgcatcatcatgtacaggggaagggacagcaacaaacaacaccggcaagcaaaacttaagagcccaggaaaaatgctaaggtgagggctagtacaaaaaatgctgacctgggatctcagatgacaaccatagaaaccagcatccaggctgcttgcaaaatggaagagagaaccagcatcctcccaaacagcaggaattcagatatagaccaagcctgtaacagaatcacgaccgttcatcacagtttcacagcaactacacaagtaacaaacaaaaccagtactatatggctgacatacagcagacagaaacatcatgggcttaactctgcttcactggaaaggatcaaaactataacacagaccatcacacaagcactattaataccaagagaacacaaaatcacgaaaaacaaatacagcttaaaatatgctggggacatcttttgtgagcttacaatatatacacaagacagcattcgggaacccatgggcaacagaaccagaggcaaacatgacagctgaatcaaataatcaacttttctagatgcggattttgtatacagagggagcttatgtcatatgttacaaaagccctgcctatgttagcatactaatcctacaggacatatcaagcatgaatgttcgctgcagcagcaatcttgcaacaaaagcttgaaacctaacctgctctagagccagtgagagttgtttttctcccggcatgttttcaaaatgaaaatgcccatgcatgtatatctatgagatgataggttctgttaaagcatgctaaaaagcaagcattgcaatgtcaggcataatctgtccagctgacaccttgctcaattctggtcactagatatggaaatcctgtgatgtttcgaaacactgacgacatgaagcaactttgttccatgaggcacccatccaacaaaatgccatctctaggtacaggcacctgaggcttacaacccattgtcactagaggcttggtttcataatcaatcgtctggtgttgtgaataccaacaccttcccatcaccatcccatccaccggtagagccaagtgcacatcttctgaatagacgccaccttgtccatccaagactgtccagggctgcacagaccaagcaaatgtacagttacagcagtgcattctttacacttctcttcttgaaccattcgacgaattcggcctcctaggcattccaaaaggcaaattatctctagacctatcaccaggacgtcccagatcatccaaatttctgtaactgccatttctcggaacagagttagaacgttcatcctcatcaggcctcatgctaaccctggaatctggaagcatttccaaatgcctcggtcttggtccaccagtcctcatgttccttatgttatttgaagtgttccttcctggagtgttagagatcttcatggcaaggaagtccttgggaatggtatcaagatccataaaacatttcctggcctttgcatctgctatcagtaaagcccagtcctcagactgcataagagcaccggcattaccaacaacctggaacagcaaagattatcatcagtacccaaatcatagatctaaggtcatacaacatttttttgaacgaattttgaataaggggaagagacgtacccatagagctctcctagctctagtaagagcaacattcatacggcgtatatctgccacgaaacccacaccatgatttgaggcacggacacatgacataataatcacatcacgctcctgtccttgaaaagcatcaactgtgtttatgtaaatgtccttcccatcctcagaactcataacctcctcgaattcccgctgaagacatttcaactgcaacttatatggtgtgattataccaacagaagctttcttgccaccattagctctcaagaacttctgaagattctcatacaaacgcaaaacaaactgtgcttcatgaacattctggtacgaagatgacccacctctatgagattcacgaccatgtgagacgtcatagaatatgtaaggtgccattaatgcatctctataatatgcctcgncaggcaatttgacaacactttcactatctgtaaggcgcccttgatagaagtgtcttgatggaaattcacggatctggggatgcatccgatactgcaccgataacaaaatggtagggcaaccagacaactggaacctctcaaagagactcctgctgtacattaaagtcccagctgctttgctgataacagttgcagggagctgttgtggatcaccaaccaagacacacctagctgcaccgagcgaaagtggagggaggactgctacttcactagcctgagcagcttcatcaattaccaccatatcaaagccatgactaaggcgggaaaataacttgcgaccactgcttgaaactgttgtaaaaacaatttctgcttcattggcgaaacttgcttctagactagccctagcatcttccatattgaagttgctgccaacacggaacctgctttctaatatcagcaggcgtgacatctccaccaatactttatccctgctttctactgaagcagcaagtttctgaagtagaaaatcacgactacgatctctttgagcgagcacatcagggtctactccaactgaaccctgcgatctgccagccgctgcaaccatagtaagttccctttgtagaagggctatctcctgtgataattgctgctcacggcattttagctgttgcagccacccaatcacttcatcacggcccttcattaaaagctggtcagtccttcgctcaactgaaacagcttgagcagcacgagattgtgaatcaactccaacacgggcaacatcaggacgatagaccttcatttcaccatctataaaaccacgatcaagaacgcgagcaagcagctcatctgtggcggcgtttgatggagcacatacaagcatccgtggtttggggcaaagcttgggaagagtgcggaaaaggttctgatccatactctgtaaaacttcatcaatggaccctgcagcaacagtctccgagctgttgcttgtgttaccgctaacttgcttgtaactttcaggagcaagcttcttgagcagagcagcatagtaatgttgatactgaacaagatggataacatttagcatcccccataccgtatgggtttttcctgtcccaggcggcccttgcactaatgtgaaaggccagggttcttgtttcttcacagctccgttgcttgtgccagcagctgtatgcattgcagcccaatgaatcgctgatagctgaggcccgttgaaagtacgatgcagatgatcagcaaaatttggagtgaaacaatcaggcatagcaggtggctgctcttcatacttggggaagtgctctggacttggctgaagaatagcattttgcatctgatggaaagatttttgttaaaacaactggaaaagaatattaacaaagaaagcaaaatatataaaatgcattacctgaacattgagtctgcggaatgcatgcaaggcaacatattccctttgtgttgttgctagggaaccaagactagtcagataccaggtgctccgaggttggagtttcctcaaaacattggtctcactgcttcacattcaacacaatagagtgataagataattggaagtcaagtattcagaacaaaagcgtagacaatagaaaaaacattataatattatttgtccatcaagcaggaaatcctacaggtcataagcacatgaataataacaggtctttttgctacaggctaacaaatgtagtctagcaaatgtatagttaatctgagcatgttatgcatacatgggcaactgtttaatgcaactgtgagtgtaccagtgtagtgctcaccggctcacaaatgaagagttacttaagtgctggactgaactcactaattatctttacttttgggaatttggaaggaatgcatcatagaacatttcaacatagaaggcaatgacacaagttgtggctatgatcaaggatgacacgcatgcttggaccctggcaggagtctactggatacacaacaagcctcccatcgtttgccctacaacttataagccgcttttggagttgatttttgtggtttctttgttatagttatattccagcattggctttcaaattgctaagggcacatacataaaagttttaccctcaaatttccttttgttgttgataagccataaagcttataatcagcattagcccaaccaatggcagatctatactcatttaaagaactccgatggtggtggtggatggtgagtttgccaccacacaccaccattgccatataggacccctaaatactgagtaggtggactactctatagacagatgtacaaatacatattaaaaggcaacaacgtagcttgaaataattaatattgattacaatgggaattttttattatgacttttggggctttagagcgcatggtggggttctctagctaaattatgatgcaaagcacaggcatttacctagttttggtagatagacctgcttgtgtaggacttgcttgcttgtagtttgttccatctaatttcctacttcctccattatcaagtataaacatactttcctaagttgtttggcagagactaaaactaagtgttttacggtcgtacataacctagaacctgttgccttcaatcccgcttaaagaaaaaaatggcaggccttctgctatcccccccccccaaacccccaaaaaaaaaggactcgacagtgcatgcatgtaagcgttgcttattgtatcaaccaaaacaatctgtatgtcaagcaatgttatatattgagcattgcatgctctaggaatgccatgtctaccagaattgaacaaatcctaatcagcagataccagatatatgagcattcaagggacaacacaactctaaagagtacacattcagaataataaataggtttgcaatgaaaaaaaaggtagtagaattacaattttgccaaatactagcgtacctgctagaatcaaatgaatccccaagatagaagtgaatgattgccccaatgggatcgcgtgtatcaataggcgtatggcgtctgactgtaccaacaagccgtccacactctgactcagtgtcttcatttgaaccaacattccgcctattagatctacttgattgggaagctgacaacaaagaatagataaataacggttattaaaatatttccttttcagataaaaggaccatcagggcttaatacaaatgagaaaaatcaagcatagctacctgaaccaggcctaggaaaggacaaaactgcaacttcaccttctttgaaagtccatttatactcgtgcattggtagaacaacaacatcataccatcctgaaagcattgcacaagcattgacaggtgattgcattgcaaccaagacatgtttgtataatagcttcatggaaaatgacatcaacaaaacatgctggagatcagaacatacctctttcacgcctctccactgttttcacccgcaccataacatgtgcatcccttgatacagactcaagactctcctcataggaactatataactgagctcgacattcctcaaagagcaaaggctcgaaaactctaatgtactcctcagcggattcaaaacttttaggaacacattgaagttctgcctcctctgttcaggtaaaaaattacaaaacatgaaacacgcaattagaacatagacaatgtgattaagaacatatacagcttgttggaattttagaatgaaaacagaaacaggaaagattcatcagtcatgtataagattcgtatgagcccaacaaaaatatcagagaagaaagagttctactttgagcaaacttcgaacagccttaataacaaagcacaagtgctgagcattaccctattatttaaaaatttaaaacatgtatttatagaatttcccagtccttgtggcacatggtggcacttctagttaatagaagtcactaaaaacagggtaaaagcattcatcactagacagttccacaatttcaagcaattgtatgcattttcccatagaacatcttattgtttttcaaattgagaaatggacaacaaagaacaaacctggattgtgccagaacttgtcacttgtcacctcccgtataagtcgttcaacagaagtgtcttggtattgcatgttatttgctggagtttgttttttggaaacaagagacctcttgttgactggtttctgatctacagtattctgtcctgttacaaccgatctctgagaagaaatttgtctgccctttaactgtcttggcattggttgttgataaccatctgcaggggcttcttcagcattcattttctttggccggccttgagatcccgtctcagcatcaccattggattcagaaatttgatcgattggatctgcagaattacttcgttccgaaccaagcatttcagattgcctctgatccctgatggttggctgactttgtctttctgcagctctttcagcaataccaccaccactgcgaaaagcttccttcacagtacgtgtgacaattggtgctggaaaggatgactgtcttctgggtgttgatgtcttcattgtgccagcttgctttgcatcctcaacattaatgaacacagtttgcctggctctctttttacctagcattgcctctttgtgttcatccaacttaggtctctttgaagggttacttgcaaacttcaacgcataattggcttctacacctctaacatcctttgacttgttggacagatctgaatcatccccaagctgatttcctttgttttctaaatttttcgtgctctcaagtcctgtgggaccacgtaccactggatccttaggcacatccatcatttcggtgtcactgggctcagcggcggcctcatctttaatcatgttaccagatttgacagcagtaggttcactttcttgggaatcccttttcacttgtgtagttgcagtaccagccaactcttctttgttgctaacactactccctgcagtgtcagaagcaacatctgcatcagaccactctccttcctctctttccactgcatgagaaacctgattggaggacccaatcattttagcaacaccatcagagctatggttcattaacatagatgtagaggctatgctagcattcaaattatcttctgccttgattggctcctttgtaatttgtgaatctttgctcctcacaaaaggctgaaaacctgaaccggacggtgcgtgcttaaagacattattgtttaatatcccctgcgactgtgttacttcctgttgcggaaatatagagggccttgttgtggaaacagaaagggtcttttaaggttgtgacacaacaactgcggcttcttcttcttcagcttctgttgggagctcattaaggtcaaataacatccttccacgagaccccatgtcatgggtaaatgcatatagtttgaacctttggaaactattggactcgataacaatcttctggggtaacagaacctactttttgaaagctataattgaccttttgtagaaaatatctgcaaaaacaaccagcacaagataagtaatatacagaacgaacagggttctcaagggatgcttggatgcttcggtccgctagtgagatggctggcccacagaaggccaggagaactgaacaagtgaacaattagagcagagtccacatcgcatgatactgcaggaaaggaacatttcaatcaggtgaagtgacctgaaaatcattcttcgctggattccttttgtgctgtgaccctgcccactccgtcctcttgttgtccacttcctacccatctcaagaatttgggttctagcaatacaggatctcagcatccaggcagacccttttacagataaagtaaataagtatgcagaacatagctaagaacaaaagaatgatgacacattggtggaaatgtttgacatagctacttaagagtgcaagctaggctctagattcttcgttgtttctaaaggaaagcaatgtaaacaatagcaccagtactatagtgtccaacattaaggtttagaaaaggaagaagtaaattaaaataagaatgatgttggactttaacatgagctgcagcaatgtcaggcttgccgatattaacagagtactaaataaaagaaaaacacaattaaagcttgcataaaacagaggctacctaaataacaggaggagaaagagtgctcaactagtctagaaactttcactagcccaacccaatcctagatctaatccggcactagcaatctcctttgcaatcccttagtccaaccgtaactgtgttatgattgtgcatgcgacatttgccgaagaaataccctgccaaaaggactcatgacagaaaattatcaatgccatcaccaccaaactacaaaaccgtaactgtgttatgattgtgcatgcgacatttgccgaagaaataccctgccaaaaggacccatgacagaaaattatcaatgccatcaccaccaaactacaaaagagagtataaacctaaaagaccatcgagatctttgccaaatctaaacaactttgtcccacatgaacaaaaatacacactaaaaccgacaaataatcccttctacggaatttgccaaaacatcaaccgtgagtgacagcctactcccaatcaaaagataaataacccatagctactccaaactatagtcggaactaaaaaagaccacttatctacaaatgctctcccaatcagtgcaaatgctacattctacagctgcatcacaactattgagtttaaaattagaaacaaaagcagatattactgatctacttaactctgattggaagatattgagttctagctaccccaaattaaaagctaattacaacagaagaaacagcttctgctaaacatgccccataaccaaaggctacatctttttcagcagcaatgcaactcttgaaaaagagaaaaacagcttcggaatctatgtgacaaataatcccattatgcaacttcacaagatatagcaacaatctacagctgctcccataaagagctacctatgacatgagtaccttcgggtaaacacaaaccaacccctacacgatttcagacactaagacatttactaagtaacaaaaaaaacagggcagccagcatagcggcagataaagcaatagctttaaccttctagtggttgtgacctctccacaaaacctagcatgatgaatactacaacataccaggactattgaaacttggaaaatacaccactgtagtaataacttaaaatgcttgtttgatcaacctaagcagagaaactaagaaactctagacagcaatagcagcagcagctgatgacagcaaaagcaatgcagtgactaactctagtcaattgtcaagcactagaatttattacgaaaatttataacagagcattcaacagacgcgcagaacagcagcacatggaccattcgaactgaatcatcactcggcatttcattccactcgcaaaaacaaaaaggagaaaacgtactaccatccctttattaccacaactccatgacgcaattccccccgttgctctgctcgatctaccaagcacccccgtgtatttaaacccacccccagtcttaaatcagcaatctggtggaaatttttcgtaaagcgagggggatcgttaccaccccgcaaacagttactagattcggcaaccaccccctgagccccctgatccccatttcgtttctagattcggcaaaatctcctcgagagaagtttctcctcaataaaagccccaattcggcagggcaaaaatattaaaaaaaatcccccgccgcgtccagtccaatcaaatcaaaccaccaccacacatcacgcgctatctatctactatcaatcaataatctattagggttctatccgttcgccgttggtcgtcctagggttggttgggagcaggggaggcgtgaggggaagggggggatctccgtaccaggcgatcggcggcggcgcggccagatccggccctgtgcctcgtctcctcctcctcctcctcccgcggcggcgtcggcggctttgactagggtttcccaccgagcgctcctcctcctcctcgtgtgatgcggtgcggtgcgatgcgatgcgtttgattttttttttctcaagttttttttcttgccccccttttttggtctgggtggtggtgtgtgtctcctcctcgcctcctccacgagcgagcgagcggtcggtgagcgtga

SEQ ID NO: 4861 - DNA, 6129 bp, Oryza sativa
cagatggttcaagtaagactggaattatgggtggaaagggttcataggatatggtcccacttgaattgttttttctttttaaggatggtttaataactgccattttaattctccgcatttttagatggcaccaatggcttgatccgtgcatttggaatggcacgttatcaatcacatggtagtaagttttaaaatgagtacatagtttatccaaatactctcaacttagcaaacggtttattgccgacaaaatacatttgcttgtatcctagttaggaggataattcgtgcaagaaatattcaattgtttctcgtagcagtttaatacgtgtgaacttttcgttattgtgcagatttgaacacggtaacaaaaaaagggggagaaaaagcatgcacgatcatcttaagttacggaactacctttggattgttatgaaacatttgtgtgaagttttgacacaagggcattagaaaacaacaagcattatttagtccactaaatcctaagcttaacatgaaaagatgtcacatcatcatacactaacaaatattacatttaaacatcatcatgcaacaatgttatattatctttaattttatagttcattaaattctatagctttttaactacaagcatattaaggttctattcggctacactctttttcactgtgttgcagccaacagccacagtgttttctttgtgcagctgctaaacaaagcagccgaataggccctaaatcatcatctcacataattcacataatatttcaatatgtctcatattttttatacctatatagttcatcctaactaatatgttctctttcttctctcattaagccatatcacatcaattattttgtccttagatgattatgtatggtccaaattgttttcatccttttcttctcttatgaagtcatatcacctcaattgtttttagctcttaaatgattaatctatgatccaaactatctccatcattttcttctatcataaagccacatcaacttacataagtttatattgtctagctatcttacacattatttttacctagtgctatcataataaactctcgcagtaatgcgcggggtttcacctagttacaaatattgacaatgacaaaatttgacaatatgtagtatgtcatcttaaatcattatatataataaaaataagaaaaatacaaagtcaccgtgttttacattttagagcgttattaagtcaacatgtgtcatgttttaaaaattaaaaaaatacctaaaatttaaacaaaaaattaaaacgtctaaccatcgggttttcacttaaatcgatgacctattaatattattttcaaccacaaaatctgcttttagaaaactcttaaatcgtgacatgtcacttcttaaaaattagaaaagaaaatcctcaaaacctgaggggaaaaaaatctaattatcggtattcatttaaatcatctagataaattagaaaaagaaagtcccaaccaccttcccatctcattgttggtatttcttaacggcatgactaaaaatattcattcccagcaggaatagtcctggtatatttatggttacagaagtaatccgctcgtgcacggattaccattgtagcatttcacccggaagtattacaatgtatcatatttatttaatcccaagggaagattgtgaaagagataaccacgctaataaatacacatatatatcacttgcctttatcaaagcctaaacaagggttaatttaatataaggatagagtgacacgaagcgaagcttatagattcctcatataaataattctaactaagtggaagaaaagatagaaataactcatttcctatacttctaatatacactcaactttactctgcacttgctagtatacaatcatgtgcccaataccccctagcaatgccctcctgatatttcgagagaccaccccgagtagtcgagtttcttatgacaacttgtcatagccgtccaaccgaggctaaatacggaggaatacccttcccaagaatttgtcttaggaatatatactaacgtggaggaatacccgtactgagctatcaccatcagcggcccacctctactgtctcgtagcatatatgcccaaataatgatacttactaatctaagcaccatgcttacattaataaatactactctacacctctgcagatgatataaagcaaccgataaatcgggcattaaacttacaccattgcacctctctagtaggctacccacacaattatactgacgcaaatataaagtaagagcagtactcatactaagtagaataccgagaatatatacagaagagaataaaaaagctactagagccataccgaaactcttccggaagctccgaggactccgagaattattctatactacttccacttagcactaaactactaaataaagtatgaaaaggaatcttgagcttgcttgagcgtgttgagagagtgaatgagcttctccttttatagggtcggtatgacacttactgccatgcgaaatgtccattttacccctgtaaccgtcaacagtaagctatcctggacatccatgtgtaaggccagctggagccgcaactagcctgggccagcccagcaggactccaagtttggcagggtggctggcaggtgggtcctattgacggttgtggcagttaaggcggttacacctatcttgtgggccctccctatccgtttgcttgcttaggagtgaggtttattcactttctctttattttatttgataaagtcctacaacatattatttattattctctaagtacaagtggaactatattattctgaaataaatatgcattgcaagcacagttaattctccattattttagttacattgatgatcgaaatttatctgtaacgaccgtcaatactcatgcacatagcactacacacccctccctccgactcgagttctatgctcttcgttaatctcctcctccctattttttagccgtgaaacttaaatacaaaaaatcaataattataaacagtacgtctgatttcttatctacctattgctcaaattacaatcaaatcaacaatgcaagattcatatgtttatattttgctatataagaaatatgacattttggcacagtcaacctatcacttatataagtatctcaaacacaacctacgatgcacacacgcgtgaatgcgagggttaccttcttagtaaaataataataacactggccttttgcacatttcaaatttctagtcacaaatattgttttgtgttgcgtattaacacaaatgtgtagaactatatcttttttctcatgttcaattgctagttataaaatatcatttttgtgctatgaactgaattctctcaagaaaaatctaggttgaatgcacgacgtttctcacacatccatcgacgtcacatgtaccatctaaccctattaattctacaaaacgctactcccaaaccatcgccaccatcgtctccttttgctcaggccatcatagatggtcctcatgtccccatcttggatcataacttgtttcatgccatagcctttttttcccttgttccataactcctaggcaccctcccaatccaattatggtgtcaaaggtttgtccgtgtctttgcccgtcctgtctttctaaccttcaggacatcaaaaatcctaagccgtcacagtcctacgtaaattcctaaacttataggggtacatctgaaaaaggtaacaaactaaaaatcacaggggtatccgcgtaaaagttgcacagttcgactttgatctcacattctcacccacctgtgacctgacgcaggtgcgaacccgaaaaaaaaaagaaaaaaaaaacggtgtaatggaagggacggcctcctcatcacggggccacccgcacgcaaatgacgtgtggggcccacggggaggccaccccggtgaggccgaggtgtcagtgccatgctgacgtggccaagcccagcccgcccggagatcgggaaaggcagcgtgttcggctacgcgcacccgagggagctcggtcggtgagtctcccactaacgcgtgggccccacctaccacgtcagcgtttattgggtagcttttcctgtgcgaaataacaaaagaggcatgagttaatttgttcgaccagataagaacccagcttaggtgacgtgcgcgtaggccatagagccttatgggcccgcatgtcagtgagggttttacaagtgagacgggtaggtgagaaatcgtttggatctggaaggatggagggatggggggtttggggtggggcccacaggaccaggctttggaattccaaagctcctttgatccttggaattgtgttagcggcagctcctgggttgtgtttgcgaggggaaaaaaaaaagagaagaccaagaaggcatgcataattaatgagtcattagcgtatgattaattaaatgttttttctctatcattaaatatttgacgctgttgacttttttaaatatttttgaccgttcatcttattaaaaaattttgtgaacattattcaaaaactttagtactagtatatttaacaatgaatcaaatgataggaaaataattaataagtacttaaaaaaattttttgaataagacgaacggtcaaacatatttaaaagagtcaacggcgtcaaatatctagggacagagggaataattattttaaatttaaaaatagattaatataattcttttaaagctatttgtattttttgtttttttaaaaaacacatgtttagcattgaaaagcatgcatgtagaaaatgaggtatttttctctcctttgtccatcaaacgaaaacgcaccctatgtctacccttggcaggagtttaaagcatcattccttgctgaaatcattcttccatcaaggaaaaagaggagaaaaggaccttaataaatgagacacttatcagcttgatattcttcatactcctcctttctatgtgtgtgaatgtgagtgttgtgttcatttcatgcatgagacaattgcaaagcaaaggaacacatgggatgggatggtgacagggatgtgatgtgaatagcttgcacatctcaaatgctcaaacaacttttatgatgggtgtgctgccattgtatagttacttcctacttctatccacagatataagcattccaagcatttacattttgtctgtaaataaaaccatattagagtactacgtctcttatccatcatctcttactcaaatttcttgtcatcttagccctcgccccctcctacccctttccatcccttctttaattagggccgaaagtattttctcctcgaacttaatttctactttaaaaaaattctagaaatatttatatttgtgggttgacggtgtaagagttatttgagcaaggatctaactaggctaatcgcctactatattttgtgatggcttttggattagtgtttcccttttggtatggtttggcagggtgtactttgatggttggttctcaattggatatattagcagggcatcctgaacatagagtgttgcgacatgtgaaagaagagttgcagaatcatgatatatagcgtctcaccaatattttcaagcaatgatctgactgatctaattaaactatatccgttcaaaattcatatcaatctgttcctgcatttgattcatatttgcatccatgaatattcaaattcgattagtctttcttttaagataatggttcgattagtctttgtatagaaaatatggaagtccactattcaattagcattcgacctgttgacacccatagatggtatgtttaatatgccatttagttataactaagcacatggcactatttttttttaaaaaaacacaaactcagatgatgtgttatatgctttccatgcaccattttagatattgtttgatgggcagtgacaaccaaatccatttgcatgggttggcacttttcgtcctattggtaaagactgagcacaattttagaagtgactacggtgggggtaggcatctagatcatcagctcattgtcagtgccctggaccatagttcccacttcaactttcatgagaccaaaaaacaaaacattcgagaaaaaaatga

SEQ ID NO: 4862 - DNA, 11511 bp, Oryza sativa
aattattgtcatcacaaagcttgtttatacaagagaaacagcagcaaagcgctagtgctattactgtagcaaggaacatgttatctgtctaaaacttcgatggcagactagcatttgagaaaatcatcagggcaaccgaaaacttctattataagcacatcgttggaataggacgtcatctattaaaaaacggagggagtatgtcataaaagaaaatggaaaatagtactctctccatctcagtttaatcatctcttaagtaaaaggcataaaaaccaaagacaccaaaatattatcattcttaaagtaattctaatcggttaaggtgctccatcactttgtgacccgtagattactcgtgctttaaatattgcatgtcattgcatcaatagaaattaattttgattggttgcatgcaacacatttaatgacatccatttactctctgtacaaataaatgaaaagacacctttttttagaaaatggattaaaatccggcatctacatccacaatggatgtaacgaaaagacacttgttaattataatcattttaggaagacctaaaaaaatcttagggcacgatcaaaatgggatggatggagtagtaatcagcgaaaaaattaaagcatatgacataagagtataagaaagaagtgcaattcttaaaaaaaagaaactaaaatgaaaaacgtaaggttaaaaatattgcgtcctcctcgtgtccctaaccgtgagcttgctggtaacactttgccacaactttagcaagcaactttgatcaaccaagtctaatgtttattttattgccatatgtttgctataccatatcttttggtttcacttgccataggcatgcatttttgcctaaacttgtctaacttacagctaataaggattagccacacaaattgtgacatgccctttttgataaacttaaacaatataataagagatatatatgcatcagtgatgcggtggtgcacgacttcacccatctagagtttaaatcctggtatacataaatattacgcacattcaggtaaaacttcgatgggattttaatgagattagggatgtgccgtcgtgctgatagtttctatctctttgagtgtgtgttatggacacatttgtaagatgtgtgaatgtgatgttgtatgtatagtggtgtgtacgcgtttgttatgtcataaaaaaaagaaatatatgtgccaaagtcaaactgtcagagcgtctagcatgggtatgtcatctgggatcttaccagattttagtttgatcaatattgtgttgagccgtccgtaccagccattcacttgcatgataaagtgttgaaagagaaggatattgcacttcctaaatagtagaaattaattactcgttaggttggaatgatctttgtttcgtttaagctactgctaatgagttattaaaaagtaaaaaaaataatttcagttataatttttatatctaagtacgttattaatattttaaaagctaataccgaataacagattaagatgaattctaaaatcattttaaaatttaaattttgattacggctaataaaaacttcctctatcctatataaactcaatctggatatcagagaaagttcttttaaggagaaagaagtagactctgttttcatcaggcagctagtactgttgcgtgatgatttgagatttccaaggagaaggaacatggacggtgaccgcactctcacgtatgattggaggcttgacagcaggtataatagaaggctataagccagctataaacatattttaaacagataaaggaagagagagaatagcagcgggctatagatctgtagccagctgcagcacggacttcaagacgtgatgtgtgcatgacaggtgagaccagatattaatagtatagtaagcactatttgatgaattgactattacattggctaaaaatgatttaaaactagtattgagctgtactattaaacttgctctgaccaccattctccatctttcagacgattccccattcgttggatgtgtgactatattgtttagatggattacactcaccatcgtattgcttcgttccataccatttgctgtgctttactttcatgcccatcaagcacgtttatgtgaggcggctgacacttttgttcatggaaaggtgctttctataatatagttggttgtgttaggaagatcgttacaaaaacgctgaagaggacgataaggtatagctggcaaaacattatgtctaaaataatgaagataaatatcttaatttgggatttagccaaatttcgctttttccattctactgtctacattcactgtactatggagtatcaatgtgtcaaagcattgatgagtgaggagatgagtttccacacaattaatatgtagtactagaaaaattgtagatctttaggactgaaaatgatgttgttgcgtgatatttcctccgggttgataatacttgtcgttttggaaaagggcacggtctctaaaaaaacaactttgaccattattttctattataatatgtaaaaaagtgttaacaaatatatgattttattaaagtacttttcaagactaatctatacatatagctaccatatttgaaagacaaatgttttaaaaataattcaaattcaaagattctaaagtttgaccccacccttgtctaaaacgacaagtattaccagcccggagggagtagtgtagaaactatttatgtaacacaacagctgattgttgtcctgaaaatcattttatcaccttagtttttttttttagaaaatcatttgtcatcttcaggatgggcctatccatgtaggccagtcatttttgtgagcggaatatgttcacaccgagttcgaaattcatccctgaatcacaaaaccggatacaacacatcgctcaacttacaaaaccatgcaaacgagatcccttagcagtattatcgtcggtattggttgacgtgacgcctatgtggctcctttgactatgtcctcttcccacgtggcatttgacgtgacgcttacgttgcaatttgatctggaaaaataataaaacccctgggaccaacatgccaatttcacacacaaaataataaaaaatattggggcccatgtgacccatacatgtcatcgttactactcccctcttctctttatcctctctctcatctcttctctctatcctctctctctagtagtaagctggttcatctcatagatgctctaatggcctcacttactgagacggcagagcggggcgggcggtggctggagtggcggtagatagagcatgctggcagagcagagtgaaccatcgtcgtcaaccgctgtcgcaccagccacagctgccgcgctcgccgacaacctcaagctcctcctctggacaccttcgctattgttgccccctccgccgcccaccccgcttcgacggccagagagagagaggatagagagaataggggagagaaagaggatagagagaagagggaagcagtgaggatgacacgtggggccacatggggcccactatttttattattttgtgtgtaactgacatgtgggttccacaggtttgattatttttccaggtcgaagcgccacgtcaatgtcatgtgggacaaacacttagtcaaaggagccacgtaggcgccatgtaagccaaaaccggggacaatactagtgagggatctcgtttgcgctggttttataagttggggatgtgttatattcgattttacggttcagggatgaatttcgaacttttgtgacaaatttgaggtaactaaagtgaacttattccgttgttaaagttggatcgcaggcccgagctgcaaaggtagttgggccagtattgatgggcataaaccacggcctttctttgctcaattttgttgctcgtggtttctctcaaattgcctagattttcatgcactgttggttaatggttacccaaattgtgctttgtagcctggattttattgaatttcatcctacttcgctttgcatccccttgtcctaagaaattaatttttaagacggagggagtaggtttaaaatgtgtctcgacgtcctactcactactacaaaaatggttttttctggcggccaaaatcagtctttgctgacggttatgctagccgcctgaaagcaaaggctagagaaaataaaagttttcacaaacggaacttaaccgctagccaaaacggattttcgctggcggctctattacatgggccggcagtgaaaacggattttcgctggcagttgtcttatgcgggccgctgacaatggtccattttcgctggcaatggttctcttctctgcatccagatccatcatacgacgcttgtacagctcttggtcaacatgcggttgcaggggacgccgatccatcaccacttttgcgtaggagcggtgatctcgcttcttctcctcaaccctccaaatctccctcgcactgtccccaaatcgatgaatatctgaggaggaagcagggaaccctagctccggatcgagacccctcccttttctcacccacagccagcggcttggagacattgaggctttcgggaaaaggtcatcgatatagaaacccaaaggctgggctgagaacgcgggacggcatgggtgtagcccaaccaaagcgttgggctcccaggcagcccaggattcccctccagggtcagggggacgcgaagcaggccgcgcagatgggggtatctcaccacgctttagggaaaatttcctccaattcgagcgcttttccttaggggaaaagtgttgaacaccttgcgcgcgcgcgctccaatgtcgccacgctgtggcgccctcgtgtcgccacgacaccactctcaccgctctcgccacgacacatttttcccttcaaataagtttttaccccagaaggtcgccatggaactggaactgcctggctgcttcaggggaagaaaaatactagtactccatcaacaaaacaaaggagggaaggggaaggagcgctccatcaccagaggaaaaaacttatttatcttttttatggctaaaatataatgtattttaagataacattttacacgtatatgtaatattattggaaggatgtgactatttttttttaaaaaaaatcgcgacattcttacctgaataagagatattccatctatcaaatctattttagcagtggtatctttttttttttttgcggggttagcagtggtatctttgactaaaaccactcgtgacaatgacataataatgtcccgctccccgaccagcgtcctcaccgccgacctctgcaacggcgaggtcgcgtcgctccgtcgccgccgttcccttctgccccgccggcgccgggggtggacccggatgcattcccccaaggacatcgtcgccaagaacacgctctgacgagatcgaggtgagtgggaactgggaaggccccctcccatggtgaaccccaactccatggtgctccaggccctcgcggcggcgaatcgaggaggaggccgagaagaatgaagaggaaggcagggccgccgcggcttcaccaccaatgcttcttcttcttcttggtcgtcgtcgtcgtcgtcttgtatgtatacagatacagctatacacataattttaggatcaaaagacgtacagctatatgtatttctgggggctaatttcagtgcagagtgaattaatgcgttgttgctaattggattgctagaatatgtgtagcagagtgaaagctagtgtgaattgagaccattgaacaaatggtttagagataataacttagctgctttctttgaattgccacatgttcagttcaatcacctaattttatctgaaaagaaatgttcgatcacccttgtctggatgaatagttactcttgtctttactttctagtgatattctatattgctacgaaagcactggttgtccttcattatgtttgtaagattgaattcgataacattttttgtcgtctattgcttctttagacaaagagggtatgtatgtcagtcagtcaaacaggttttccatggttgtaaatcctctcttacaaagttatagccactaattccttcccagaaattgaaactatgatcatggcataagcagtgtagggtgatcttaacataaccagtagcatactatgcgcatcatgaatgtcagaaacaggaacataccagtaatgcgataacatgctagaggcatcatgtagaacaggaacaagaacatagcgcacacagtatagcgctaacaatgggaacaggagtagcgctaacagcagtagaaggagaagattataccccgagaatggccctccgctggatggtgaggcagaattgcctccgttgttgtagtcgttcatggcacctcctcctggcgcaccagctctggatccagctcctgtcggcggcgcagctcctgtcggcggcggcgcaccacctccgccaatagcggcggcagcaactccagacatggcgatgagcagtcgtgcaggaggcactccccaaaaacctgatcacccgcctacccgatgcagatctcaggcgaaggtgtggtttcggaggcactacttcttccaatctctcgtgcgcgcaagagatcagaagcggggaagcgagagcaactcaggcgcggagaaggagaaactaacaccgggaaagaagcgaggaactcggatcggactcgcggcctccttatctatcaggagaaagaacgtggacgcgctgttgcggagggaatcgtgggaacgtgggttagtggctgcaaaaggatagcgacgtgacgtgacgcacgcacgccggccagcctcgcccacggccacggccacggccacgcccggcccggcgcgcgcgcgcgcgcgcgtgtggcattccgacccccacctcaactggtcaacagggagcctctaataactccctatttaggttgagatatttctcgcttaaatccagaggtggtattattatcctcaacatttattatgggcctttgagatttaatattataagttgggcctagcccaattattctaacaatccccaccaaatttcaaggctcataagaaatgttctcaaggctgtgcctgtttgatataccagggttttggtggagactgttaagttaaacttccacctaggaaatgagctacatcagaccacaactgaacaatggactatgccttgaattgtcagttttgtgtgatcaggtttcactcagacccttgactggtactgggctgccgttcgcatcccctctgtttggagcatataagtcaaactccaggcctttcatgagtatctagagattgcccaaacctcatagactgtgactagcagtcgaactcatataggtgtgttccttctgagatgttctgcaggtcaacatctctgcttggaaaaaccactcggatcacattaagacataagccatcctaccatgcaggaaagaagagaagcacatcatgaaaatgagcccctttcaagggtcttttctctcagtcacacaataatttgtttcaccatccaaattcacgggatctccgatcacaatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcagcctcaactgtcgcagtatctagtgctgtaagttctgcttccattgttgacctcgttaagatggtctgcttgcaagacttccaggaaacagcgccacctccaagtgtgaacgcatatccacttgtggcttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgccaggcctcgttgcgctagccaagtacatcaatgaaccaatgatttgagagtatctcagttgatcccttcctattcttcggtttttccttaatagcacgctgggatcataaggagtaggagctggcttacagtcactatatccaaagcgactcaaaaccttgtccacatagtgggattgcacaagtgtaatcccatcctcatctcctctttgtagtttgatgttaagaataacatcagcctctcccaaatccttcatttcaaaactcttggacagatagtctttgacctcctcaatcacattaaggctggtcccaaagatcagtatgtcatcgacatacaagcataagatcaccccttctcccccaccatagcgatagtatacacatttgtcagcttcgttcacaacaaagcctgcagatgtaagcgtggtgtcaaacttctcatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtagtcaagcgagcaactggtgaatatgtgtcgaataaatcctcgccttccttttgggtataacccttggccacaagccttgccttatacttttcgattgtaccatcaggcctaagctttttcttgaaaacccatttgcatcctacgggcttacatccatatggacgctcaacgacttcccaagtaccattagacataatcgagtccatttcactgcgtactggtttccttccagtagtcagcgtcaggagatgaatatgcctcttctatggttcttggggtgtcatccacaaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttctttactagaagtgttaggtgtatatttcataggaaattcattctcaaagaaagtagcatctctggactcaaaaattgtaccagcatgcatgtcgggtactccagagtttactattaagaatctataacccacactgtggatagcataaccaagaaacacacaatcaacagtttttggtccaagtttccgctttttgactataggtacatttaccttggccaaacagccccatgttcgtaggtatgagagatttaatttcttcctttcccattcctcgaatggtgttacttccttgtgcttcattggaattttattcaggacatgacacgcagtcagaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaacctttgaccaaagtgaattttggaattaaactcatgttagctaagcgcatcatacaaccgaaattcacatgacagagtcgcgaatgccacacattagactcatcattctcgctaatatggttcacagcgttatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcagaacagtccttggcccaatgcccagacttgccacacacaaagcagtctccctttgcctttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagtttcttagccagcatctgaatctcatgagcttgttctactacagaacggtcatcgaccatcttgtagtcatagaactgctccatgacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggtttacttcgtttaccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttgga

SEQ ID NO: 4863 - DNA, 3758 bp, Oryza sativa
tcattgtttaagatatcttacacattatttttacttattattatcatagtaaactcccgcagcaaagcgtaaggtttcatctagttgtgtaaatgttcaggtgttacgatgtcccagcaatgacttcttaagcctatagtgccatggagcaactatcgtgtgtaaatcctacaattatgaggtaatttatttcccatgaatttagtttagtttttttaatgaaaagaatggtttagttttgagcatatgaaaaagatagggccttcacctcagtaatctgcattgctaagaaacaaagcagtgtagtggatttaaaagtatggtatgagaagacaacgaaaatgaacggtgcttgtcggaatgagtcacaaattgagtactgtacaatagtcactgaatcgttcattttaccttttgactgttgtagcataacataagtcatctaattctttaccttgacttttgtgcaaacatagtcaattttggacatatttgccaatttaaaatagagttcatgcaagtatttattcagtgctgttatgaatgggctttgttggtactgcaatatatgattttgaatttactaaaactttgatactacttatgagaatgaattgggaaagtaatccttaatacctagttgcttatgaatcccatagctcatccaatataactcgactgcaatttttggatagaaaactagaagtctgataatcaattagtgtctggtagacctcctgcattgttggtcttgcttgcggagaagctttcaagcaagaaaacaccaccttaatgagggaaactatgttttcttcttctgtcgttgttggtgctaaaggtcgtgaatccaggatttccttgattgttatattgtgatcccttgatgaagtcagatgctgcaataaatctcttgggtgcttcccaatcactacctctagcataaccatgccgaaactatacacatcacatttctctgtcaccaaagatgtataggacagctctacacaaggagagaacacatattagtaatcaatgattagatatcaaagctttttgtataagaaagtatataccaggagctatgtagccatatgtaccagctagcgcactccaattagatgaatcaggtctcaaaatcctcgctgtaccaaaatctgagacataagccttcaaagttgtatcaagtaagatgttgttgctggttatatctcgatgaaatattggtggattgcagtcgcggtgcagataacatagtgcttgagctacatcctttataagaatattcctcttttgccaatctaatgccttagctaactcatcatcagctaaggtcatatggaggcttccctgctctatgtattcatagacaagaaacctgtactctggatgggagcagaattcatacagtttgacaatgctacgttgtcggatttctgttaagatgtacatttcacatgaaaatcttttttgatcacccaaccattattaagacgtgtgaagctgcttcacagcaactacctgcccgtcctggagttgtgctcgatagaccttgccataacctcccgctccaatgatgtacttgtcatcgaaatcttctgttgccctgacaatatcctcaaatgctaatcttccatcaaaattccaaacagagaacatgtcccttcctttggctgtagtactttcttgtggttttctcttgctatgaataaacaccgttccgagaacaactgtagcaagaatggcaaaacccagaacaagaacaaccggcaacagaaaacgaaatagctttcttttgttgtgaccaggtgctgagtaacaagacggcaggccagagagattaccgcatagacctttattgttgagaaaccagcttgctgaagcattttgaaatagtcgccctgctggtagtggtccttctaagttattgtatgacgcatcaagtgttgataggctcaccatgcttgcaaaggaagtcggaattcttccagtgaactggttgtgagataaatttagaaataccagcatctgcatccttccaaagtcttgcggcaacaaaccatcaagtttgttattgctaacatctagcatgatttgtatgcttgctaaatttccaattgtggcaggcaaattcccactgaagtggttgttgttgatcctcagtaactgtagtttggtgcatctcccaagttcctcaggtattggtccactcaaactatttctggaaacatcaaggtattctaaatctctcaggtttcccaactgcgaaggtatggatcctgataacttattgaacgacaaattcagactatatagatttattaaattccctatttctggtggaatcacaccatttacatgattagaactgagttttagttcaactaggttgggcaatttagacagagctggaggtattgtgcctgtgatcatattttctgctatatttagaatagctaattctggacaagcaccccactttggtgaaatctgcccagagagcctattggacatcaagctcatctttttgagttttggatacacaccaaaatgtttggatatatctcccgttaactggttgccatcaaggaaaagtcgaaccaacgatgtgcacgtcttcaagctcctcggaacagggccattgaacatatttaaagacagaaataaaagtttgaggcttgtgccagcacatatatttgctggcaactgccctgaaagggagttacttgctaggtctagctcaaccatgtttgtgatatttccaaattcctgaggaagagaattcgacaattggttactacgaaaattcagattttgcatgttttgaaagttccctaaagatttcggtattgagccggaaatttgattctcttccaaagacaaaagttgaaggttcactaggttgccgaactcctgggggatagagccatttatctgatttttactgaggtccagtgcaattagcttggtaaggttcgctaaggtgccaggtatagagccagagatttgattgctgtgcaggattaagttctggagatttgatatgatccctagtcctgggggtattgaaccagtaatttggttttcatggaggaaaagattgttcagcatagtgaggttgcctagttctgtgggtaaggaaccttttaatttattttcattgagaacaagatcggtgagcatggcgagattgcctatttcagggggaatggaaccaattatttggtttctaaagagatagagtttgatcatcttagtgagattgcctatacatgtggggatttcaccagtaagtttgttatcaccaagagcaagatattgcaagttggtcagcttgcagagttttggtggtacaggccctgacagttcattaccatctagatagaaagtatctaggttggtcagatttgctagagttgttggtatctcgccgctcaacgtgttgttgctcagctgcaaaagctgcaggttggcaagcattcctatctcctttgggatgggaccagagaccatatttcggtgaatggagagctcggtgatcatcgtcaggttacccacggatgcagggatgtggcctgtgaggttgttgtacgaaagatcaagcatggtgagcctctgaagctcactgatctcatccggcattcttcctgtgagctggttgagttgaaggtcaaggtaggtgagtgctgatagagagctgatacttgagggtattgggccatagacactgttgctgctgagatcaatatatgtgaggaagg

SEQ ID NO: 4864 - DNA, 3104 bp, Oryza sativa
aactattttcatggacagtgcaagctcctgaatcctacctaatatatagtattccagggttgtctgtcagcacagggaagttggattggattaactttctgcctctctttttgattttttcttcagcgtcgccatccttaccatcgtttttctacactaggatggtgcaggatccacggctgttgctgtaagtcttccttttccatttagtgtttgacatctccgagtcgataaagcttaagatacctgtttaatcatgcattcctatttcacagcaagttcttttgttggagtgttcgcaaaaaagttcttttgttgggatggccgaatttattaagaatgagagaaacatattgcactaggaaagacaaacaaaaaagagaactgctgcctcaaagttacttaagtcatactacacgatgggtcagttttgaagcagctggaaagtaccccgtttgatttatattattgagcggattattgcaaggattatctactcaattataggaataaattcaatattctgatattaagcttaataacagttctaaaaaagtggtttaagaaatgctctagaggaaagttttttgagaaaacatatttttttaaagtgtcgagcaattattccgttttaatgatctaatgaataatccaaaaagaacctggcagatcatccagcagaatgccctgagaatccttgcgttgccatccttacagatgattcaaaagttcagaactgtatgagtttgcttaagtcatcattgttgacattgggtgtgcaattttttttctccatatgatttgctcacttatgagttatgacttatgagcttacacacacacattgatatcacgatactggcatataccttaaaaagatatcagtgtaaaatagtatttggacacagaattaggctaatttcgttttaataaactcttacacggacccttctggattcactcaaggcatggtgtccatgttactgactagcataaacaaagaagtctctatgcctagcacagactaagtcttcatctgcatggtgtttatgtggttgaaggtattcacgagtcaatcccctgtatgtttcaatctaaatgttcaccataacaactattctcatgtgattttccaatatattccattcagattgcattcttttttcagctgagcagtttcattggtttatgaaatacagtatcttgctatgctgatgtagcctgactgcccatatttttgtcatatgcccatttgcactgtaatccgtttctttctgtttttttttcaggtgattccaagaggcaacttcgaaaatacccaagcaagttgagtacatgtgtcctgtaggaattacaataagccatttttatgcgtaacaatatgcctgttcattctcatttcataagcataacaagaatcagaagagggttcaaaggaaggaattataacagccattatatatgtttcatatatattttcttgtgtactcagcagtgccaggtcggagaacatgctgccttcaccaacttgctgaacctgatagacatcagatgcatgaactggatgggcgtgtttaatttcatgcttctattcggtggcggatctagaaaattgattcgttggtgctagaacgtctctatcggtgttacagtatattaattatacttaaatcatggtgttatagcatatggataagcagtttcgctatagttttttgctgaaagtcgtcggtgtcgcctgacaccggtccttctactgtacatctgcccctgcttctattggaattaggggtgtagtacaagcctaaacgggatgtctctttcatcaacacacagtttggtttgacctcataaaatagaaatggaaaaatggaatagaacaaagtgagtcatgtagctatattaagggcctaggcttaggcttttaagccaatttttttgcttgtatatttcataagccagtgactttgaagccttaggtgtattgatgcagtcataccttcactttaaataagctgaaaaatttactccgacttaccttttagcaatagtgtaagaatagcttatggctttcaaaaacaggaaaaaaacagttgcttgtttgtttatcataggctttttggcttataagttactacatccgttttgtagtatgacattgttgactttttacataacgtttgaccattcgttttattcataaatatataaagtataagcatgtgaaattacaagttaagattatagtttttttattacagtataaaataagttataatatatattttgaataagatgaatgatcaacgtcaaagtcagcgaagtcattacttttgaaaacggaggtagtactactagcttatacaaacatggattaaggctgtgtttggcaatgatagttaggaactaatcccccgcaatagagtgactcattagcggccgttcagttttggagcgtggtttcattgaggtggctcctcttcccctccctgaccacgtcatgtgccttgtggggaggccgacgcacgctgacatgttagtggatcccacaatatattttaggaacaaatgggtcccacatattttttttctaattctaatgccatgtaagcgccatgtcaccatcacgttggatgaagccaaggtcaacacctccacataggcgtcccatcatcgaaaccgtcctcaaccaccgagggagtcaaattgcaccgatagtattagttaggagatcgagatatctggtattgtgattcaaaaatacgaatcatattcgaccactagttaagggagtaagagtggacttactccgtacaatatcaaccccccacccaccttcatgggccggaattgagcccaaccaactaaaccaaccgaacgaggcctcaaccgtcacacctacttgctgttgttacccagagggtgttggttacttgcgtacctgtcgtgctggaggcgcacagctcatggaggaggcgcccagtacaaattacaaacaacaacgacaaatctccaaaactgaatctctctctccctctcccctccattccattcgattcgacccaccaccgccacataaaccaaaaaaaaaaaaaaaaaaaccg

SEQ ID NO: 4865 - DNA, 2351 bp, Oryza sativa
tgcagtattcgacgtcagttcctcaaaatggtcctgttaggtgttcactaatctcagttatactgattgctggacttcaccctactgtacaactcatcaagtgacttacctgatgttcacccttagattttcatataccttactgttctttacaaaatctaattgcagtccgagtgagcaactgggcaagtactgagaaccccaagtgacatttagaagatctattcattcatatgaaatgtcactgcttagtagattcttctacaagaggcctcctgatggattactggagtttattgatagggtctatggtgagcctccaaattttgtaacacggtcacattgtccttttacgtgccatttgaactgattttgctctttgttacattgcacagtttttgattcatgcttctgcacagaagtcttgccacatggcatgtacccagtctatttgactggtattcttacagatttgcatgaagaacatagccagtcttcatttctgggtattaattttagagacggggataagagaagccaactcgctgatgtcctgcgtgaatacaatgttccagtaattgactaccctcgtcattttgaaggctgccctgtgcttcctttatctcttatccagcatttccttcgtgtctgtgaacactggttatccaccggaaataatcaaaatatcatactgctacattgtgagaggggaggctggccatcattagcatttatgttatcgtgtctccttattttcaagaaactgcagagtgcagagcataaaactctggaccttatttaccgtgaggcacctaaagggtttttgcagctcttttctgccctcaacccaatgccctctcagctcagatacctgcagtatgtagctagaagaaatatatctccagagtggcctccaatggagcgggcactctcctttgactgcctgattcttcgagccattccaagtttcgattccgataatggatgcaggccattagtccgaatatttgggcgaaatattattggcaagaacgctagtacgagcaacatgattttttcaatgcctaagaagaagactttgcgccactatcggcaggtatgtgctagagttaatttagcattgccatctacttgctttgtgtcacttttttttgcattaatctgcaaggttattatgcaggaggattgtgacgtgataaaaatagatatacaatgtccagtccaaggagatgttgttctggagtgtgtacatcttgatcttgatccagaaaaggaagttatgatgttccggataatgttcaacactgcttttattcgttcgaatgtactaatgctgaacagcgacgatatagatatagtatggggttcaaaggatcagtacccaagaaattttagagcagaggtatgagcattgcacatactctttgtaacttcaagatacaaattaataattgaacctaatttggaagtgcagatgctgttttgtgagcttgggggcatatctcctgcaagacctccaacagcaacattgaatggtgatatgaaaggaggtttaccaattgaagccttttcagctgttcaagaactcttcaatggagttgactggatggaaagcagtgacaatgctgccttttggttgctcaaggagttctcagcaaattccctccaagagaaatttcaaaagctaatactcagtgatatggaagagctttcaaagtttcaagctaaagttggtctccaaataccgctaatgtctcctctggattctgatgaagaaaagtattcagtggcttctgattcggtttcttcatctgagcatgagaaggttcagcctggtggcaactcatctgactcggagaacattaatcatgatcttaccactgaagatactgcatccatgggtatagcatttgccataagcattgtgttatgcaactttatattgctatatacctgttgctatatattccctctggaagaatatgccttgtgttgctaaacctgttgtttccatgctatcgattcccccaaaatcacttccgtttcctcccaattctgttctttttgttgctatctgtttaaattcttattcacaacccttaaaattttgcaggcaatgtcttggtgaacactccatctgtcctacctcccacgacaccacctccttgtggtagcttatctatcctttccactgatgaaaatcagctgcccccagaagtacagcatgagtcaccaagtgacaggaagctaccatctccatcaccaacagctgctgcaccggcgacggcaccaccggcaccaccgtcttcaagtggaaacaaacctgccttttcccaccaccaccaccaccg

SEQ ID NO: 4866 - DNA, 1064 bp, Oryza sativa
atcgttcatctggtatgtactactactcacacatttgtatgctaaacacttgtatcacaacctttttattcagttgttccatgatatgttggaatgttagaactcttgtttgtctaaagctttttctattagattgcacgatgcatgcacactgccttttcttccgtgaatatatatttatcctttttatgtatgtgatcagtttattgataatgagactacataagcttttgagttcaatcataaaagtgcatagtaaagcatggaattatgatttgttgcatacatggtattccctgctgcaatctttgcactcttttgagtggcatttgcttgcaacacagacttctgattttctttattgttatatttgaagacttcaacttatttgtaaatcaacaccatcctatcctgtcatggagaattctgttcctcatttcattagacaatgaattctttgtttttatttcaggttgatatgagaagagcaaacaattgcgagatcatgcttactaaaattaaaatgcctcttcctgatatgattgtaagtatctttcttgattgagccgctcccttataatagaaagagattggacatcagtttcctcatgcagaatattgataacaagttattttttgctctgttgataacctttatttatttatcttgaatacctgaagtttctgtgtttcctgggtatgtatatttctaggttttcacagttttgatttaggtatggatagggagacagagagtacatatgatgagctacagcaatggtttagagcctagcatagctaagttaagagataattgagcctgccatgatgttgttaggttgatgggtggtgagggcccatattgactatcatgagatcttttcttgttagcgatacactcatcctttcttatctctatgatctgatcgattgcataagacccgcgatagcaatagaacggggaagtatcacttggctacatccgccccttatccagctaaaggattttctaatttaatacacagttattatttttttctcaaccagacacattttcaaagatt

SEQ ID NO: 4867 - DNA, 3348 bp, Oryza sativa
cttttaagattacattttcaacacaggtctgttgaccctcctctctcccctggtcatgttatcttcctctctgtaagtttcatgttgtgactgagaatcctcccttttgacaggtagaagagctgagaactaacctaaccaccataaatgatgcaacaaaagaggtcagtgttacatcctgcaaaatttcaagttatgacttttccttctggctggcttattcagttattgatcactttgtgcaggtgaaagagtctctgaagttaaggcagataatgcagaccattcttacattagggaatgcattgaaccaaggaacagctcgaggtatcaaatagttgaagaaaaattatggaataatttcttcgatggtctttttaatgtgctgattggttgaacaggatctgcggttggcttcagattagacagtcttcttaaattatcagatactcgagctagaaacaacaagatgacactaatgcattatttatgcaaggtatgcacttggcagtgaggaagtgctattaacatatactgttgtgtgctgaagtttctcagtttttggtgtggagaatacctcaaaataattcaaagttggttagactttaatagtttctggtgaattgtgccacttgttatgcattcaaatatggtatgcatgatagtcataattttgttgttaatctctgcagttcgaataatttattcttgtacaaatttgagtttggcaccagtcgtgtcacataacttcctgtggtcaaaattattttgttacatattatctcggtctactgtaaaatattttaagatgatttagctatagatttgacaaagctcatatggatcaagtcatcaagcaattctggatttgtactattattttatatgaaagtatgcatgctcctggtctcctggggatacgtgagcgtgtagttaatgcattattaggcctcacaattggataattagttacaatactcgcttggttcccttaacaattgggtaccaggttaccatttttcagaaaaaaaaaactcacttgctatttgtgccacaaaggtttcgaagagctcttgtaggatacccccaattgttctcctagttggtaagaggactataaatctcagatgtagtttgattaagtatgtctcatgcttaatctaaactagaaacaaaaacatgagtctgggccatcaactggatggatgattcagatttcagagcataatttccttctatcctcttacagtggagggctgaaaattgagttggatcattaccccacataagcactagtatgcgaacaacaccaacttaaaagcaccggaggcaatttctttgcttaccctgtgcattgctcaattcaattatatcagaaaagacgtgttttacacttgtgcagttactactattacccatagactatatctactggctcccaaaccttttgaaaaggaacaaattttaattgtattatttacacttgggtagtacttgtgaaaagtggaattttgatcaattaataaaaaactacaaaagcatgaaactgagttttaagttttagattcagattctagttcgtttgatagatttgcatgttgcatatttccaactttgtcattaatggaaattatacaattttatatgcatgccagcatgtgttcataattgaaatgcatgcccctcaatccatgtaataagccatcccaagtaaaagtaatgtaattaattctttctatgtatgccatttcgatgaataggaaagtttgtttcttgtttcatgcttccattcctttcaaggaagctttggacgtattaacaacaatgtttttttttccgccgggaaggccgaaggaggccatccggatatattaagaaggaaaaaagtaacaacaatgtttttggtccttttcttttcattatcccatctaaatatgaacttatagaatattttcctttcaaaaaggtcaaagatgacctattacctcttaatgtgtaataggacacctatactagccaatagccatttgatcaagaattcaaaagaatcggcatccatcaaagtggagtaccatacggaaatattcagtggtaggctgttttccactaacaaacagagacactgagacagtgaaagcgtggtttatagaattttgggtgcatttgtctgacattgcaagttactgatttcaaacaagttaatgtgagtctaattgacgttattcaatcatcttgaaaagtcagttttctggggaagtccataacatcatggactcatggtatctttgcaacttgcaaggaccaacctggtttcctttttccatacactggcgctatttacacggacaacttttaagtgaactttcaaaatagttttccagtatagctattgctattcattcttttaacttttggtatgccattatagtgtagtacacacatacactggctgataaaggttcagttttagttctgcattttactctgcaagttcataaaagagtacctatcgtttaatccgttgcgtactataaagacttttgaactactattcagtcagttgccttgttgttagtattgtttgtttacacagtttagctaatttctttctatttctgttatatgctagcttctttctgagaaattgcctgagcttcttgattttgacaaagatttaattcatttggaagctgcttctaaggtactaaatctttactgattattatcttgaatattgcaatcctcgatgactattgagctgctaatcaaaatgttgctccataactgcatttattatttccctcagatccagctaaagttgcttgcggaagaaatgcaagcaataaacaaaggtctagagaaggttgagcaagaattagctgcttcagtgaatgacggtgcaatttctgttggtttccgtgaggtagaaaaattcccccttttgtctgagaaatattaatcatatttataaccagtccattgtatggaggagttgtaggttactcatttttgccaagaacactaaataaggtctgtaggttactcattaattccaagaaacactaaataacttgacactgttatttaaagtgattaagttagttgtccccaaatgatttgcaatttgatatattacagatattagtatacgttcatacaaactgcttttagtaatgtagtatacgttcatacaaactgcttttgcatgcctcctttgttaaagaatggcctgagtctgacatgcagtatgtttgatgagaatttgtgtcatgtgtgcgcgaaacaaatgaaatactacatccgtttcaggttataagactttctagcattgcccacattcatatagat

SEQ ID NO: 4868 - DNA, 5432 bp, Oryza sativa
tatatgaatgtgggcaatgctagaaagtcttaaaatatgaaacggaggaagtacccttttaggattgaatcaagataaactgcttttgcaggcattgaaaagctttcttgatgcagcagaggctgaggttaggtccctaatttccttgtactcggaagtggtgagtccctactgtatttttttttacaaagttatttgtgtttggaaagatcctgacaacattaattttgtagggaagaaacgctgattcactagctcagtattttggcgaggatccagcacgatgcccttttgagcaaggtatagtcttttttgttttggtacttcacattttactagtcattatcttatctcacaaatagttgcacattttatccacatcaccacatattactgaccgatcatcatccaatgtacaaaaatgcaatgattctcatcaaagatcaaaatttaaaattccagaccgaaaattctcgcgcatggttaaaaatggaagatgggttatctatgaactgcatcatcgtgcttctgtgaatgtgattagcattaatttatttatcagcacagctttatttactatggttgttttttttttcagtgacatcaattctggttatatttgtgaatatgttcaaaaaatcacgtgatgaaaatgctcgaactgcggaacttgagaaaaagaaattagaaaaggacaaggaaaaggcaactttgtctgcaaagaaagtcttggaatgatactactgctacactgaagttccatctttgcgaagtagagccatgatccagcaccagccatggcggagatgccaaattgtgtattgtaaacgagaacctgcttctgcttttagtggacatgcagggctgtaatgcctggaagctgccttgttggatgggtgcgatccacgaaatggtagtatcttaactccttccgtggtatataagatgttttatagtcttggctagctattgaatgattgcagcctgcattagtccttatcaatatcaatttgtgtacacaagatgttctatccaccaaatatacacaagcctgttagtattccgtatttcaaagtcatgttggaatgcatttctaatgtggtcattttcctccttgcagggtgtcatttggattgcaaccttggaaagttctgtgattaccaataggcggcattggcgatatggctgagcgaagtgcagcgagaagtgctgctgctgacagttttggtgtaaatacagtagttactaggatatagttgtattacctgtacatagaatatgcagcccaagtgggaggaaagcaattaagcaaacaacagtagtgttgtataatcaagaacaatcatgtttcccttcgtcacaggtgttaattcgtggctcgccaatttctcttgtgctttgcattttgctcctttctaatgcattggttactcaagtaaacagccatgataacaccagaatgcgcgtattgaacttgggtggacaagcaatcaagctatcttacgtactagcactgagaatttgggatgtacttctcgatgatttgttgatctcattttgtcgaacggatctactccctccgctcttcttgttgaatggaactaaccaacgtcaaacatttcagagggagtacatatattttcttctgcaagtttgtgatgaagacataagcgcgtaacactatacagaaaaacccatcttgagtttgatttagtattttgcaatttgtcaaactacggtgaaaggtttatgtaggaagcagatgatattttttagaaatggattaaaatccgacctctacatccaaactttgtggaattctgcccaacaagcagtaaccattctactgatgtagaagctacaaagttagtacacaatagttgcccttaatcaccacataacaagccgcctaggtgtacaattgagcattatcatgaaatatgaaccagtacattaattcctattttgaatatgatcgtcttctcccgctgattctttcaccgtatttctgatacatatctaactataattgaacaagtttgtcatggtcagcaatgaacactacaggaaagtacaataagctcagggatttcattgaaacctccgttccacagagactttgggggttgttcggttgactgactgcagtggctgtcgtggtgatgttacgtttgttactgtagctgctttgcttctttgcagggcatatctagtcctatcaaataacccctttattttttatttttaactttcttcattttccaataaaaaaggagaaagtttaagaaagtagaggacagatactgaaagttataaaaaggagaaaacaaatgaattaaagtttaaaaaaagtggagggcttatcttttagctttatattggtacatgtgagacagaaaagtaataaaatcttcttaagacagtaactacatatgttcgatacttcatcttagttgattatactccctctgtttcgagtcaaatttcttaattatgaagaaaattatattaaatgcggcatcatttccaacacaaagtaaatatactattaaatatattatggatattatgggactaatgagccctgtttttttagaaaataatgagccgttgtggggattgtggattggtggcctcttcttcccctccgccggcggcaatcggcgaagacggtgatgtcggaggttccaaggccgcaggcgcgcgtgccatatatcttcacgaccatctctttaaattctccttctgatagcctacacttgaatcgatcgatcattcatatctgtcgattgagaaaagttcattcaagtgaagattattcatatcgatcaatcggtttctgtttatgataaatcatacaactcctgcattgcaaaaagaccaaggatgaggtgatgcaaaagatctagatctccaggatgcgtgcttcctcatgacgacctctaaccaaatgcattggttacttaggtggatgcaagggaaggattagaatcaaacctattaagcatttgattgatgcgtttgcagtacactgaactctgaatactcaatacttaatacgctaaaatgtcttcctcgcgctaaggcaacttactgaaactgaaataagtgtttgataacaaatcaaactgcagcttttcagctttaagcagacacactaatatatattttacaagaaaccgcaagcatatttatacatctatgtatttcttagttgttctagtgtaacttcattgaaacgtatagggcatgagctagaggaatgctgctgaatgagagtctggtatgcctccatcattgttggccttgcatgaggagaagcttccaggcaagaaatggccaccttgatgagaatttctatgctttcctcttctgctgttgtgggtgctgtaggccgttcatccaatatttctttgaccaatgtatgttgctgttctgatgacaaaagagtttgcaacaattccataggatgcttccccattaccacctctagaacaacaacaccaaagctataaacatcacatttctctgtcacgacacatgtgaaggacagttctgcaccaagaaaagaacagacaagaatgaaataagtaataatcattgagaaaactgcactttaggtattactcaaattttacagaacataccaggagctatgtagccatatgtccccgctaatgcactccagtttgatgaatccggcttcaaaatccttgccgtgccaaaatccgagacataagccttgaaagctgtatcaagtaggatgttgttacttgtgatatctcgatgtattatgggtggactgcagtcatggtgcaaataagatagagcttgagccacatcttttacaagagtaactctcttagaccaatccagttcttttgctagctcctcattttttaaggtcatatagaggcttccccgttgaatgtagtcatagacaagaaagttgtagttcggatggaagcagaatccatacagtttgacattgcttctatgacggatttgtgacaagacttaaagtcttgtttcatcatttaactcttcttcaactggatgaagcttctcgacaatgactacattcccgtcttggagtcgtgctttgtagaccttgccagatcctcctattccaacgatgtgcttatcattgaagttttcggttgccctgatgatatcctcaaatgctagtctgccatcgaagttctagacagaaaacatgttccttgcaacagtaatagcactagcgctttgctgttgttttctcttgttatgaacaagctttgtgatgacaataattgtagccagaatgacaatgaccacaacaagaacaattggcagtagcaaacttagtagctttggcttatggtgaccagatgctataactgaataacaagttggcaggccagagagattaccacacaaacctttattgtgaataaaccagcttattgatgcattttgaagtagatgtcctgcagggagaggtccttccaagttgttgtaggacacatcaagaactgttaagctcaacatgctagcgatggatgatggaagacttcctctgaactggttgtgagacaaattaagaatctctaacatctgcaaggttccaagttgttgtggcaacaaaccatcgagtttgttgttactagcatccaatatgatttgcaggcctttcaaatttccaattgtgcctggcaaattcccatgtatattgttattgttaatcttcaaagattctaacctgatgcagtcccctagttcatcaggtattggtccactcaaattgtttcttgatacatcaaggtaccctaaattgcttagctttcctagctgtgctggtaaagatcctgagagctgattgaatgataaatttagcttatataggcttttcagatttccaaattctgctggaatctcaccactgatattattaagatcaagtctgagcacacctaggttggacaacttagagagagcaggaggtaacacacctgtgatcatgtttccttgaaaatacatttcctcaagctgggggctagcaacccaatttggtgtgatctgcccagagaacctattgtatgccaagctgaccgttttgagatgtggatacacaccaaaatgttcagatatgtctcccgtaagctggtttttgtgcacggcaattctaaccaaacttgtacatgtctttaagcttctcggaatggggccatcgaaggtattcacactaaccatgaaagttttgagtctgccccccatgcatacatatgcaggcaagtgtcctgaaaattggttattatcaagccaaaggtctggtatgcccgtgagattttcgaattcccgaggaagagaacctgttaatcggttatgaaacatggtcatcagttggatgttcaccaagttaccgaaagttttgtagcatcgaatcacaa

SEQ ID NO: 4869 - DNA, 11000 bp, Oryza sativa
actactccgggcttaccaaatttcactgctaacagccgtgaacaaccggaatccacgatccacacgttatccttccttgccaccaaagcctacacacaagcagaagtcgaagcctcaatactggggttagatgataacaaaaatttaggaatccaatactgagatacacgaccagaagatctaataggcatatatccacgtgcaaaaacagtttgagaattttcagaaacattcctccgaggccggtctgaccgaggtacagtggccggtctgaccgggggccggtctgaccgctgctgcaccgccggtctgaccgaggcacagtagccggtctgatcggtcgccggtccgaccgcgggacccaccgtggtctgaccggtttccccgagggaaaacccgatttttgcaactttgattttgcaaaagcaatctctctcacctttttctgtttatgagctaatctgaaacaaaaaccaacaatatgtccatctttgccacaaaaagaacaagtatatttttcacgatgattagacacattggtagaattgaaagacttagcaacacaagcaacaataggaggttttgcatgcacaacattggattttgaagcagatgcattctaggtagacatgataccagcagatttaaacacagttttgttagtatcaggtttaaccaaaatctcaccacttctagcaccaacacctaacacaccaggaggatgtctagattatgagcataaggattaaaacctaaaccacgattatttgtgctaaccttagattgatctaaaatcatgttgaggttctttttaccatcagaacatcttagcaatgaatttttcaaataagaaacctctttttctaaattagcacaattttcacaatctactatgacacctttgcttttacgacatttggggcaagaaaacacttcattgtttttcacaacatcttccatgtactcaacacgacctaaagcatctttcaatttcatcttattcaaattacatgttgagcaatccaaaacatcacgaggttgttttaactttttagcagaaatcatgttaaacataaactagcatgaaaagcaatttgatatttttgcaacaactttttagttaaaaacaactcatccaaagtgcgtgtgtgcaaagcaaaagtaagagcaagagaagatttatttttcaaatcatgtgcaacattaacctctctaatttttgaaatctcattcattaaaacctcacaacttttgcaatcatcatcattaggaataagagattttaatctagcaatttcagaattaagagattcaatgataaattcctgttttctatacatcttctcacacttcttattttttgcactcaaaatattaatagcttcctcaaaagcacttacctcattgttttcacactctgaatctgattcaccacgtgccatgaagcaaacaccggagatgttctttcccttagcttcatctccactatcaccatctacgtcgcttagtggctcaaacgcgacgtagacttgatcaaaagccttcttgagattctccttgatcttccttcctttgaatgtaccctttggcttattgtcgttggtcttctcaccatctttgtcttctcttttgcctctcccaagcttaggacaatgcaaacgaagatgatcaattgaaccacattcaaagcaacggtttggaccacatcttttcctgttcctagcattattcatagctcgagcaattctgttagcaaccaaagccaaatcctcctcctcgatctgttcgagttgatcatcggatgtggcattaaaaatagctagaaaagaagactttgatgaagaagcatcaacatccaaagaagatgaagaagaaaccaaagcacttgacttagaatcaactttacgagaaagaacgttcatctcatgtgttttcaattttgtgtaaagtgaatctaaagtcaaagtagacatgttaacagactcctgaatagatgtaacttttatctcccaaatagacatgtcaagaccattcaaaaagtgatgagaaatctcagattgtggataattagcataataagaaaaatcaacagatctaagatcactcaaaattttattaaacctagaaagatagtcatccaaagcttctccaggttttatctcaaatttaatgtactcctttttgaaaatagcacgacgaagttctttaatgttatttgttccttgatgaaagttactcaaagcattccaaatctcatgagcagtttgaaaatgcgcaacacgatcataatccgaacgagaaatcccactcaaaagaatattgcgagctttgcaaatttgtcaaacttagtttttgcagcagcagtattaataacttcaggaatcacataaggatgagaaacttttctccaaatatcataatcttcagccataatataagattgcatcctactacaccaatgagaaaaatccgttccatcgaaaacatgaggcttagttgaaaacctaacaggagcagccatggcaaaaattctagatcgataaaaatccaaagaagaaaccaaggctctgataccacttgtaggatcgaatcacaataactaagccacccagagggggggggggtgaatggttggtatacccaaaaagggaaaacttttagcggaaataaaagttaccctcgaaatcgacggagttcggtctgaccgagattgatctgccggtctgaccgctcgcatgccgccggtctgaccgtcggtgagtcgtcggttagaccgccgaaacccggtgaaacacaaatcgaagaactcttaaagtggatgacgactttattgattctctctgtgtttacaaagtgcaccaacagcactccttacaaaaatttcgactaaacttgaaaccctaactcaaaactaaactcaattgctctcaaaagcgataccgggaagactcacgctctctctctatttatacccgaggtagacagcctaaagccatgaaccaaactcatactagaagtcctaaacaccttagaaaaccctctagtacaagaaacaaactttacataaccaatcataccaaatttggactccttccaaattcgattccgcatcccatacacacacaatacctccatcgtatgccgtatggaatatccatcaaccacgtacatcaactctagcctaagtatcccgcatgatctctgaccaccacggacgtcggcttatccccaagcctactcccggtccatcaccgcaaatactctcccgaggcatctagtcacctacacatgaaataaacaaagaaaccatattccgagaccaagctaactccaacttggctcattgttagtaaacaacagtattacatacgtatagtatccatctagaagccataatcatgaaataatcacggatatccaaacaaacaacccgaaaccgaaaccgacacagagtcggccggtcagaccgcgggctgcgccggtctgaccgcgcgatacacgccggtctgaccggcacacactgcccggtctgaccggtcacatgaaattaatagaacctgcgattcacctgtaaatccaatcatctcaaaaccacttcgtgaataaattccaaataacaaaaccaataaacttcgatgccaattgttcatcacagaataataatcaaaaacacctttgattttacaatctcccccttgatgaacacattggcaaatccatcaaaaatgttttggtgtttggaaaaataaaaacaaaagcggtaaaagcacacttcgtacaaacgtacacatcgtgctcgaaaattcaaaaatccaaaagaaaacttcttcccctttgtaaaagaaagaaattcccaattgaacaaaaaacatgctcttctcaaaaactcttctcttctccaaacattcaccttgcttctcccaaaaagtcaaaaagttacctttgcttctcccccttttgacaatgatttcatcaagcataggaattatgttcattaatgttcaagagcttagcatacatatagcatatcatgtcatgtgttgcaataaaaagaagataaactcatctataatataacaagcatgcattaaagtataaccatgaaccaaagactttacaattaagcttgaatcaacaatcaaaattcatgatttcatacgatttataatgcaacatcttaacaagcagataggttgaagaataaacactaaacacatatacctattgcatttatcactctttctcaaataacctttagcacaaaataaccaagagaatttttaacttttttattttcttgagcctttttgctcatatttttctcttttattctgggtacgtccctgtcgtcaagactgtttccaaagattcggcacccattattttgctcacatcgaatacgtccttgtcgtcaagactgtttccaaggattcggtattcatttttttcatatttttattctatttttcacaatgagcaattaaagctatttgaggaataacaattcaataaagcatagacataaagcatttagaaatcaaaccatatgctagcatcaacattgcatatttgcttaattcaagtagaatttaagtgtcatgcatcatctccttaaaagcaaaatctaaatcttatgaaaaagactagaatacatacaagctatgctagagacaaataaaccttcaaagtattgctagcatgcacaagaaaatactatatgtataaacaaagctctctttttctcaattttcctcattgttatattattgcttgataaaaccatgaggtacaaactccccctcaaaacatgccaaaaggatgaattatgcccaattcaccacgaagaaaagcaaagcgattagaatccaaaggtttagtgaaaatatcagcaagttgcaactttgtgtccaaaaactgcaattcaacatctcccttctcaacatgatccctcaaaaagtgaaagcgaatatcaatgtgctttgtgtgtgagtgttgaacaggattcttagcaatgttaatagcactagtattatcacaaaagagaggtactttctcaaaagtaagaccataatctttcaaagtagataaaagccaaagaatctgtgaacaacaactagcagcagcaacatattcagattcagcagttgattgagcaacactagattgtttcctagaagaccatgcaatcaatgatgtaccaagaaaatgacatgttccactagtacttttcctatcaattctacaaccaccaaaatcagcatcggaatatccacttaagcatatagaagatgaagtagaataccaaattccaaactcaagtgtatgattcaaatacctcattattcgcttgaccgcttgacgatgtgaagcacgaggagaagcttgaaagcgtgcacacaaacacacaacaaattgtatgtctggcctataagcagttagatacaacaaagatccaatcatacttctatactccttttgattaacagcttcaccatcttcatcaggatccaatacggctatagaaccaattggtgttgaaattggcttgcaattctccatcttgaaccatctcaaaagatcctttgtatacttcgtttgatgcacaaaagtaccttgaggtgtttgcttaatttgcaatcccaaaaagtacgataactcacccatcatgctcatctcaaattccctacgcatagtctcagcaaactccacaaccaaagcgtgagatgaacaatcaaagatgatatcatccacataaatttgaacaaaaagttgattatcaccatgcttaagaacaaaaagcattttgtcaacctttcccattgtaaaacctttcgcaagcaaaaagttcttaaatctatcgtaccatgctctaggtgcttgtttcaagccatacaaagctttagacaattcaaaaacatggttgggaaaatcaggattttcaaaacctggtggttgtttgacataaacttcctcctgtataaaaccatttagaaaagcacttttcacatccatttgaaacaatttaaaaccttttgaagcagcaaaagccaacaaaagtctaattgcctcaattctagcaacaggagcaaaagtttcattaaaatccaaaccctccacctgggtaaaaccttgagcaacaagtctagctttatttctcacaatcaaaccatcctcattttgtttatttttgaaaacccacttggttccaataatattatgtccagaaggtggttcaactaaagtccaaactttgtttctctcaaaattttcaagttcttcatgcatggcgttaatccacgattcatcagttaatacatgtgacacatctttaggttcaaaagaagcaacaaatgcagaatttgcacaaacatcatgagtcgttaccttagaccttgtagtccgctcacctatattaccaatgatttgttccggcggatgtcgtcgttgaatgtgtaaaggagcagcgacttctaaagttgatccacattctgtatctgtcacatcctgattttcgtttcaggatttataaattatttaataaattaataatagaatttatattaaatgttttttaatttacaagtgaagttaaatgtgggaaataaaatttcttaaatctaaagcatggatggatttaatttttattaaattttccatgattaagtcaactctctgaaattttctcggatttttcagagctcaattcttaaataatacaaagaacagttcagtaattatttgatcattaatgatctaattataattgttaagagcttttcttgtttaaaaatccttaaattataaattgttgtttaaaaggaattattagaaatgattttaaaagcctagaagagaagatctaattttaatttgttaaatctcaatataaaattgggccagataaaatttcattaaatactttgcttaattctataattcctagatttttctgggatttatttgagctaaggaagtatttttaataaatggaattgcatttaaggaataatttaaattgaaaaaggttttaaaagtcttcttttggctttgggccgaaagccggcccaaaacccttctctttctctttccctcagcccagtccggcccagtccgccgagccgccgctctcctctctctctcagccgctgacaggtgggccccgtctgtcggagtcgtcttcctcgcgccgccgccgccgcccgaaaccctagccgagccgcgccgccgccgctttccaattccgtcgctcttttccatctccggccgaattgtttgagggcaaatgatccttgagatctcctcttccttttctcttttggaaacatcggctaattttctttggaaaccggtggattcgagtttgaatcggattcctctttctctctcccgaacccgatctttccttctcggcgccggtcgccgtgggcctccgtcgccgctcgctagcccctttataaggacccccgagctctcctctacccgtcgccaccctcgccttcgtctctcgtcgcccgtagcgctctagcgccgtgtgccctagcgccgccgtcgccgccgtcgctccagccgtgcgccgctgccgtttcagctgtcgccgtcgctcgggaaggtcgccatcgtggtcgccaagtcgccgctgtcctcgtccgccccttcgccaccgccgaagaccgccggagcaccaccgtcaccgtcgacccgaagaccgccgccgcttttcctcgtcgccggcgctgtccgttgttccttcgccgcttctttggtcaccggtgagttcgtcgcgtcgccctctacccgttggtgccctccgttcgtgccgaagcgccgccgttcgccggcgagcgtgcgcgtccgagccgccgagccgccgccgccggtggtgacgtcatcgctgacgtcatcgtccccgtctcccgtgagccggtcgtggaccgttcgatctcggccgtccgttttggatggatcgatctcggccgtccgttcccgtgaaccgccgccgtgcgcccggtccaccgaaaccctagcccgctgacgcaataatccttcttttccttttcaaaaataattcattattgcgtcataattcaattaaaatcaatttaaaggttttaatccgatttaatccttaaaaattcataactaattcatttgaactcagtttaatgtggttcaagttgcaaaagttgtgtaaaataaagatctacatattaaaattgtccataaattgaattaaatttatttaattctttttaaatgggctttaaatagatttaatcttgtaaaattcataataaattcatttgaagtcagaatgaggccgttcaagtctcataattcatccaaaaatatgatctacatgtttgtttactttttatgtattgtttatttggtttttattagtcttttccttgttttgcgtgttagcttgtcgtttccgtcgttgcgaaggttcgcgagtgcgtcggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcttttgttatggcctgtttgcattgattactttaatccttgataccttgggttattataatttgactagttgagctttatatattggttcagctagatattagatgtgattgcttagccatgcttagaaacattagcacactattgggataacttatgattcattattatttaatgatggtttaatggtagctcacgatggtcaatcgtgattggttaataaattacttgccaactaaaacttgataatggtgggttgtgagcacatggttttgagagtcgtgctcatgacaattaaggaccggttcgcgagctactgttgtgaaacattaaccgtgacaaccacaagccagcgtgggcaacggctttacctttttgtatagcatgattcattgcggagcaccagactgagaagtggcggagataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcatgattagtcccacacctcccacaataattatggatgttatacctggtaataatttgcttagctcctggtttggagattagttctgtacagccgggtatggttgttcaggatggttgggcctgtgcagcatgggtgtgctgttcagtgttgattaaaatttctgattaattactccactgttttacttctcttaaatgttttgctaaatgctgcttttgcaagtgagcctatattatgccatcctttggtatccttgtgcacttgcatatttgctgtgtggcttgctgagtatgtcatatgctcaccttgcaataatcaatcaacctcagttgaagacaagttgcgaaggagaagacgtttggcttataccccagttgagctgcctgtgggagtggagccggagcttcgctagattttattttccgctgcagttttcttcatgttgaggactaagtgcctcttaagtaagtatttattcgctttagttattgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaattttcctttcttccttctctagaattctctataaatcattttatcatcctcttccctcctgctttcaacttgagtagttctgaaactagttgttgaaactagaagatgttgatgtggtcaacttatggaggccagtcaagtggatcgaggaaggaccgaagtgccaagtgtcaagaaggaatgaagtttgcatcctaccttagaaccctatgccgccaaagtgtctttgaagaatagttagtaggatagaacgtttgttgcttgcttgtgtgtaggtatggttgcattcccatcattggagtagttcagtgatgagcatgtaattatactaggttgcttgcttaatcaacttgaacaatataatggtctacacacaccagatcagtgataacctagttaaggtcttgtctttagtgtaacccctctccttctatcttctctaatttgcaatagatggtgaacactcgcgccagtggaagtggaaacaataacaatgaagggaacccaactcttgctcaagttctggctcaacagactcagttaatgaacatgatgatacagcagatgcagaatcagctcaaccaagggaacaacaatgctccaccgccgcagaacaagttagctgattttcttcgtgtgaggccacctaccttttctagcactaccaacccagtggaagcaggtgattggctacacgctgttgagaagaagttggaactgctccagtgtacggatcaggagaaagttgttttcgcttcacatcagttgcaaggacctgcatcagaatggtgggatcatttccggatgaacagagcagaaggacaaccaatcacttgggcggacttcacggaagcattcgagaagacacacatacctacaggagttgtttctttgaagaagcgtgagttcagggcattgaagcaaagggatcataccgtggcagagtatcttcatgagttcaatcgtctggcacgttatgctccagaagatgtgcgtactgacgaggaa

SEQ ID NO: 4870 - DNA, 712 bp, Oryza sativa
aagccacttcaaattggtgaatctttttccactggtcaaggacagtcgcaaccattgaacatcggtggtgagatcaaatcaaagactaatgaaagcaatgaagttaacatcgagcaagctaatcagccggtgccagttcagcaggatcagtctcaagtgaataacagtagtggaagggagcagcaggtatgtttcaactgttacaagccaggccactttgcaagagagtgtccgaagccgaagcatcagcagccgcaaggtcaggtcaataacattgttgtcacaggagccaatgcagtgccagttgcgtcttcaagagttgtgtcttcaagtgttacaactcagccaccagtttcaaggcagcagtagttttctttaaagccttagaataattatcgcagttatggaataagatagactgcagtttacctatgcctttttctttctagccattccgaatctcgggacgagattctttgtaaggggggtagtttgtcacatcctgattttcgtttcaggatttataaattatttaataaattaataatagaatttatattaaatgttttttaatttacaagtgaagttaaatgtgggaaataaaatttcttaaatctaaagcatggatggatttaatttttattaaattctccatgattaagtcaactctctgaaattttctcggatttttcagagctcaattcttaaataa

SEQ ID NO: 4871 - DNA, 1573 bp, Oryza sativa
acaagaattaggatggactatatataaatagttcttttgaaattatgaataaacatattttatccacataactaaacaaaagaaatatttaacatgtagtagatgctatcaatattaatatcccgtgcagcgcacgggtcgacggctagtatataagaatcagtcatacatcaatccatctttatcactgtcgtttttttccagaacgtaaagacgatgaaaagtggcactggggcagtgatcaatagttacaccggataagtatcacgctgtccaaaatgacattgtgttcttactatgaatattcatattctctatgtgtttaaattcatgacactgttaactttattaattaagtgaaacttcaaaacttttaccatcaataactcttaaaataactttattccttccaatcccataggatacaatgaactaattactatacttgagatatacctattttttatataatttagtaacatttcctaataccacatatactaaagacatcaaattttataatagaaattttctatgcacccaggtacctctcaaagacagcaagatcatcctgactaaaaacagtagaaaagtatacatgaatcaatctgtatcactgtcaacttttctataacctaaagaaaaggaaaagtgacaatgatcaatggttacaccggataagaccaagttgcatgcgaatttttatcattattaattaatcacatattcacccatggaaacatttaagtcgaaactatatgacactattatgtattatcctactaatcatacgttgagagtatttttcatatttataaaaatgaaaaatatatatttcaaaataattatttgtaatattttttctactgtccaaatgcgtgagaaatcacatttgggaacataaccttttatatgaaaatattgggaactacactagacctcctttttaaaaaagcagccttttatgtaaacttattgtttgaacatctacttcccatgaaagaatttatgtgtttttttatactttttctttagttggattggcagcccaaccgtcgggttaagtggaccacagggggataatcgattatccgtaagatcaaataataccaatcacacggaaacaaaaaaaaagaacaaaaaaatcgaaaaaataaaaaaaaccacgccggcgtcgctcgtcgtcgcggccgccgtcgccttcccaggctcaccgctcctggatccggggcggcaccgcctcgtcgtcgtcgtcgttgtgccccccgccgcgagaaccacgctgccaccgcccgagctcgccgctccagcaggatccgcgcctgcaccgcccggtcgtcgtcgcgcccgccgcggccccgccgagctcaccgctcctggatccagggcgacgccgcctcgtcgtcgtcgtcgtcgcgccccgcacagcgtctactagtcggcgtcgggcctcgtcgtcctcgttcgctcgcggagccgccgccgtgcctccgccaacagccgtcgcgccgcctcccgcgccgtcggcggcgggggcagcggcgctcaatcggtggggaggggaggagaggaa

SEQ ID NO: 4872 - DNA, 2093 bp, Oryza sativa
acactctgcacaagtaatcacaaaccgagaaccgagcgttgctcggttgggtagcttcgctggtgagcgagcagcccgcgcggcttcgatccctgggatcgtcacaaaagtagagtgacgtcctcgtcacgcacaaggtccttaagtggctttgtgtatctcattagcacgtgtgtgtagttgatatcgtcacgcacaaggtccttaggtggctttgtgtatctcattagcacgtgtgtgtatagttgataggtctagcatgcgtgtaggggtgtgtgtgtgcgtggtggaatgcgtttgcacgtatgttcagatactatagcttgtactcaaagtggagagctctcaaaaaaaaaagtgacgtcctcgtcacgcacaaggtccttaggtggctttgtgtatctcattagcacgtgtgtgtatagttgataggtctagcatgcgtgtaggggtgtgtgtgcgtggtaaagtgcgtttgcacgtatgttcagatactacagcttgtactcaaagtggagagctctcaaaaaaaaaaaagtaatcacaaaccaatagcttcagtcatcttctttgaatccaaatgccaacactcctactgcgcttgctcgtgtcatgccttctttgcctgcaaacatatgtaggtgcaaaacggcatgaaagcatgatctcactcaattcacaataaatggcacttcttcgctggaagtccactctcaggatctcatcagtgcatatgagctcctggaagaacaccacaagcctctgcaactggacagggatcatgtgtagtcgtagtgtcatccgccatggacgacgacaccgtctgccatggccagtggtgaccaacatctcccttccagcttctggcatccatggccagcttcgtgagcttgacttctcatctctaccatatctcacatatattgatctcagcaaaaacagtctctctggtccaataccctcaaatatcaactctctgtcagctcttgtgcaccttgaacttcaattgaacctgctcacaggaagaataccagatgagattggtgaactacgaagtctcaccacactatccctttcctttaacaacctcaccggacacatccctgcttccttggggaatctaacgatggtaaccacatttttcgtacaccaaaatatgatctccagtttcatcccaaaggaaataggactgctagctaacctgcagagtttaagtctaagcaacaacacattgaccggagagatacccagaactctagcaaatctaaccaacctagctactttgcaactatatggtaatgaactgtcagggcctataccccaaaaactttgcatgctcacgaagatccaatatcttgaacttagcggtaataaacttactggtgaacttccttcatgtttatccaatctaacaaagatgaaagaactttacctacaccaaaaccaaatcacgggttccatcccaaaagagataggaatgcttgctaacctgcaacttttaagtttaggcaataatacctttagcggcgagatacccacaactctagcaaatctgaccaacctagctactttgtacctatggggtaatgaactttcggggcctataccccaaaaactctgcatgctcaccaagatgcaataccttggtcttaacagtaacaaacttactagcgaaatccctgcatgtttatccgatctaacgaaaatggaaaaactttacctataccaaaaccaaatcacaggttccatcccaaaagagataggaatgcttgctaacctgcatcttttaaatgtaggcaacaatgcctttagcggcgagatacccataactctatcaaatctgaccaacctagctactttgtacctatgaggtaatgaaatttcggggcctataccccaaaaactctgtatgctcaccaagatgcaataccttggtcttaacattaacaaacttactggcgaaatccctgcatgtttatccaatctaacgaaaatggaagaactttacctataccaaaaccaaatcacaggttccatcccaaaagagataggaatgcttgccaacctgcagcttttaagtttaggcaacaata

SEQ ID NO: 4873 - DNA, 305 bp, Oryza sativa
tcgccggcaagatcggcccacagaggtagccgtgcacgaggtcgagcaggtgtccagcgaaatgcttcgcatgtgccggaaacgagcacacgttgtttcccggccaggtagctatcgcacacttggtagacgtggtcgattagcggcagacctcgcaccatgtcaccgtgcaccatttcctcagcgattgaaagctaaggtgaccgtacctcgcgtgccaccgccatgactcgtcggagctgcgggtggtgaggcagaccgggcacgccgcgttgatccggatggagtaaagccggttcctcgat

SEQ ID NO: 4874 - DNA, 1009 bp, Oryza sativa
tcactctcatcaagccttcgtcacctacatcatccagattctcgtgcccctcttgggagccattagtctcattaaattgaacgtcggcggtttcttccacaatacctttgttcttgttgtagacccggtatgccttgctatttgaggcataacctagaagaaacccttcatcacaccaactttcaaagttggttagtctagcaccctttcgataaatataacacttgcaaccaaaaactcaaaaataggcaacatttggcttcctcccaacaattagctcataggaagtctttttcaagagacgatgtaaataaagcctattggttgcatggcaagcagtgtttatggcttccgcccaaaaggaatcggaaacaccatattcatcaagcatagtccttgccatctcaatcaatgtacgatttttcctctccactacaccattttgttgtggtgagtaggtagcggaaagttcgtgtttaataccaagatcatcacaatagtcctcgatattggtattcttaaactcggaaccattgtcacttctaattttcacaagagtgcaactaaattcattttgggccctgtttgcaaactttttgaaaagctcggcaacaatagacttatcatgcaaaaagaacacccaagtatagcgagaataatcatcaataatcacaagacaatgactattaccaccaatgctcttataggttgttgggccaaacaaatctatatgcaagagctccattggtctaggtgtagacatgatactcttagtaggatgagaacatgcaacttgcttgccggcttgacaagcactacaaagcttatccttctcaaacttcacatctttcaagccaacaactagatcacgttttgaaagtttgctcaattgattcatgccaacatgggctagcctcctatgccaaagccaacccaatgaagtttttgcaactaaacaagttttcaaatttgcttcactagaattgaaatcaaccaaataaagatttcc

SEQ ID NO: 4875 - DNA, 7035 bp, Oryza sativa
catagacccgtggtgaaccggatcgatctcgcccgtcgatttggtcaagtatagatcaattagatctcggccattggtttcgtaggcctctgtgcacccggtctaccgtggactgccttcgatgacgcaataaatccctttttcctttcaaaaataattctttattgcgtcataattcaattaaaatccatataaatgatttaatccgatttaatctttaaaaattcataactaattcattgtaactcggtttaatgtggttcaagttgcaaaagttatataaaataaatatctacatattaaaattatccataaattgaattaaatttatttaatcctttttaaatgggctttaattagattaaatcttgtaaaattcgtaattaattcatatgaagtcagaatgaggccgttcaagtctcaaaattcatctaaaatcatgatctacatgtttgtttactttttatgtattgtttatttggtttttattagtctttttcctcgttttgcgtgttagcttgttgtttcgaaggttcgcgagtgcgccggaagtgttcaagaagattaattgaagacccgttattgcaaggcaagtcacacagatcccaaacacaattcctttgagaatgttgatcctatatttaaattccctatttatttcaactgtgcatttattttcgaatgtcaccgggtggtatgaaactattcctttgttatggccaatttgcattgatgaccctatttcttgattaccttgggttataattggactagttgtacttatataatggttcaactagatgttagacataattgcttagctatgcttagaaataatagcacattattgggataactaatgattcactattactttacttaataatggatatttaatggtatctcacgctggtcaatcgtgattagttaattaattaattgccaattaaaacttgataatggtgggttgtgatcacatggttttgatggtagtgctcatgacaattaaggaccggttcacgagttttggttgtgaaacattaaccgtgccaaccacaagccagaatgggcaacggctggacactttgtatagcaaggctcattgtggagtgccagactgagaagtggcggagataagcccacgggggtcgctggggagtccatgcctctagtttttgagggggtgactacgatccgggaatagtgcactgctttgagttgagttatgtgaggggtcttgtcacaatcacttgccatggtgacgtgtctgcgcggacacggtgacatgacggtgggttgtgtcttgtgggtacagtggtacacctctggccagagtaaaactattcgaatagccgtgcccgcggttatgggcgggtctaacaatgtctttcgtgattagtcccacactactcattaataataatgtggtaattgatggtaattaatttagcttctggtttggaatggtatattcctggtttggagatagatctgtacagccgggtatggttgttcaggatggttgggcctgtgcagcatgggtgtgctgttcagtgttgattaatattgatgattaattactctactgttttacaattctcaattgtttgctaaatgctgcttttgcaaatgagccctatattatgccattctttggtaaccttgtgcacttacatatttgctgtgtggcttgcggagtattccatgtactcaccttgcaataatcaatcaaacctcagttgaagacaagttgcgaaggagaagacgtttggcttatatcccagttgagctgcctgtgggagtggagccggagcttcgctagaccgtaattccgctgctattttcttttcttttgtaagtatataacgttattattatgatgaatctgtatattaaattgtcagtttgtgtacctcggttgattcctggacgaggattttatgcacaaataagttcgaaaattactagtgaatttctgggcgtgacatccagtatcaagcacccaatggctcccaccggtgcggtagttcacctataaaagaagatcaagctcttttaggtacacaaacttatttgggtccttggaggttagataccaaagctttgggcaccaaaatggcattctttttaccaccaagtataggggaacccacatatctagcaacaatactaccatcataagccttcctaagcatataatgagaatcaaacatgcatgtcttataaggcttaccaccggggcaatcactcaccaaatgcccaacctcacaatacttggagcaatgcttaccgttgctcttgacaaaacgagtggcacggtgagaaggtttcttactcttctttggaatgaatccaagtccctccttgttaaggatgcaccgttgctcactcaaaatcttgtcaagagtgttcttgccgttgaagcatctctccaaactcttgttgagcttagccacttgctccttaagctcgttgttctcaacaacaagtgaggcatcacaaattgaaacacaagagctagagctagagctaggcatatccataagatcatcacaagagatagaaatgctagatgatgcaacatgagcaatatggcaagtagcactatcatcaagcaaatcacaagatatgccaacattaatgtgagctccatgttgagtagtggaaaggaggttgtcatgagcttacttaagcttcttatgagaaatggtgagtctctcatgagaggtctttagctcctcatacaagacctccaaagaagcatgatccatttttagggccttgaacttaacaatctccttctcactataagcatggagctcctcaaacatactcacaagctcatcataggaaacatcatcacaatcatcatcactctcactatcactaagagatgttaccttagaagagccctttgccatgagacaaagtggagcgaagagtgttggagcctccttgatgacaacaacagccatcttcttcttcttggagcttgcatcatcaccaccttcttcctcggacccagatgaggcggagctctcctcatttgagtcccattctccgatgaaggcctcaatcttcttcccttccttcttgagcttcttcatgagcttgtagcctccactcttcttcttggatgacttgtctccatcatcatccttggaagggcacttggaagcaaagtgtcccttctcaccacactcaaagcacctcaagttggagagagtcttgttgggtctcctatttcttctcctattggagttggagcctcttactctctcctttcttcttcccaagagatcattgaaccttctagcaagaagggcaatctcttccttcaagtcatcattggcttcattcaccttgctcttgcccttgtcttcaacttcggcttggagagcaatgcacttcttggatggtgaggcttcctccatctccttcttcttcaacttgtacatgtcattggtgttgatcttccccaagaggcttgcgggtgtcatccttgacatgtcggagttgatgagcatggtgacaagggtctcatacttcttcggtagagccctaagcatcttttgggcaacctcaagatcggtgtaggttgccccaagccccttgagatcattcacaatgacattgagcctcccatacatgtcattcacgctctcatgaggcaacatggagaatgtctcatattggatcttgaggaaatgaagcttggcatccttgtactcacttgtaccctcatggatctccgccaacttgttccaaatctcatatgcggtctcaaggttgctcactctatcgaactcctcttggctgaaggagttgaacaaagcattcatggcttgggcattgagttggaggttgcagtgatcaatctccgtcaagggtgtgccggtgatagcaaagcctacatccacaatactccaaatatggaagctcatagctttgaggtgagtagacattttaattttccaagtggagtagtttgtgccattgaacatgggagccttccctacatggttcacctcgttcgacatcttctttctaggcggtgaagcccaatcaagagagaccaagctctgataccacttgtaggatcaagatgtcgactagaggggggtgaataggcgatttaaaactaaatgacacctaatcaaaactaacctaagttgctaggctcgatgagggacaagtctaactaagcaactaagttatgttttgcaatcctagggtgaaagtggctcaattatatcactaggaaagtaaatcacactttctaagtctagtttagcaatcctagggtgaaatgatctctagtatgtctctaggaatgtaaattgcacaaatgtaaatgcaacaagtaaatgagacaaggtgacaagagatttttcaccgaggttcggaaactcgccggtttcctactccccgttatggcgagcccaactctaccgctcaaccacgaagccaccgcacgcccccttcgtcaaggggtgggcaaggcgggagccggcccacggagaggactacccaagcttcgatcactcggggtagtttttccttcactccaaagttgatgaactccaaaccactcacaaaccggcgccgggcctccttcacaatcttctcgaagaggtcaccgggcaactcttccacaagccgtctaggaggcggcaacctccaagagtaacaagcgatgacccagcgtagagatgatcaagtgacacactagctctacaatgaagcaatgcacttgactcttggctaatcaaccctcaacactacaatggatgaacactaagctcaaatgtgtgtgagagaggtgcaaggggtgtatgcaagtgatttgggtgctaagagagtccccttgctgcaggtgggggagtatttatactcctaccaaccaaaactagctgttgggggtgaaatctcccaactctgtgctctgccgatctgaccggaggtatgtggccggttagaccgtgctactctacaacggctagttttctagctgttctagggctgtcattgggccccacagccctggccggtcagaccgacatggggtggccggtcagaccggccttggctcggtcagaccgccctcagctcggtctgaccgaatacggctccggcggctcgggatcggccatcccagagcatgccatcccggccatatgaccggccggtcagactggacaacacttgccggtcagaccggctttgtggaggcgggcagaccggccgtgaccctgtggtcagaccggctgcactggccggtcagatcggcacttgggctgcggtcagaccggctctggtcaggccacacagtgaatgcacaaattgaaatatggggagagtctaaatgcgagcacaagtctaaatgcataatgacctaatgtggcaattaaaatcatctctttgctaggtcattacccatcttaatagtacggcgaaggtaaaattacactagcaaattcgatcgccctacacctcgatcaatttaaatataaagtactagtttaccatcttctcatccttcgctttgcgccgtcaattttaatccttcggtgatcatccatgtgcacacaataagtgaacctaactcaaataaatatctcaaagacaacggttagtccacaattagtgcttgccattaattaccaaaatcaacaacgggggcctagatgcttcaacgggtagaaaatccgctaactaaatagaaggaggtacggtcttgctcgttggacccaaaacgacgcggcccttgccaataggtaaattggtatatatcttcatatttatttctgttaatttgattttttgcatcaaagcatgtttgaatttccaaaatttgcatttagacttaattttgaggaaattacttcaaatgaatttttcagagcaaaataaaataaaattttcaatgaaaatttgctatgccatgaccacactgaccattggattccaacggccaaaagtggggctggttgggcctactaggggtttggtcgaaccggccaggcaatggttggcagccgtctcttttcgaggtcacggctagttggccccacaggccagttttgaccgttgtgggcaccctatgttagccaaccggctgggagaggggatttcaccctatttcaactcattttcactccccttccaaactttgctctcaaaattcattaaagctttgcaagtttgcctcaaattcaagcattttagttgcatttgcaagttgtcttggtgaagctaaccggcgggtagaagtcttgctatcctaacccccgccgagttagtccattttcttgctcatttgtgcataatgaagagacgattgtcccgattgttcaagaagggactcagctctccatcaagtcgccatgacgagtccagtgctcgttcatccgtcgatgtctcaatggaggaagccgaagttccaccacgcctcttgaatgacgccgaccttgaccttgtcggtgatcgtgagctgcaagcctactacatgctaaaagaccggttgtttgctcacacccgggcatacgatctggagctgttgcaaaagataggtatgaatgttgattttcgtaccatttggaaagctgttggatggcagagatttgcgatagtagatgagcctggctctcgtttgctcactttgcaatttctatgcactttgaaagaaatagaagatggaatttcctttcgttttttccgtaaagaacataaacttacatggaaaggattaagtacacttcttggttttcatgatgcctataaaatcgatcttcggaaaggaatttccgggttcgagaaaaacatattttgggaagacatttctggtgctccaatttgcaagaaacctagaacaaatgacatccataatcctacacttaggcttatgcacaaatggatagctatgactttatttccttgaggtgatcttaggcccataagagaggatgaattgattatcatgtttgccatggttagaaatattaaagttgctcatgtgaactgtatgataagaca

SEQ ID NO: 4876 - DNA, 15085 bp, Oryza sativa
  unsure (1)..(15085): unsure at all n locations
acttccgcttcgaagggttcaatccttaccaatgaccctaagcgaaagacaagcttagggggagacatctctccccccactaaggtaacttgtgtcattgcatatttttctttccaaatgcatgtttatttttcattgcatcttataaactaaaaaacaacataaaaatttacaaaatagaaaggggcatttgcaaatttgccatcggttttttcaattttgcaaggatgccactcgaatgacagttatagtggtatttttgcaattatctagtgacagttttgcaataacgattcaaagcagtggtaaatttgcaattgccccaaatagaaaataccaaaaatataggttagattttattatgctaggtaagacaacttagttctcttcgttgaaatgatgaatagttgctctgttttatatctctcatatatgggttcatggttaagtactatctcaaaaattgaataagagtagccaacaattatccggggacctgagggaagtgagctgtactttgctaatctgagtctaagttattgcaagatataagatagtaaataagagttgctatgatcctattctaaatatgacctgaattccggatgttttattttcccaaaatgataaactcatgaagttcctcatttgataaaaattcctaccagagccaaaaatatccatcttgattaaaccatatatatttttcggttgcttgtaattccattgaactttgtcaaatctttgtgacttgggtagatacttttcatgctctatgatcaagatcatacacccatatgcacatgctaaacatctacattggaagccagcatccatccattccatctttatatccaccatattattatcaaaataaattctccatgcttttatgtgctttcttctcctagaaaagaaaattctttctaaaaaaagaggtaggagggaaaggtatggttacgaaaaaataataataataaatttatgctctctcaactattgagcatgatgaaaaggaaaaaaaaatgtgtgtagccatgccctctccatatttatgaaagaaggattttggagaagagagtaagcataaaggagaagcattttctttattttccacattccattcccattataccacacacactttgcacgatcttgatcttgagtatgtctagtcatctattttagtccaagtttttgatttagtaataaatgtgaatacaagtattccatgtttgatccctaccaagctccacatatcaaccttagaataggaataaaaaaggcaaatttggtgaggaattcatattcatacactttgagagatcaagtgaatcatttgaggaacttggatttcttttgcaaaattcatttgaaaaccttccgggataaaagttgaataaagattgggtgactagtactctgatgattgttctatctttcaaccgcttaagacaaggaaatgcagtgtctcgtgggaattaggtgtaagggtaagccaccgtgccaaacttatttaatttgagagagagtagatatacattgcacctgtacatttgagatatacaacatagtagcaactcctgatcaacaactaagtttagatttttgtgaagttcttcactcggggcgagcaaaggttcaagcttgggggttttaattgatggtcgttatcgatcagttgcgtccgtcaatattcccaaaataaaggagaactagttatgcttgcaatgcaaatttatgttagaataagttctattccactagcactagaattctaacctcttgcagagaataaatataaaatggaggagaatcggtagcaaaacagacaatcaaataatcggacgctatcaagaatcagacttgcggacaagtgggctgagaacatcaaattgacacaaccaaaacagtccaaaattcacaagtctttggaaaggagcaaaagaggaggccacctgccgaaattgggctaggtcggcccagcacatgttttggctgaacccgtcgtggctccattggatgcagggttttgatggacggctgagattggctccctatgacggttggagggtattaccgacctttccaaccatcggaaccggcatactcaagctataaaaggccctcactccctccatttcaacacacacctcaagcaagaagaatcaagctctctctcaagtttagtagtgttctagagctagtggggtaggaatagaataggagtcttagtctgagaagtcttcggaaggattcgggtatggctctagtagctcttctctcttttgtaggacttgtacttttattagaatattcttctttatactactctggtattctatcacttcccgagtatatgaataccaactttattatatatccaaattatattgattatgatgctaacttatgtgggagatgcaatggggtgggcataatgatcttgtatacgattgctctatgtcatgacgatgatattagagtagtatttggtaatttaagcgtgttgtttagattactagatatcgttatttggggttatatgctgcgggtatgtcgaggtggggcgctgatggtgacagctcagtacaggtattcctctccgtgcgtgtatataatcctaagtgactttcctgaggagggtactcatccgtatttagccccggttggatggtcatgatgggttgtcgtaaggaactcggcaatcaggggtggcttatcaaagcaccaggagggcattggaaatgtggtattgactaaataatcatataactaggatatatatataatgtgtatgtatattacaagggtaggaatagattctttttactttctttccacttagcttagatgatttattatgagagtatataattctcgtgctgtatgtcactctaccctattcattatcttaacccctgcttagactttgattattacaagtaatatataagttattagtatagttttctctattataatctttccacagtattaaataaatacgatacccttagaatactctcgggtgaaatgctaaaatggtatatccgtgcgcttgcggatgaaatgtgtaaccataatatagcacaagtgtttctgggtcattgttgggaattatatttctagtaatgtcatgaagaaataccaacactagcttaattaccctcaacgcacatgtcccttctaataaaatttccagctttactcgatctgaaccgtgcatcatgtcacaaataattgatatttgttgaagattaatttgcaaaatttgtgaattaagcaagattttttttttcaaatcttgcacctcatcgctgctagttctcaagcaggcatcgccgattactgttgctcaacaccttgcaggagcagctcgccaacagtgagtgctacggtccggtggcgagtgctagggtaaaacatggcggacatcctcaccggggagcccactattcgatgacttgtcagaggaggtgatgctcaaggagatggccaacatgcgcgagaccggttcgagtccacgaggacaaagctattagaccttagacgagctgccggagctgtcggcggacaggctgggacccgcttgaaagtcgatcgatgtggccgggtccagctcagatgatgacatggaatacgtggggcacactaggaaaaaaaaccaaatatgtcacacaagtcatcaactgttcgagtaggaagttaggaacaggactaccctgttacccttgacttgcttataccaaccgggcctcaccgtcttgccgtcgtgctcaccccgcaacctctctgtcagccgtcaccaccatccctagcgactgatggaagcttagggatggtaatttccccgttgggggcagggacccgcccctttggggacggggacggggctgcttttcgacccgtgggttgggcggggacggggccccacatatatgcggggccggggccgggtgaagggttccacccacgggtccccatggagccccggaattaagaaagatagaaatataatagagggccattaccttaaatcccagcaaaagaatggatatagatgatcatttgacaaaggcccaacataaaagcccatcaagtccacataggggatgatataaaagcaaaaaaaaccctagctttcccgatcctactgagccgccagtccgccacccacacatgactgagtcgcggtgcatccccaaccatgtcgtcaacggcttaacgtgcggaggttacttctcgcgactgcggcgccggatgccttctcctcctcacgccgtcggcttcctgctcctcctcgcgccggtggccacctgctcctcctcacgctgccggcctatccctcctactcctcacgccactggccgcttgctcctcctcgtgccgccagccactcattcctcttcgtgccgccggccacctcgctcctcctgttcctctcccacctgcgtcttcttcacttgcaatggcagagtgacctcctgcggagccccggccgggttccggggacctagagggtgcggggacgggtagcattttgtacccgacttcctcttcggggccggggccgggggatggaatcggcattgggggtgggggcgttcttgcccgacccggccccaacccaccccgttgccatccctactcaagctacatgccaccgtcacctcattggactgccgtggctcagacccctcgttgccaactggatctggcttctctgcctttaatgagctttgtgctacagtggaaaactgtcacgcccagaaattcacaagtaatttccgaactaatttgtgcattaaatcctcgtccaggaatcagccgaggtacacaaactgacaatttaatatacagattcatcaaaataactaaaacgataaatacttacataagagacacttagtcctcaccacgaagaaaactgcagcggaaaacaaaatctagcgaaacttcagctccactcccacgggcagctcaactgggatctaagccaaaggtcttcttcttatggatcctttttcttcaactgaggtttgatgattattgcaaggtgagcatatgacatactccgcaagccacacaacaattatgcaaatgcacaaggataccaaaggatggcataatatagggttcatttgcgaaagcagcatttagcaaagatttaagagtagtaaaacagtagagtaattaatcatcaatattaatcaacactgaacagcacacccatgctgcacaggcccaaccaaacctgaacaaccaaccccggtcgtacagaacaaacctccaaaccaggaattatccattccaaaccaggagtcaaattaattatcacattattatcattaacgagtagtatgggactaatcacgaaaaacattgttagacccgcccataaccgcgggcacggctattcgaatagttttactctggccagagatgtaccactatacccacaagacacagcctcaacatcatgtccaccatgcgtcgcgatactggaaagtacccgaatagaggatgtgacaataccccctgcacaacacaacccaccacagtgaaccgttcctggatcataatcaccccctcaataaccagaggcatggactccccagcgacccccacggacttctcgccgattctcagtctggcaccccgtaatgaaccatgctatacaaaaggtaaagccgttgcccacgctggcttgtggttggcacggttaatgtttcacaacagtagctcgcgaaccggtccttaattgtcatgagcacgaccatcaaaaccatgtgctcacaacccaccattaatcaagttttaattatcaattatcataacacgattgaccatcgtgagctaccattaaatataaccataattggtagtgtagtatgaatcaccccattaatgagctaatatttctaagcatgactaagcatctataataatcatatagctgaaccaaaccaatatataaggttctagctaatcaaattataacccataggaaaataaagttatcttcggccataattaaatgggaaaggctcaccacccggtgacattcgaaaataatgtataagttcaaataaaacattagctttaaacgggttcaacatgctcaaagggttgtttgggatctgtgtgacttgccttgcaaacaagcgtcttcaattcatctttaggaactcctccaacgatcaaacgctccttcgaaacgaccaaaaactaaacctagaacgcaaaacgagaaaatacactaaaaaaaccaaataaacagtacaattaaagttcataaatgggtaaagcttgaatttatatgaattatgaggcttgaacgacctcattccgagttcttatgaattagttatgaattaatgaagttttaatcaattaaaacctataaaagaaaacaacctaaataatttatggcatcatatttaattattgttgcactgaaaagggtagaagatgacatcagccctaggattagagaaaaagagctggtgatactgataaacggaacccacctgtcatagagacaggaggtagctcgatccaccatagactcagttcacagagaggtccataagatggatgactaggattagattgactagagttgaccatgatcagagatcaaatccgatctagggtttaggatagtggccacatgacaacacgtggcgctgacgtggacgccacaaggacagccacgtcgacacggtgccggcgagcactggatggttacgacgatggcaaacggcggcacgacggcggacactgaggacaccaacgcgaagagaagatcagcacggtccttaccggcacttacatggcgacgggcgatgaaaacagcggccggtgatgagcttcgaagggcgacgagatcgggatgacggtggcggcaactttacggcgaataccggcggagaaagggtggacggccttccgcttggcgctgcaatgcccacggaggaaacttcgaggttcggcgaccatgggggaagcggcaaagcttcgccggagatcaaaacatggcgatggttcggccttcacggtgatggcgaattccggcagggtttggcgcaatggagcgggtggccggggtagctctcacccttgcgaagccgagggaggtgacggggctgaccggcgacggccgaggcgacggcgcacggcggctggagaggcgaccggaggtggaaagagagggagctcgcggggaggcggctagggttagggaaaaattcgggaaaaaaaagggaaacggaagaggagacctggggcatgctatttatagccaaaggaggaggagatcgactcagttacgggaggaatcggcgacggattagttagggttcaccggaaaaacggagctcgaaaccacgtcgaattcacgcgatatacaacgggattcaaaggggtttcttagggataaggtagaggagttcgaggggaatccgtttttacaaccaattttggaaggggagcaacggagtggccgaatttggtggggaggcggcgctgtacacgggcacggcagggaggagatcaaccggctggaggttaggggcgacactgtagcatagggaggcaaaacagacttcttttcgggcttccttttctttactaggcctaattgcaagaaggaccaaaactggacttcagctaagagaaagaggaagagtgggctgctgcaggctaaggaagagagagaagaggagtgggctgagttcggcccgggcaaagaagaggaattaaattactttttaatttaaataaatactgaaatgatatctcatttattaaaaatacttccagtgctcaaataaatccaagaaaaatcctgaaaatacttgggcagaccaagtatttaatgaaattttatctagctcaagttaatgttcaaatttttcatagattttattcacacacttactttaatcatcaaataaattttaaaaatttctttctcacaacaatttataatttagcgattttcagggtgtgacaaaaacaatgattctaagtgtatttctgtagtaacggtgcaagacagtgaacatacatactgtacatagttagggtagcgatcgatttcattcgtccgctgtgaatcggacggctaaaaatactcccaaaatcacatcactgtagctctctaacttcacacatgtaaagtcagatgatccaaatccttgccaacctcaaggcaaggcaccagcattgctcctcgctgtctgttcccaggcacccatcgtctttgcttcccgccattgttctacatactaagcatcgttaaaaactgatattatgtggtgaagtgagcttaactcaactggttaggttccttgtggtggaatctgtctaccgggttcaaatcaaaaactagacacgggtactcgtatttatagctaattattgttttattggtagatgacaggtgacgtaccctacgatagtgagacgtctcacattatgtgactgcatactctttgtacaagctactgcacgaattcttcgaccttaccttccatgggccaaccccacctccctcacccttcctaagacccaaaacccacctcccacctcggttaaagggcggttaaagcgtcctcccgatggtccgaccccggtctaacccgcctactcactttcccccctcatccacctctttgttgtttttgtctagcaggggtctagcaggaattgcgcagtaacaaaacgatcatcgtgtagtaacaggataattgtctcgcaataaaactcaaaatttggatggaggggcagcaacagaaggctaaaagctggggaaaaaaacatcaagatgtctagagctcatgttttctgttctagttattgtaacacctgttctgaaatgttatgttgtctcttctttctttgtagcttaggtgtcaaattggtattgtttattttgaggatgctaataggacttaagttagatggtcttcctgtaggcttagatggtgggatggtgctattggtagcctcacagatatatatctggatgcataaaactctattttgtactcctaagtacattgctgttaatggatatgggaggaagtctgcctctcttttatcaaaactggctcaatcagtgacataacgacatgcctgtacatatatacttatactgatttcagcagtttcacaactcaactaaaccgtgaccttgaactgtaacctgcagaggactgatcattgtactaatatctatttcaagtagctaataatgtggtactccttccgtctcaaaatataagaacctatgaccggataggatgttttctaatactacgaatctggacaaatagaaaatattcaatccggtcttaggctcttatattttggaacggagacagagagagtagtttatttgtacagtaaattcgtttgtccaacagtgcttctgcccaagctgattgttggttgccagaactattaactattggttgataggaatatacggagctaggcagcttgcttggggctcaatgggacggaagcccatgttgctgcacatacctgtgctttatctcctttaaatgctgtaactcaatttcatgttccattttcaagtaaagtgccaaataaagtgcagtgaattggtaatttaaatcatgtgtgcccctaatgtcaataattcatatgtgctctgtgactacataaatttatcaataagttctgacatgtttggcaaggcatggttttcctgtttgaaccgaggcataattcatcaacagttgcaaccatctagtaataatctgttttgagtttgctactgtacttatagcactagatacataataaaaaagtgaaaattgaccagaagaccaaaaagtaaagcaatgcttgtttcttcaaatgcaaaatctacttcgagaggcctctcgatttagcattaacgagcgaagccagctatacgtgagagtgagagaaatagtactattagtactacacatctacaaacatgcatatctttttttctattcttatataattttctcttaaattacttatccgatctataatccgattgcaccatttgttcgttgtaattaaatctttataccaagattttatattattatattataataaaaatattcattttttaaattacttttatctctctctctctctcacacacagatatatatatatatatatatatatatatatatatatatatatatatatatatatatatagcttttagatttgattaaattacttcttatacattcataatgctctgagtttattacttttattatttctagttaattccataatttattctgattaaatttaatttctagatagactcatatgttaatccctacacggattacttctaatgtcataacaatttacttctattttgtgttaagttacttttatggtttatgtaaaaattactttcaggctttattgaatttacattcataaatgtatttacttgaaaatcttctctacactttgcttgtgaatttactccagataatttcttatttcaactcagtcataatgtaattacttctaatgttatagagagttacttctattgcattgctaagttacttctacaattaaaataaattatttttaaattaataaaaatgtttgaatatatttaacatggatcttgttttgtcacatattttgagtggcaaacaaatattaaaataatatgtgatttaaaagatataagttattaaagaggttacaaaagacatgcctcattgtatattattttagttaaatagggagtcatacctgggatgaaccagcgaccagtcgctttgtagtcgtgtccttcttaaaaaccagtcacaactcataaagagcagtaataaggcaatgtttagttcccacgcaaaaactttttaccctgttatatcgaatgtttggacacatgcatagagtattaaatatagataaaaaaactaattacacagattgtgtgttttaagcctaattgcttcatgatttgataatatggtgctacagtaaatatttgctaacgacggattaattaggcttaataaattcgtctcgcagtttacatgcagaatctgtaatttgttttattattaatctacgtttaatatatcagtatatccgatatgatacgccaaacttttcacccctgaaaataaacatggcctaagtaaagatgacatgcaataaatcctctggaatctttctgttgacggcagtttttcctcccccctcctgctggtcctgggttgtactaatataatattacttactcctctcctgcaatgactacatttttggatgttgtgtcctatgtttaaccatccatcttatttgaaaaatttataattttttttcaaaaaatttagtcacacataaagtattattcatgttctatcatctaataattagaaaaatattaatcataaaaatttttaataagaggaagagtcaaacgttgtattaaatattaaaaaatgaagcctttgtgggacggagagagtaatcatcaataaagtcctgttttccttttaaaaaaatcatagaacatcctccctccatccctacgtatgtgggatgtaccctggggaaaaatatttacaaatacacttttttttaataatttacgtttatatacatcaataacaaagttttgtaaaaatatacccattctgtggatccaaaatacggaaccgacacggtcccgcagcccgaaaatgcaggacctgaacagtcccgcggtcccaaaanntgcaatcggggtaccattgatttttcacactgcaaaacactgttccgatactgtgcacaattgttccaacactgtgttgcactattcacacagcgtgcccgcgcctccattgtgcggaaccgacgctgtaacagtgtcgaacaaccccgggaacagtactgcacagtcagaacagtgcggaacaatgtcgaaatagctgggcaacgcggttgcgcgttttgggaccgcggactggctcggtcccacgactgcaccatgggaccgtttgaatttgtggtaccgtcgtaggacgggtatatttttataaaactttttcatagatgaatataaacgtaaattattgaaaaaataaatatatttgtaatttttttttcgtacctatgtctctctttgcactcacaagtcacgacagtttcaagtaaattacctacaatacattcccaacaaactcattttccacagtttgggtactagatacttaataaaataacagaagtccttttctatatcaaacatattccacagtaaaatgcatgtagtattcattttgcagtttactagcccacaaaaaggcttattgaaataacaaaaaataaaaattattgaggagactgggctgtaagtcacacggtgggtcaagtcgtgtcgtgccgtattgtctaagccacaaccgcaaacactgtaaagcatccggagactggggtgcgtcaacaaagtcgttcaagattctttacagacaaaattaaaggcgtttgatgtgaagagcttgggctgagtttagttccaaactttttctttaaactttcaactttttcatcacatcaaaatttttttatacactcaaacattcaatttttccatcacatcatttcaatttcaaccaaacttttaattttggcgtgaactaaacacacccttggttgattcgttactccgttgagcaaactgttaatgaaacagaaagcagaacaaggcatccaaactaaggccattcacattgcaaatccctcttttgtgtcgacttaaggtgagagagtgtaccacattggatggagttcctataaagcaactcgtttcacaatgcatgctattttaatgggtcccacgagcttttcacctcccctctctctcctctcttcctttccccatcgcggaggaagcctcgtcgccgtcagccaagtccacgtcggcttcgctctccctgccctctacaccggtgccgctctgctcccttccaccgccggcgtccttctccctgccctctgcatggacgacagcgccatcgaactcactaggtccggcctagggctcacctgatctggtctcggcagcagtagcagcacggcggcggcggcatcggtagcttgatggataggatggcgtgtggatggcgcacccgctccactttgtcctctcgtttccctcctcaccacagcggtggtgcaaattgaggctacaccccaaatcccctgcctcactcccacaccagcgacaagctccaccgacgtctctcccctctcccctctcatgtggcaacgagcttggcgccaccttgatgcagacgggggccttgattgtcggatctggtcaggcaaatcggcgagtcgatgagctcctcagcagtggggcgaagagaagggttgctaccgccatcgagcacctctacgctggtccatggcaggagctcctctctctctctcctttttttacgcttcctctcttttgttttctgtcacctataacaacgccacccgttctctccgagggagcgaggagcatgctgttgagctgtgatccaaattcatttgcacttaataaaatacagcttctgccttagcgaagcggaggcccgtcgccggaggcttgggccggagcccccacggtacggatcgtcattccttttaggtttccaccatatatatacctcttgtaagccgccgtgtggcgttgtatcctcacccccgatatagtgaagatattttgctggttgacgctcgtggtttttctctcctactttgggagggtttttcacgttaaatctcgtgtcttctgtaattgatctgttgttttttatcgtaggaacttgacatgtaggtggtaggctggggctgaatatcacctaagacatgtttggttgtagttgtagattttagaaaataaactagaagccagaagatgaaaaatccagtttctctatatttttagaagctggctaccatccagctacttctcataatcttaaacttcgtaaactgggattttcagaagcactgtgaatagcctaaaaagtcgccacgatttggatgggacgtccaggcatccggaagcatggcgtacaagatggggtacctttaaatcggagactgactgagtgaaggttggttggttcacacttcacacacatctttttcgaccaactgaagtactactagttaataatctgcctttttaagggagaccggcacgcaggcccggcaatacctacgtactgccatggatggcacatctgccaaggttgtgctcttcatcggcgccagctttagcttcttcctcatcacgcatgctcagcaacaagctactcgttgcagaccacaagagagagacgccctcctgtccttcaagcaaggcatcaccaacgacagtgtgggcctcctctcctcatggcggagaggccatggcgattgctgctcatgggcaggcatcacctgtagcagcaagactggccatgtcgtcaagctcgatgtcaacagcttccttactgatgattcacctatggttggccagataagtccatctttgctgtctctcaactacttgcagtacctcgacctcagctcaaacttgctggcagggcctaacggcagtgtcccagagttcctaggttcaatgaacagcttgatacatcttgacctctcctacatccccttctccggtacactgccacccctgcttagcaaccttaccaacttggaatatctcgacctctccttcacatcattttctggtacacttcctcctcagctgggcaacctttcaaatttacggtatcttgatgttagtgagatgcagaatgtagtgtattcgactgacctctcatggttaagtcgtctgcatttgttagagtatattgacatgagcaatactattctcagcaaaataacgaatttgcctgccgtgctcaacaagatcccaactctaaagcatgtcctccttttgaattgttcaattccaagtgcaaaccaatccatcacacacctaaaccttacccagcttgaggagcttgatctctctctcaactac

SEQ ID NO: 4877 - DNA, 17452 bp, Oryza sativa
  unsure (1)..(17452): unsure at all n locations
aatcttgaaaacctaattatatcctccaattacataactggccaagttcctggatctatttgtgagtcagaaaacatgaaacacttggatttgtcaaacaatttatttaagggagaagtacctcactgtcgtcgtatgcgaaacttacgtttcctgctcttaagtaacaacagcttctctggaaagtttccccaatggatccaaagcttctcttcactggttttcctagatctttcatggaacatgttctatggttcgttaccaaggtggattggagacttggtgaccttgcgtattctgcacctgggtcataacatgttcaatggagatattccagtcaacatcacacatcttacacaacttcaatacctgaatttagcagacaataatatatcaggtttaattcctctatctttgtcacattttaatgaaatgactctaaaagctgtgggtgattcaatctcgaccctggcatttgatgagtcatttgatacattttccctcggaatgaagcatcaaatactcaagtatggatcacatggggtcgttgatatggttggaatcgacttatcgctcaatcgcataaccggtggaattccagaggaaataacatctctcgatagattgtctaatttaaatttatcatggaatcgcttgagtgggaaaattccggagaacattgggtctatgaaatcaatagaatcactcgacctctcaaggaactacctttgtggtgaagtcccatcaagcttgacagatcttacatatttaagctacctggacctatcgtacaacaatcttactggaaaagttccatccggacgccaacttgacaccttgtacttagagaatccatccatgtacaatggaaacattggtctttgtggccctcctcttcaaaggaattgttcaagcaatggttatgcacaagggcatggtgatcacaaaggacaagagaaggattccaattcaatgttcttttactatggtcttgcatcaggttttgttgttggttattgggttgtgttttgtgctctgctattccacaagtcatggagagtcacttatttctgccttgtggacaaggtatatgacaagttatatgtgtatgtggtcattacttggaccagatggatgaacactacaaattaattaagcacagtaaggaaatgtgttactagcattaagcaggttctacttccgtttatagtcattttctgtttttggtggctttgtaataatggatgaatttacacttgtgggacattttgaatcccatacgtgattcaatttccattagattttttttagttgtgactagaatttctatgtgttataatgatcctgctaacagtggattcgcaataaggccttgtcatttgtttagatcaagcattttgtcctcctccctccaaaaattattatatatatttttgactaataaaaggaggctccacattcgctcttaatgcgtagaaattctcactttcctcaaattaacttgaatgaccgatcaaggtgactagatttagggtgaataggcgcctcgacaattttcttacgaaattgatgaccatttcctgtttttcatccgacgcacctctcttctgacacaccatgatcacgtagtcactgaggacctactagtgatcataggagtatgtcggaaaaacccagaaaaatgtggaagccaaaacaaggaaaaagaaatcggagcagaaacggtgatggcgccatggattaacttcaacgttctccccctaattcttgtcgccatcgcccttgagctcaacgatgccgatcccattgcataactcctggaatggaacacggccgagcggcttcatcagtacggccgccagctgctcctctatacgaatgtagttgatgacgatcttcccgttctccacgcactcccggatgaaatggtatctcgtgtcgatatgcttgctccggtcatggaaaacgggattcttggtgattgctatggcagacttattgtccaccatgatctccggtgctccaggctccgagtcaagcaggtcgctcaggagccgagctaactagatggcttggcaggcagcagctgtcgcagcgatgtactccgcttcgcacgatgatagtgtgaccaccttctgtttcgctgattgccaagagacaggactggagtcgtggaaggagaacgccgctcgtgctccggcgcgtgtccagatcgccggccatgtcgctgtcgctgaagccatgcagctccagccatcctcctttccccctggcgtaatgaacaccatggtgtcgcgttctgccgatgtacctcagcacatgcttcaccgccgcttgatgatcctcatgtggttcctccatgaaccgactcaggtagccgacggcgtgagcaatgtcggggcgcgtgttcaccagataacgcagcccaccgatgatgctgcgatagcttgtcgcgctcaccggtggacttgagcttgccttactcagcttcaggtgtatctccatcggcgtggcgcatgagttgcagtctcccatgccactcttgtagagcagcttgtcggcatacgccgactgatagagcgagatccccgtctacccctgcttcacctcgagcccaagatagtaggacaagagcctgaggtcactcatcttgaagatgttgcacatctccttcttgaattcaccgatgtttgcttgattcgcgccggtgatgatcaagtcatccacatagacgccgacgatcagcttcgcatcgccctggctgtgtgtgtacatggcgtgctaggtggcgctcttccagaaaccaagcgacagtaggctgtcgtcgagcttggcattccaggccatgggtgcttgccggagtccgtacaaggccttgtgaagccggtaaaccttgtgctcttgtccctcaacggaaaaacccggtggctgttgcacgtacacctcctcggcaagctctccgtttaggaaagcacttttgacgtccatgtgatggacgccccagccggcgtgcgccgcgacggcgagcaggagccgcacggactccatgcgtgccaccggcgcaaacacctcttcgaagtcaatgccggcttgctggatgtagcccttagcgatgaggcgcgccttgtacttgacgatgacaccgcgctcgtcctgcttgactttgtacacccacttcagtctgatcgggcggtgcgacggcggcgggtcgacgagaacccatgttttgttgtgggtgatggactccatttcctccatcatcgcgtgccgccagctcttgtgttgctcggcctccttgaatgaggccgtctcctctgccgtcacgaagaacagttcaccggcagcagctcgcggtgtgagaggcccggcacaactgtatcttcgagaatgttggcaatggtgcggtaccaaagtgggatgttgtcgtcgtgattggcgtccagggcatcagtgagattgctcggtggcgacacgaactcgggtgacgtcccacccgtttcgtccaccggcgttgccggcgatggtggcatgggcacgtcccctgaggccaccgacggtgcccctgagctcggagtcgacccgccggcttgttcctgttccgggcgttgatatctatcggcgccacagtgtattcaatggtgatgtcggtgacaccgcccttgtcgtcgccgccgccgtgagcagcccagtcccagctggctgcctcgtcgaacacggcatcacgcgtgacatgcacacagttagatcacgggttgaacacccggtatgccttggacccagcctcatagcacaggaaaatcatcagcgagctttggtcgtcgaatttcttcagattgggctttgtgttcttcacttgcgccacacagccgaatgtgcgcaggaagtggacggccggcttgatgccatgccaagcctcatatggcgtcttgccggacaaagttcgcatgggagcatggttgaggaggaacaacgccgtcgaaaccgcctccccctagaagcgagcagggagcccctttgctttcatcatggagcacgccatggcgaccacggtttgattccgccgctcgactacttcgttctgttgtggggagtagggcggggtgagttgtcgctggatgctgcggtctgcgcagtaggcaccgaactcgatggaggtgaactcaccaccacgatcagtcctgagcaccttgagcttgcacccggactccagctcggccgccgcttggaagcgcttgatcgccgccggtgcttgatccttgcttgctagcagagtaagccatatgtagcggctcacatcatcgactagtagcaagaagtagtggttcccacccagcatcgccggcaagatcggcccacagaggtagccgtgcacgaggtcgagcaggtgttcagcgaaatgcttcgcatgtgccgggaacggagcacaacgttgtttcccggccaggtagctatcgcacacttggtcgacgtggtcgattagcggcagacctcgcaccatgtcaccctgcaccatttcctcagcgattgaaagctaaggtgaccgtacctcgcgtgccaccgccatgactcgtcggagctgcgggtggtgaggcagaccgggcacgccgcgttgatccggatggagtaaagccggttcctcgatcgcggaaccctcgccaggaaccgccgatcttgccgttgcgcaccagggactcgcagccattctcgtcgagctgcccgaggcttatgaggttgacggtgaggcggggaatgtagtagacgccggtcagcccgcggtgctcgccattcttgcaggcgaagaggatcgtgccgtagccctcgatcgtgacgacggatccagtcaccgccgtgttgagctcggagaagacggagcgggcaccggtcatgtggttcgtcacgccggtgtcgaggtaccacaaatccgcgggatcggggtcgccatcaagatgcgcgagcacctttttacctccaggaacacgggcgcggacaccggcgtgatcttcgacgtgggttcggctggcgggcatcgccgctggaccaagcacgcacgcgccatcagcagcgtgggctcgtcgtcgtccttcgtggcgatgtgagcctcggccttcttggccttggagcggcagtccttggcccagtggcccatcttgctgcagttatggcacttgtcgccagggtgctcctggccacgcccacgtctgcgccgattcccgcgtttcttgccgctgttgttcgcggccgcgccgggcgtggtgccactgctctcaccgccctgctcgcggttcttgagccgtgccagccactgctcctcagtgagcatgagacggccgccactgtcaacgacctccttcggcttggccttgcatttctcgacggagcggagccggacggtgacctccttaattgacaggtcgcggatgtcgaggagcgtttcgatcgagattgctatctgcgagagatgctcagggacaacgttagcagcttgttgacaacatctatctcggggagatcgcctccaagagtgcgaatgctgtttgcgatgccgaagatgcgcatggagaagtcgtcgatgttctcgccatccttgaaccgcgcatcggcaaactcccggcgaagtagctgctcattcgcctctcgcacgcgccgagtgccgacgcatacggtcttgatcgcttcccatgcggatttcaccgtgcgcttggtggagagggagcgaagcatctccggtggcaccacacgcaagatcgcggccagcaccagccgatcgtcgcggtactcgatctcctcgtcttcatacggctccacggcgtgccaaagtccctgtgcttgctggttgacggtcatgaagagcgcacattcctcgtagttggtcctcgttaggaccgggtagtggacggcggcgctcgactccctgacgacgcgtggctgggcagcgaagggctgtcgctcgccacgcccgcgcccacggcacggcggggactcagcaggattgtggcatggcggtgtttgtgacgggcgaacgaggggagagcgtgagcgcggcggtgttggcggcggcgagcaggatggccgcggtggggtatgctccgacatggcaccagcgagccaacgaggctctgatagcaactgttggcgaaccccgaaggtgttcgaccaaattcacgatcaagaacagagtatgcaaaagagaaatttttgtgctgctgaaaacttggcagcgttttttaatgcattaggaactttaaataggcaaaatacatgtctacgacctatcggatcgtgccaacccatgaccgtgattttcgccatacctcctcctacaactccggcacttcgccatgtctcctgagcttgaccgcgccatcccacgatcgaagaacagacgaagcgcacacactccctaacaaccaaagcgaaaaactagctcccacatgaacgtgcatgcatcagagctgatacatgcgccatgatctccacaaaacagagtcacgtgcttggagtagaaataggagcagaaatggtgatggcgccatggattaacttcaacattgctcctccattacaggcatattattcatcctcatgttctgacactcaaggtgctggttgttccttttcagcaagtgttgtagactcacattggatattagactcaagagcttcttttcatatgagacatgatgtttcacagcttcagccatgctctgcttctagtaaagcctcaagtgtccagacggctaatggtactgatttactctgtttgtggcactcttcggacagagatcgcaaaaactaatcggcgaggcctcttgatattgtcttatcgcgcgatggatcggagcggtggagaagcttactacacatccatgccttttttttgctgttagacatgcatgtctttttccccttcttataaagttttctgtcaaattacttatccaatctactattcgattacatcattgtattcgttgcaattaaatcttcagaaaagatcttacatgattatattacgatgaaaaatatttatatttgtaaattgcttttattatatacgtaagttacttttatcatatatataaaaattacttttagatttgactaagttacttcttatacattcataatgctctaagttgttatttttattattgtttttagtcaattctataatttatggactttaaatttaatttttaggcagaccatatttttctccttacaacgaatttacttctaatgttgtaacaacttacttccattttgtgctaagttacttttatgattgatataaattacttgtatacttttgtcgacaggtgatacccgtagaccggataaatagggtattggggtacgttggtatgaggatctgcacaatacgacatcaagcaaacacagagatagggattatactggtttaggccccttagaaggtaatagccctacgtccagtttatatgatattgatatagaaaatcacagattacaaagagaacaactgaactcggcaataccggtgagatcgtagtcgatagtttcgactagatgacctggcgagatgacttcgcatgcttcggcttcgtaggctatggtggatttgctggtagaaagattcgatgcccgtaacccctcaggaggttctccttttataccacagatcaccttgacctncaagtaagactcgaagatgttggaccccgtacagtatagagaacaggaacctctncgagtaggactctgttgtctcccaactgatcaagataattttcataatagccgtaatcttccttaccgcatactgaaatattccatatacatgaaggtataccatacttgcatattgtgtagatcgtaggataggccttatccgtaaccctgatagtagcccccgacttcaaattaaatgagctttgttgtttacttccaacttcacttgtcgtccgcgactacccagatgcgacgttatcgtactcacttgatcgttctcagtgcaaactgaggagacatggagttttcgacaacgccacatgaagttcaacggtccacaagtgaatttaactagaagtctaaacagctgccagcaacggtccttagaaatttccggcggcaatctctctcctttcattcaaatacgaaccgcctgttagtgggcttatataaagagattttgggatttatttggagtctgcacgcctagaaactttccagcttccagcgcattctctctctcggttcatccgcctcccaaaaaccctagctttcttcctccttctccggcgaacttccggtgaccatggatcttggcaagacaatcaccgacaccgccgcaatgaaggagctgcaggtggagggattacttctcggccgtgaagttctggagcgagatgaaggaagtactgaacctaatcctccccttggtcgcatggtcatagtagaggacttcgttcgttgcggatttctaccaccgctctccaaatttctgttgttggttctgaatttttacggtctttctcttcttcacctcaatcccaactccatcacttttctgagcatcttttctcatctctgtgaggcctacattggggtagtgcctttccttgatcttttccggtatttctatgaactccggtggatggaataggggaggatatccggttgttgcggattctgcctccgcgatcatatgcgggcaagatacatccctttccaatgtcatttatcccggagcaaatggagacagaggtggttctttctcgaaatcaagaaccccaatcccgttcttgttgtgcctgaagaccaaccagaacggtcttcggattggacctccaaaccgccattgaccctttcccttgagacatttgtcgggatcagcgatgatctgcgagaacggggactaactgggtatgacgtcgctcaagacttcgtaagtcgtcgcatccagccgctccaagcccgtgcacatccggcgttcgactacacgggggcgaaagatgtgacacggatctcattgcggggtactcgttctcgcgtcgtcgtagtccttctcgtcgtcaccctgtccttttgagcttaacttgaatcgctttcctcttacaggtctgaacaacaacatggtggctcatcaagtaggccaagtactggtgagctcgccatctacagctgccgagatccccatcctagtctgcaacctcgaggacgcagacaaagccgtcgctatcaatgtgagtatccttggtgtattttattcccttgtcaaaaaacgaagtaactttaacacttgtaggccttgcccctgacggacgccattggtccactcgtcgatcaccaggcctcagcctcgttgaagtccaatgtctccgaggagaccactgccgccatcgccctcgccgagaacagcggcaccgcaaagaagaggaaatgggccgtcacttcttgcggaggcaagactcgtcgtcaggcgagcggctccgacgtaagtgtatctccatcagtcctccacatttttattataagaaagtcctgatctttatcttacgcagggtggaagcgatctcccaccaactccaaagaagcggctgctgaagggaggtgtttcccggtaaggaaaaaacttgaactcgtagattattcgatctcgttatctctgtactctgttctcatccactgtgagtacgcttgttaccagcaaggcttctccaccgtcctcggcgcaaagcggggaccaggtggccaccagcgacgtgccaacagtggtcgcgactcggacctcttcagccgccgcagtttccccgaggatcggcaccatcgctccaccgctgcctccgtcgacccccgcggccccatcatcctggtctgaggtactggccgaagaccggcgccttatcgaaccaggggaacaaatggtggccggcgtggtcgggcgtgctaacgctcgtgcgactgaggcggagaaatgagcagcgggcctcgagcaggagaacaaagaactacgcgaggatttgaaaaagatgagggaactcgttgctgggaacgagaggcaattccgaggcctgcggcagaagtcgtctgagctggaggaccacctgacgacaatcagggaatcccttcgcaaggacttcacccgattacaccaggttgctggtgaactcggaatctactcctcgattccgcagcaccccgacgaaacctccttgacgttcggtctacaagacctcgtcaaggcgatggaggcagcgcctgcaaaacacgccgcgaaggtcgctgaggagacttgtaccagagttcgcacgggcgcctgccatgtcctcgcctgcgtgaagatcgctcatcctgaggtcgacctggagcaggccatggcgaagggaggagctgatgacacacgcgaggacgtgatgtcggaggtggcggatttaggggagttaatcctctctttttacgaagagtaaaaacccgcgtcttctatgttttgaactctttttgttttgtaaacacttgtcgggcttgcattgtctttaaacaattatcccttccggctttagtaatttgtagtatttgttatgacttgtagatgtcttgatgttgaggacgtccagcagagtggacgtcctgattcacccgagttcgctccggttgcatctccgcaagcatccagtccggatgtaaacgagaacgccatgatagctgtgaacgcagctgaagtcgtcacttcgcctggcccaagtccgaccacgcttcttcgggagaacttaggttagatattcttggatcactttgtctgcaattcttgcgaagatggatcccttagaattttttcctttttgcagccctcgaagaaacgcttgctgaatgagaacgcctaatccaagtctggaagacgaaatttgaagtggcggagctcgaacgcaggattgagattacccggaaaacttaggatgtcgagactctttgaggacgtgaggtttggttgaactcgtatctcaagagctgctgcgacgtcttggcaagggtttgcgaggacttgcgagttgagcgcccagcgcctaaggaatcgacggcaggatatgtgccttggataaagggagtgtgtccccaactagatggcatcggtgcccgtagcgacaacgcctaaaagaggagtgtcgtcgagcaagtcgctatgccgggggtcactttctcacatgtatccgagatcaccgtccacatatgaacctggggttccttgaggcgggctttaggaactcgcggttgtagaccgagcagatcaatcaacttgcacaatcatttgctcctctagcggaacgggtctttttatccatggactggcgatggccgtcgtggtagatgtaatatctgcaaaaaacatctcaaacaagtttgtaatataacaatgtctggttcaacttttgtaatagaattgaaatctatctcctaagtacaacttaaataggatgtgtaagagtgcttctcttttgtaaactgctgttagtttattttgagttgtgagctctccctagcccccagccttgttctcggagaactgttctcggaggagaaggcttaaaaacccataactcgcctagttgaaactgcggtttacctagcccccagccgtgaagttggaaaaatcaatttccgattacatggcttggttaatacgcatccagtgagctctctgacatgaccaattctgacatggtcgttcagctctgattaatctgacaaggccttattaactctgggcgtcccgaggcgagatccccttaggtttcttggaggctttgtcaaaacagcgtaaagggacgataggttcgatttcaacttaaggtgttatcgtggtaagggatctctgggttaaacactacagataactgaaaagagttcgtatacctctgaaataagctttattttactgttctgtaaggaggaaacttacagacttggatacattgaatctatacatagaatttacgtaattggtcaatgttccaggagtttgataattcgcggccttcgccatctgcaatcttgaatgcgcctggtcgtaaaacttgtaccaccgtgtacggtccatcccacttaggtgagagcttgttgtgccctccttggttttgtactcggcggaggacgtaatcgccgacggcaagtgtgcgagctcgaacgcatttctcatggtatcggtgtagggcctgctggtatgcggctgctagaacggcaactcgttcgcgatgttcctcaagtaggtttacatcatcacttcgtctttcctcctggtcctcgtcagagtattgtttaactcgtgtactctgatgccgcaactctgaaggtagcatggcttcagatccgtaaacgaggaagaaggtgtctccttattggacgaagtcggcgtagttcgcacggcccacagaacgaatgggagctcttcaacccagtgtttgttgtaggccatgagcctatcgtacacacaagttttgatcccttggagcacgatgccattagcccgttcgacttgtccgttactctggggatgagaaactgatgcgaagcaaattttgactccaagttcaatgcagtaatcttgaaaatcaccgcttgtgaattgggagccattgtctatgaggatgcgatgaggctatccgtatctgcagaacacccctttcatgaacttgatggcgttgtcggctttaatttctcgtgtgggctctgcttcaatccacttcgtgaatttgttgtttgccacgaacaagaatttgtagccgcccagtcctcgtgggaacggtccgagtatgtcgagcccccagcatgacaatggccaagtgagagggatggtctggagtgcttgggttggcaacttcgtgtgtttgctgaagaactgacaggcttcatatcgttgcaccatgtcgcaagcatctttgagggcggtcggccagaaaaacacttgtcgaaaagcttttccaaccatagtacgcccgctggcgtgtgacccgcatataccttcatggatgtcgaggagcagtgctttgccgtcgtcggacgaaacgtatttgaggatctcgttcgggcccattttatatagatctttgtcgatcaaacaatagattctggcctggcgggatatcttttctgcctcaacgtcgtcctcgggtagctcatcggtgctcaaaaatttgataagcttgattcgccagtcgtcttttgtctcgatgtccgccatgacgttgttgacctctctagcccttaagttgatatcggaatcggctgtggtattttcgtcgtgtgactctttcacagatggttttgtcaggatatccagaaaagttcctagctcaagaggttctcttctagaagcacaccgtgctagggcatcgggttcgacgctgtcttttcgatagacatgtcgtacctcaaggccgtcaaatttccgctctagtttcctgacttcggcgaggtacttggttaacttggggttggagcacttgtagtctttgtgcacttggttcgtgactaattctgagtcccttttcacaattaatcgcttgacacccagtgcaatagctgctcttagtcccacgaggagtccttcgtactcagctgtgttattggttgcccggaagtcgaggtggattgcgtgtttgaactggtctccagtcggagctgtcaaaatgaaccctgcacctgctccttggctgttgaatgcgccatcaaatgccatagtccatgtctctttatccatttgactgtctggtctattctctggaatagtccagtcagctacgaagtcagcgagaacttgggatttgatggctattctcggcacgaagtgaacatcaaattgactaagctcgactacccatttcgcaatgcggccgacaacgtccttgtttctgacaacttctcccaagggaaaagaggaaacaactgtaaccttgtaggcttgaaagtagtggcgtagttttcttgatgtcatgatcaccacgtagagtagcttttggatctgtggatatctggcttttgcgtcatggagggcctcgctgacgtagtacacagggcgttgtactttttccctcttgacgacgataaccgtactcatagaataagacatggcagcaatgtataagaaaagctcttcattgtattgtggtggattgtggtgcaacgagtacagtgggatttgacaagtagtgtttgagcgctatgagtaaagcaaagaagggttgtcctcgttctcccatcctagcgacgaagcggctcagtgctgcatgcatccggttagtttttggacttccttgagtcttgttggcgacttcatgttctcgattgccttgattgtctcatggttagcttagatgcctcatccggaaactaagaaaccgagtagcttttctgatggtactccgaacgtgcacttctccggatttagtttcagccgatgtcgtcggaggttgtcgaacgtttcccttaggtcatcgatcaatgtgtcgcttgtcttcgttttgatgaccacgttggcgacgtaagcttcgacatttggccgatttgatcgccaagagctccttggatcttgcgttggtatgtgttccctgcgcttatcaatccaaatggcatcttggtatagcagaatacaccgaagggcgtgatgaatgccgttttctcctcgtcctcttttgccatactgatttgataatagccggagtaagcgtcaaggaaacttaacagctcacagccggcggttgagtctagcagttggtctatttgagatagagggaaatgatccttggggcacgccttgttgagatcagtgaagtctatgcacattctccatttcccgttggccttgcgaaccatgactggattggcgagccactctgggtggagaacttctctgataaaaccagctttgagaagtttgccgagctcttctcgtatggcttgttttcgatcgggtgcgaatctccgcagtttttgcttaactggtttggcattggctcacaccataagtttgtgctcaatcacctccctgggactcccggcatgtcggacggttgccaagcgaacacgtctacattgtcgcggaggaaggtgacaagctcgagttcctatttgctggtcagcgtcgccccgatcttgacggtcttgtcagggttggtgctgatcagcgggacgatttggattgcgccgtcgggtcttggcgtcttgttgggcttgctcactttcgtaggtggctcaactgcggcgggtgggttgggagtttgctcgaccatgtcaaggctccgcttgttgcattgtaccgccagcttcgcgtttccttgaacagtgattgtcccttttggtcctggcatcttgagcaattgatacgcgtagtgggacgctgccataaacttcgcgagtgcggtccttcctaagatgggtttgtatgccgtatcaaattcagcgacatcaaaggtgacctgctctgttcggaagttatcggcctgtccaaacgtgacgggtagcgtgatcttgcccaatggcttgaagggttgatctgatggggtcaactcgcttcgtgggattcccatcgcgtccaatgtgccagcgaagagaagattgatggagctgtcgccgtcgatgagaacccgtgcgactttgatgttccgtatggtgggctcgaccacgatcggatatctgccgggtagggttgtagtttttgggtggtctgcctccgagaactctatcttgtgctgagaccaattcatcctggcagcaactccttgagatgtagagtgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaaccaaaaataaacagcagcggactagcgggcctacggctccatcttcacaggcgctcaactggggtataagccaggactccacctaagacatcttctccaaagcttctcttactgaagggggaagaaagatagagcaagaatgagtacaaccacagtactcagcaagtcacaccggagatgcatgattaatgcaagggggtacaaggggataataatatcggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccatttcacattttagttgttaagcaggttttaagaattaaaacactaacttgggtacattgcttggcttgcccataaccgagggcgcggctattcgaatagattatactctgatcagaggtgtacatctttacccacaagacacatcttcctcacgtgcaaccacgtgccacataacaccacggtatacagacggaagacgtgacatagtttccaacccatcctagccatagacaagagtaccgacccaatcccgcctacggccggaacctccgggacaggcaggcaggactgagcccctagcagcagggcaccaaccctgtgctatgacatctcgactaccgggccgcagctcctgtagccttcatttgccctggagaatgtccatcgacccccgacttcatccatctccaatccgtgtacttttgtttataaccagactgagccacaaactaagccttacccactagacatgtggaagtacggtagtgcttagcaacagaggctcgaagaccggtccttatatggccgaggtgctactatcaaaaccatgcaccccgagcccagcctaaaaccattttggggattttgaatagagggggcggtgtgaatccaattccacaataatccaacaattccgaagtgtccaggtgatgagattatcccaaagtctagagttgtaaaaccacctaatgttacctaattaaacagcgaagcatctacctaaaatcatgctagtggtaccatgagtagagtgtccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactgggattcaatatgttcaaggatgatgtgacttgccttgctcgctttcccaaacgccggcttcaacttccacgaagagcggatcttccgaagctgcagcgtctacacgaccaacggaaaagaaaaggcttttactctaataaactccaaataacaagcagaaacaaagcacaaaaatgggtt

SEQ ID NO: 4878 - DNA, 790 bp, Oryza sativa
caagaagggaaggggggggggaaaaagactttttagggtttttctttttataaaatcattttaactttgtttatttcttaataattatatttgtgctctgaaaattccactaaaatttgagggctccttttagaccaagaggaatttaacaaaaattctccgggccacatttgaatttttcttgtacgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtctgacttcttccgctccgtcttctataacaaacttgcctaacaaaacttctccactctggactgcttggctcgatctcctgttgcaggtggaatcttctcttcacccgacttgtccctggttgaacctttagctgacttcgactgggttgcggcacttgaagatggggcttcagttccagaacttctcataattcatatctttggagtcaacctcattgaagttaccaacttcatgtcatgcgtcgacaccagcttgtcattactaggataccatgcttgtcatcatgagattaccatgcttgtcatttacttttaacttgccaccaactgcctcatattagctttcctgctctccgggtgctaactacttctgctattcgatgcaagggtcgataactttgcctttgaattatgtttc

SEQ ID NO: 4879 - DNA, 470 bp, Oryza sativa
cgatctagatgtccctgcgaaggtatttttttggatgagattaatgtttaaatcagtagactttgagttaagaagttgattctccacaatgtggatgggcctcatccaaccatttgaagactttaggagaaaaaggctgacttccctgatgaaggaggaattctgcctcctggtggcctttggactggagttgcagtatcaactcttttctggatttccagcctgccagcatgccctgtaaaagtcagaagtcagatttgcaagcccctacagttgtgtgaaccagttctttaaaataaatctgtttctgtctctgtctctgtctgtctgtctgtctgtctgtctgtctatctgtctgtctatctgtccatattctgttggttctgtattctggaaaaccctgactgatacatggcacaatagtgggacaacaagagcatgtgcaggctccagcccaggtagggagaagg

SEQ ID NO: 4880 - DNA, 2520 bp, Oryza sativa
cgcattcaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggatgagtttttgtcagatgaaggtttccccgaggagtaggcttcgtccgtgccgtcgaggatgcctgtggagtggtgttcccgctgcagtttagtcaaggcttagctccagttatcttttgtttccgctgcatttttgtaagacttttatgatgtttgtaagacgtggatctgaatgtcaacattgtcgtttgtgtaccccggctggtcctggacggggattttaatgcacattctgcttggaattctattcgggaatttctgggcatgacaagttggtatcagagccgaccttgaccgtaggacaagccaaatggaaacctaagagccctctgaatccttttcattgcatatattctttgcaattggatttgttccgggaaaattgggatctgttcttgtggttcgagggaaaaatcttgtcgcttgtttaagtgggattttttcaaaacgagtcagtctagggttttagtaaaattattgggatttattcgtcagtcagttggggtttgatgggtgaaatgcattaggtcctagctctataacatgggttgcaaggtgtttatgcttcgtttgttattattaatatgtatctaattctcattactttgtcgttatatgagtctgtcttatttattcgctctcatgcaaaatgatctatgcataaaatttcgcttctattcgattctcttatttgagtcttttattgctttatttaaatttggatttgagcatgcattgatcctactcctttgtcttctctagatggccggtcacccacccaaccaccgcggagaaggcatgatcgatttcgtggcagagttagcacgtatgacactggtggtgggctaccccaacgcgccggagtacacgacgattccgccgctcagtggcgagcttcctcaccgtgtccacttggaggtccatggctacgtggggacttgcctcgctaacatggcggtcgaggcatctggaggcacagcagatcacgcctgtcaggaggcagcctacttgatgatggccagaatacgggagcgccacgactacatcttccacgacacggcgtaccgctaccacccccgtcgagcccatggtgatggcgtcagctccttccgtccgacagctggcgagaacgacaccacctttggtcacatgtgtgctgtgatgagtggattggacaggatgcactcggacctgcacaaggcgaccaaagccttgaacgatgggaagctcatgaggatcgtcgccctgaaggacgagatagcgcgcctgaagaaggagaacgctcagctaaagggtcttccagcgccaggaggagtccggatccgcaccacgccccgcaagacgacgactgcacctgtgcgtatccagcttgcgcccaggaacccacctccagcagcagctcccgcagcaccttcagttccgcccgcagttcctgcagctccagttccagctcccgcattcactctctccttcgctccagcatcagccgccagaggtccagccagtggtaccggaggttggttgtctgctactcccagtggcagcggcgagactgatctgtcaggctccaggagtcgctcagagggaccgggtgacgagcaggaggacgctttcgactccaccgaccgcaggagccgttccgagcattaggctcgtttttcccactagtttatcgatggtctagcttctggttgttagtttgcgtgtttaggctgcttgtttggggtcagttgacggttgatatcatgtgcctatgatatggctgtcttaataaggatgtttgcttgctcttttaagtgtttttaattcagatcagaacaattgcagttttaattcctttgtaataaagcttagttcttgagcatctgtttttcttcttttccccccgtctgcttttccctccagatggtctacaccaggactggcaaccgcacgacaggcgagggcagcaacggcgaagaacgcgtggatggtgtgcaccccaacagtgattctggcaatggtccgccaccacttcccgagaatccgacgcttgcccaagttatggcacatcagactcagatgatggcagccatgatgcagcagatgcagcagcagcaccagcagatgcaccaaaggatgatgcagcacgccgagcagcagcaccagcagtttggtccccctccccctcagtccaagttgccagagtttctacgcgtcaggccacccaccttctccagcaccaccaaccccatggaggcgaacgactggctccatgccatagagaagaagctgaatctcctgcagtgcaatgatcaggagaaggtcgctttcgccacacaccagcttcagggtcccgcgtcagcttggtgggacaaccacat

SEQ ID NO: 4881 - DNA, 25444 bp, Oryza sativa
cttttatttgagtttatttggattttatttgaattctaactgaattcaaatcatttcttcgcacgtaattttagagcccgagggagttgcggatccgagcaaggatcaagacccgcaggactacgagcaaggcaagtcatcactattctttgaacatgttgatcccaattgcgaaattattttgtttacaaataaaattgcatgcaatgatgaacatcccacttttgattatgccatgccttgattattgtttactcttaaatctttgtaaccatgattatgtatgagtccctagtcaattatgataattgcttagaaatgctattctagaatcatgcatattcatatttatcaaatgctatatgcttgggcaattacctttgggaaggtaattgagatgtggcatgtggagacatgagcgccacattgccatgatattgatgacatgatttgtgaaaggaaaataaagtgaaacaactgttttcgactggccgtggatggaggatttgggtggtgtccggaaaaggctagtgccgtccctggtcagttaaggaccgagccatgaagttaagcatgaaacgacccccgtacgaccgcacttctcgaatgggtatagacctagcggagtagatagctgtgcggaggcagtaaccatgcatagtagtttcttgatgtgtgaggcaggggctctacggtggggcagccattggtaggaccgcgaggcgggtgtctacagtggtgtcgccattggtaggactgccatgtgagaatctaaacataattataccttaatgcatgtgtgagtcttcctttcccgggtgcgccagaactcctctcactgctagaaatcgtattacgcctagagtgcatgaggatgtaaagttcatggagcgggtactgccaatgcgaggttatcgaaaagctttgccatgacgcgtctcatgtgttgggacgaggctcatgtgttgggcagtcgcggagtgcgggtaaagtgtacatccactacagtgtgagtaaaccaaatctattcgaatagctgtgctcgcggttattgagcaccgggacatgtattacacttggctagactctaaattcttaacttgtgtggggtggaatattgcatgatgattttatgctgatggagccacttcctgagaggagggaaggtggtcgtcctcagaaaaccatgacgactcaatggcgggaagctatccttgggatcacaatggatggtggacagaaccgtcgttgtttaatatgaacactggtactaaaatttgatcagtctatgctaggtcttaggcttgtgaaaagaattacaaaacttgctttgcacaaaaaaccatagccatcccttgaataccccctatcatgtgcattgttgttgtagtggcttgctgagtacggttggtactcacccttgcaatatacaaacttaatcagaggtcggaattatagcttagaaggatccatacgcttactccggaaagggtgatgaagacgatggcgctcagtaggtcttagttacggtcgttgcctgtggcaatggcgtgccattgccttaactccgctgcgttatatacttctgcttttggaatgtattccggaccattcggtcctatgttctaagactatgcctgtgggcctatgatgtaataatgcgcactagactctcgtgtatgtgcacttggtatttcagctatgaactcgtgtgtaccagactacttgatccagggaaatggtactatttacacgattgattcttgttataaaaacgggggtccacaggagtggtgtctagactacgggatatcattatttggagttatatgctgcggttgagaggtgggccgctgatggtgacagctcagtacgggtattcctccgcgcgtgtatatagtactaagttaatttcctagggaaggtattcctccatattcagccccggttgtatggtcatgacgggctgtcgtaaggaactcggcagtcaggggtggcttctcgaagtaccaggagggcatcggatagagggtattagctagtatatcagataactaggatgtatgtatactatgtatactagaattataggaatagattctttttctattttcttcccacttagcttagatattttagtatgagaatgagtagcttcctgcttgtgtgtcactctacccttgaattatcttaacccctgcttagagtatgattattacaaataacatataaattattagtctagttctctctaccatgatcttcctacgggattaaataaatacgatacccttggaatactctcgagtgaaatgctacaatggtatatccgtgcgcttgcggatgaactctgtaaccataatataccaagagtatttctgcgccattgctgggaattatatttctagtaatgtcgttaagaaataccaacaacatgctagttctccatgttgaaatgataaataattgatctgctttatatctttaatgtatgtgcacatagttaagtactctctcaagttttaagtgaaattagccaaccattatacgggaacctgagagaactgagttgcacattgcatgatctaagtctaggttgttgtgagatatgagatagtgaaatagagttactatattcttgttccacgtttgactaaaactccggatattttgtttctcagaaagataaactcttgaagttcctcatttgatatgaattcctaccagagccaaaaaaaatgttatacaatgttgaacccatatacattttggttacttgtatgtccattgaacaaattccgtgacttgtgtagatgctcttcatactttatgattaagatcatacacccacatatatgcacatgtgctaagtttctaaactggaagctagcatccatccattccatcatatatcacatgtgtcatccaccaaataaatactccatgatatttatacctctttttcaaaagtaacataaaagaggagagtgactaaaaagaaataaaagagagagagaaaaggaatttatactcatgcaaattatgtggcatgaactctctcaaaaatattcttgaaaaaaaaacgaaaaagagctagccaaaaagactccctctcaaaagctttcaaaaatggaggaagaggtatacaaaaggagtagtcatattcatttcattttcaccgtatattccacacactatgcacgatcttgagtatgatttgttatccgctttagtctagatttttgacttagtgataaatgtgattgcaagtatgccttattcttgatcactaacaaactacacatattcagctttagtgtaggaataaaaaaggtataattttggtgaggaataatatgtatacacattgagtgattgagagaatcatttaaagagcatggttttaatttgcaaaatcatttgaaaacttccagaataagagctaggcaaagaatgagataatggtactctatgatctgttctgtctcccaaccgctcaaggcaaagagaagcatgtgttctgtcacaccccgaagttttcctccctagccaaaatcgtaattttcaaatgaccccaagaaaatgcaggtgaaatcaggagaaaaccctaagaaagtaatgcaaataataatcggacttgacatgtggaatttttcttaagttctacatgtcaaaattcattaacaggatttttagtggaattttcagagctctagaaataattttaaccaattaaaattgggcaagcaatattttaattacagggaaaatcctttttctttttctttttctttttcctctctttttcctcctttttgtcaaatgggccgtcggcccatttccctctttccttccccctcctcctttctgggccggccgcaggccgaggcccagccaggccgcccgccgcctcctctctcggggtcgccgacaggtggggcccacctgtcggtcccgtctccctcctcccgcctctcccgctcgcgccgccgcacccgtaacggccgccgcgcccacgcctccgccttccccgggccacgtcggccacgtccgcgcgtgcgccgcgctctccgcgcccattcccctctctctcccgctcgcgcccgcgcccgagatggccgggattcgaaaaccgaatcccgcctctctctcctccccactcccccgcgtcggccggcgattcccgcctcttccggccacgtccggttccctctccccctatttaagcatcgccggcactccttctcactttttccccattgcgccgacctctcccgagctccccatcgctcccgcgccgtgcaaccacccaccgccgcttcttcccgcactccggccgccgctagccgccgctaggctcgccgccgtcttgcgccgtcgccgccgttagattcgcgcggccgaggtccacctcgtccacccctcctccgttgaggttcgccgccggagacccatccccgccgtgcgccggtgagtgacgccatggccgccgccttcggccggcgcccttgcgctctcgcgcccttccctctctctctaacccctctccttttgttcgttaggaggctccggagctcgttccgccgtcgccatcgtccttcgtcgcccgccgtcgtcgaccgttgtcggtgaggccctcctcctcgttttctctctcccgcaccgtttagccgccgcgtcgccgcctagctgcgtagccgccgctcctcctctagccgccgctctccgccgcccgcgctcgccgtcggccgtcgccttgcgccgctgctgcatgcgcgccgccgccgcgtgagcgctgcgccgccggcgccatggtcgccggttcggcttgcgccgtgcccgcgtgccccggccgcgagctcccaccgccgtccgatctacccttgggtagatcggggccgtcggtccggctgccacgtggcgccgccgcccctttctctctctcccgtgccgctgaccggtgggccccgcatgtcggcgccgcaccccccgtgctgacgtcagccctggaatttattgcgcaataaattgtttaaggtttttcttttatagtaataaacacagtgaatcttctaaaattcataactaattcatccgagctccgtttaatcccattcaagtctcagtaaatcaaggaaaatgtgtagaatccattaaaaatggttttgttctctgtttcagtagtcttatagcctgtttgcaatgtttgctttgtatgtcggtagattccgtttcctccgacgctccggtgtacttcgagatagtcgccgaggttcctccagcagcagagcaaggcaagtcatgcttgtcacttgaacatgttgatcctatattgcaaatgctctattgttttctttcaaacattgcattgttttataatcttactatgggttgtttacctattgttacagccatgctattttgataccatgctcctttgttagcttgggttataacatgattagagttaggactagggattgcttaaccatgcctagttcaactagttcacattggagaaaaccctattaatgtttagactgttggttctaatggtttgttggattagtgacaccgctttggtgttggttaattaaaataaatcatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgtttggctagagggggttatgcaaagggtcctgtcacggcctctttccgatatgtcgtggtggcatgtcggcgcacggaaacgtgttgtggggctgtgtcttgtgggtacagttgtacacctctgatcagagtaaaactattcgaatagccgtgcccgcggttatgggcggtcaaccagattcaccgtgattagtctcaccctagtgtaatctttgaatttggatagtttaggtggatggttgggcctgtcgcaacgtgggttagcgttggacagtggatagttgttattaattaattattacaactgcttttttttttcaacttctgtttataaatgctcactttatgcaaatgaaccacgctagctcttcattgttaattccctgcatcatacccctattccggtatgacttgctgagtacagggggtagtactcagtcttgctctatttttccccaatcccagaggatgggtttgtgtcagatgaaggtttccccgaggagtaggcttcgttccggccgtcgaggatgcctgtggagtggggttcccgctgcagttctagtcaaggcttagctcctgttgtttttcttttcttccgctgcatttttgtaagacttttatgatgtttgtaagacgtggatctgaatgtcaacattgtcgtttgtgtaccccggctggtcctggacggggattttaatgcacattctgcttggaattctattcgggaatttctgggcgtgacacagttgggccaggctagggttctgacgaacctccctgagcatcgttgatctccctctttggcttggatgtccaggatgcactctcattgacggttggagggtgtttccggcatttacaaccgtcataaccatcattgagaggctatataaaggggtcacctcactctctcccacacacactccaagaagaagatcaagctctctccaaagtttagattactgttctagttctagtggagtagaattagaatagttttcttagtcctcgagtcttcaggagatttcggatatggctctagtagctcttctctcttttgtaagacttatagaattaatgaaatattcttctttatttagcttcggtcttttacttaattcatattatctaagtaccaactttactttatacttgtctcgatgtaattgtgtagctagcttaccagagatatgtgttggcgtgggtttaatgttcacgcagatgattgctcaatgtctttctaggggatatagagcaatatttaataatgtaagcgtgatgcttggattattaagtatcattatttgaggttatatactgcggaacagtaaaggtgggccgctaatggtgacagctcagtatgggtattcctctatgttaggatagagtcctaagacactttcctggtatggacactcctctatatgcatttccggttgcatggctgtgacggattgtcgtaacaaactcgacaaacaggggtggtctcttgaaccaacaagggggcatagttagggggtaattgctacatgattgtatactagtgagtgtaaactaaagataattgtatattggaagtatatgaatgatttcttttcttattctttctctacttagcctagaatttatttagtgagagtaacctgattcttcctcgtgtcacctaccccttttgaattaattaaccccatacatagactttgatatatgcaagtaatatatgaaattattagcatagttctctcttatcatatttttccttgggattaaataaatacgataccttggaatacttctgggtggaaagctacattggaatatccgtgcgcttgcggactatatctgtaaccataatataccaagaatatttctgcaccattgctgggaattatatttctagtaatgtcgttaagaaatatcaagattgtggcgaaggcagagttatggttggcaattgtatattccatctagcacaaccacacgtcagcctctgggtaagtaacttgatcaaatggagcatttcgaagtaatgagttgacgactgtcatgtgctctgcaggtatgcgtacggaatcgatttgcactggagctacatcttgggggttcaacttcgccatcctccaatgatctctgcagtgtacggtcatgtgcacctcagtcttcgatctcctcgtcgattacgttcatgtcatgtggtgtgtttgatcctgttaacaacggaatttcacatccgattcaaagaagaagatacaagatctaagtggatttggtatgaaatcaaattggaattagagtcggactgcgcatcggctgagtatcgtatcggctgaaggcagagcagaggcttgacttagtgataaaccctgagctccactagagacactcaaccctgagtagatcaaccttatttctacaagcaaatcgaagaaacaaacaagaacaagataaaagcaatctgaattgcagaaaggaattgaatacaaatgataagttggggtttcgtaacgagcaaaccggcgatctaaccgatcacaggattatacagcaaagtagtgaggctaaactttaatctaaacaaaacccaagaaaccctaaaggggtacctagctatttaagtatgtgggaggatgacctaggggtccctagggtcatgctccacctggttggagcgcaccccacatgggccctacttgggctggggtcccaaatgaagttacaagcccataggcccattataggagactcaacaccttgtttttgtgatcgcggtcaaactagatcgaattcggagatgaggctggatcacttggaaagataactctgagagctttccatcaagtactcacgggctgaaaacggagctcgtatcttagatttggtggccgtttgaattcagcaatgtcgtaggtggccgaatcagattccatcactcggtgaacttgatcttgatgtgagtgacggttgtataaatagtagtcatagtcacatcatcctccccttcttcatagataaccgtcctcggattttccatgtggtgctcgctgcatagtgcatggtcttgcgcgtagaattgtctacaagaaaacaaaagcaacaatctttcggcatgtaatatcattagctctttagcaaatagtatcaatctccaatgaaacaattgtacctgattatgaggtaacacaacaaaaaatgtaggcactgcatatgtaaggccctttagtagctcatgttgcacccctttctcacatgtcaagtaatcacatggtacatttttaatggagtatggtagcagcattgagggatttggtcgctccccttcttcaaaaccatcctatttctttacatcaaaacaagaaaaacttgagataacatgataagcaataatatgtctctctagcttgcaatttttatccacaacaacatctgtaaactctatgcaccaaatatattcctctatcattatattaaccaaagatatgaaaattagcattagttggatagatatggcaaattagacttagcaaataatttctccttcaaattatcgagctcacaaaatccatgaaacaatacatagcccaaagtttttaaagaagatagcaattcacgttcctcaacttcattagcaatttgaacaacatgctcattcactataaatagcatgttcattcagtagttgtggcattaatataactgaagaattatcacacaactcttttttatcgcaaggaatagcaagtgtgtagctaatggtggacatgtgtagctcggcttgagaatactcaccttcatttatctcagcaccatttaatttaccttgcaaactttcttcaaacatcgcaggtgcttcatactcctccgctttcttctcaagaacattattctcttccttttgttgaatgttttgaactccctgcgaaacgttttgaactcacaggagacacaaaagattgctcctcccatgtttgcacaccatcattgcataaggatataggagattcagaaacaggagataaatcacattgttcatgcttccttgcatttgattatgatccgagtctaaatgctatgagcaagcatgaatatgtgtccaatatgattatgtgtcatattagcaagcataacctgaacttcagaattaataccattgataaacctacgcattgtgttttcattacattcttttaaagcactgtagatgatacaaactttaaattctcagatgtacaccttaacatttctatcatcttgtttcagattttctaatttctcaataatagtacatttgtaataagaacttacaaaactctttcccatcattgttttgcattcatcccaagttttaggtttattactcacataactccaccaaaataatgcagaagaggtcaacttattattagcagccttaatcatttgagcatcagaaaaatcttgtcaaattcattgtctattgctagcttccaatcaatataagcaacaaaatcatacttctcgtcgcataatgataacttagattcaactcatgcaaacttatagtcaggtacctcatatgcacttcatggagaagttgtcatatctcatctaaggtgaagaagtcgatgatctcttattcccttgcgcaatcctgcgatggttagtagcaaacaacaaacatacacaagaatatgcacgctcctatcaactacttggtcgtggtagctcagatatcacacactcaagcttttaaccaagctcttacaaaatcttaccaatgcaagcggaatggtgatgtacactgactcaactaagcaccccaatggaggttggatgtatcgatgcctttacaaacacctgtcgtatagctgcaaacaaatatgtggtctgatgtggagatctgggtaagcttaaatatgtagcaaaggaatagaaaatgctgaaatcagagagtgcaatgttcaataattgtgctggttctaggctagaacgtaatagagacacgatcctagacacaaactagcagtagaaaaaactcaagcacactatgatatatcaaattcagctaaaaaaacaacttattttctctcttctttttttctctctcttttttctttcttctctgtcttttcttttttttctcggtgcgtcttttttttttgttttttaagcacctttctgtcttctctctctttttttgcctttttcttttcaaaaaacgactcaagcacctcaatgcaaaattgcagggactcaaatgtaaatacaaaaatcactaggacttaaatgtaaaagtcccaaccgaaatcaaaattatacaaaaatggaatgctcttgtcccgtaggtttcgtttttgcaaacggatctccaatctgacacttgcaaaattttcaccaaggtgttgagctactcaaagtattggaggaaacaacagtagagggagagaaacggtggggaggtggtactggccacatgttaagtgcagatgtggtgcacaggataagagggaaactaattctagcagattcaatctattatttcttcccaaaacaaacctgactacttccaaaatctgatttggtaattcaccttcctcctctcgtgcacgacacaagcacggcaagaaacacagccaagttggcaaaccctagatgaaactcacactgctggagaaagcgtttttaaccccggttcataaccggactacgaatccggctatctttagtcccgggtgaaacaaccagagttaaagatccatctttagtcccgattggtgttaccaaccgggactaaaaatgaatgcatctttagactcaggactaaagatttgttttctttcttttattattttttgttgtatgcatattgatttcataccaaactcaacaacaaacatccacgttcacaaaaccattagaaaaacttccacaaatttatagatcgaatggacatacccagattaacatcacaaatttaccattcccatcacaaatttatagttctaaacatcacaaatcaataaaaactcacggatctaaacatcacaaatcgacaaaaaatcacaaaaaaaaaattccgagcggccactgccctcccgctccgccacctgcaccagagctggcaccgccgcccccctcgctggcaccggccacagccaccgatacggagcgagccgccactgtagccgccgggctagcgcaggccactggccaccgctgcccccaccttgctatactatgtgttgattgctagtcccgattggtgttaacaaccgggactaaaaatggtaagggggcggacgcttttttaaccgggactaaaaatgatatttattcccggttggtaacaccaatcgggactaaagatcataaaatggtgctggctttttaactggggttaaatatcatttttagtcctggtttttggtcaaaccaggactaatgtggtttttgggcaacccaacaaagatggtttctccagtagtgtcaataactccaaaacagattgacagaaacttctgaaaactagaaaaatggaaccctagcagaaagatgattccgttttcgtaggtctcgacgacaacaaagacacggcgactgcgatgacagtggtacaaaacgtgtacataactcaaaactctaaacgaactaggcgctaagaccatcaactcgatgcgacaatgcaacgcaaaactcaacaaagcaaaaactgaaagaacaatgcaacgggcacaaagaaggctaagtaatggatgcaaacttttattgtatggctattttctgcttatgggtagatcaaaaatcactgagcaacaaaatctcctataccagttgataaaacctgaggtccactcgtgacactcaaggctgttgatgacccaatctttcagtgagttgatgatgactacaatttgggagaaacgttgatgacccgactacaaccgtactagatgttgttgcattgtgccttagcaatcattactcctccccgtgggttgttgattttgccgatgcagatcaacattattcctgcaagcaaatcgaagaaacaagcaagaacaagataaaaacaatctgaattgcagatatgaatagaatacaaatgataagttggggttccgaaacgaggaaaccggcgatctaaccgatcacaggatcacacggcaaagtagcgagtctaaactttaatttaaacaaaatccaagaaaccctgaaggggtacctagctatgtaaggaggtgggaggatgaccaaggggtccctagggtcgtgctctacctagttggggcacaccccatatgggcggggtcccaaatgaagttacaagcccatacgcaacactttgtttttgtgattgcggccaaacaagatgtaatacggagataagactggttcccttggaaacagggcttccgagagctttccattaattacttacgggccaaaaatggagctcgatacagatttggcggccgtttgaattcagcaatgtcacaggtggccaaatcagattccagcacttggtcaacttgatcttgatgtgagcaacggtttgggcttggtttgagcataaattgtgataaacgttattgcaaattagagatagacctcgaataaggcaattgcatgtattaattaggatatttaagttggtttattttagatttgtgttggtatttcttacgaccatagataaatccgcaagcgcacggaataccgctatagcacatcaccttcgggtgacccaaaaaggatatcgaactcagggaatgtgtataatctacctaaggctaagacaatccaaggacaacaactgtaggtaggctaggctagagaggactttctatgttttttaattatctacgctaagcaaaggtaatttcctatctgttgcttcgggaaccgacccctacttgtctgctagcatggttccggctatagctctatgatgtatccgaacgtggaggattactaggacgggatttagagttgtcaccacctgccacctacctctgacaaatccgtgggatacacaacaaacaaatccgagccgtctaggtgaaagtaaatggcgggaagcgctaggattggttcgaccgaaccaaaaaaccgtcctcccggcctctcctttggctggtaggttgcttaatggccccccaacatcttgcacaatgttttggctcaattctaagtggttttggttgacatatggaccctccaatccatgtaaacgtgtcctgaatgagcagaggtccattttgtcgcatggcggatgtgttttctcctcaaaatacctgcatgcacatatttcaccaacactagtagaaatgatttgtaataaaccctatcactaagttggatactatgttttatttcattatatgcaggtattgacggtcaaatgttatgatttaaggaccgtcaacaatttggcaggagaacgccttgaggtcttgtttgtatcttatctttaggaaagtttgagtcgtgtccataacggactaaatttgtattcggggtatatatacagaccctgactattgtaatcagggagacaatccaatacaacttcgatgcatcgccaccctttttgttcttcttgtcggtgagttctctcgacaagaggtaacccgtctcgatggcttgtgctatcagcccatgaccatctgctgtcatatgtcttagttaatctagttttagtatctcaaattagccctattggctagctctcgttttagggttcttgccagtatcgactaaattgccttactagattgtattaactaaggcatctaccatcttaaaaagtgattaattccttgattgtttagaatttaggtttctttacttactttgagatacatcatccctagtcttgtctagaaacctagaaactaatgtggaattaattatagttagagatagtatcggagtttcagccgatcttacctaatatacatgctactttactagttttatgtatatttgtcacttatatagatagatcaccctatataaatatatcaagtctagatcagcattggctatgttatcaaacctggcagtagatcgttatttgatatatttctatagattgatttgtttatataagtttgtactagagtattagctagtacattatctttatctatctatcttgctctaaatactgttccattggctatttctataatatcgtctgacttgtacttgacaaacttattagatgatactacagccgatgaggcatatttagtgtttatacttattttatatatcaattcatagtcgactacatctgctgggatcactaatgatacgtcatcggcctgtcggctaactaactttgtttgttgttttggcaaaccccgagctccactagagacactcacccttgttgttggcacgatcttttggtgagttgatgataactatgatttggaagaacggtgacgatccgactacaactatacaagacgttgttatgttgcgccttagcgatcgattcacctcttcttgtgttgttgatcttgccaatgcaaatcaaccttattcctgcaagcaaatcgaagaaacaagaaaaaacaaaagaaaagccatcaaatccagataggaattaaatacaaatgataatttggggttccgaagacaagcagacggacagtctaaccgacatgcgcactgtaagcaagtagatatggctaaactgtaatctaaacaaaacccaagaaaccttgaaggggtacctagctatttaagaaggtgggaggactacgtaagggtccctagggtcgtgctccacttggttggggtgcaccacacacaagccccacttggctcggggtcccaaacaaagttacaagcccaaaggcccatgacaggtgccacagcacattgtctctccaattctggacagctgaggtggaatttggcgatatggccgaatccatcggaaagaggactccgagacttttcatcaactactcatgtacccaaaacggagctcgtatgcacaattgcacatctaacggcctttagaagtcagcaatgtagcatgtggctgtatcggattccaacacttgaagggacttgatcttggtgtcttcttgtttattcatgatatgagcaatggttgtatccataatagccatggtcacatcatgtttcgttgctggttgcaagatcaaaccagctggcatgcccttagcacactcgaagcaagccttggacctgcactggagttaagcagatctcctaggccaccgtgtttctcgtcaacagatccaaaaaattccaggttatccagaccatgaagaatggatggttcgcgggagtcgaacctgatgtgtatgatagtatgatcttgtcgttctaaagtgttgctgtccatgaatgcgttgcgagtctcatcttgtctggcatggatcgggcgacatgtgactcgcaccgttggttctataagcttcatgaatacttcgcaactggtgagggggtgattctgagttttgtgaatcggacaccacgccctgtaaggagaggcacgctgaatcatgcgttcttcgcaaccgtcgagttcaactttgtcttgaatgatcacccggcacccgatcaatggatagctagttgtcttgtggatacggcaccaggatcaatctttacttgaagacttcctaatcggtgcacatttcttggtggaatcgaggagcaagacggtttaggagtcttgcaatgggtaacgaagttggcgcaccgttgtcaggatgaaatgaagaaggtgttgtctgtgttgatgtatctgcttggtccatcattatagccacatcttcgctaggtaccaaaggggaggagatcgggatgggagcgaaaactgaaaagataatggatctgacttggactaatgtgtaggatggttggattggatctaccaagccaggttggtcatagaaaccctcgtcagagaatccggctcttgagtttatctcgttgaaactcattagcaccaagcccactacctagcgcgccactatcgagggtggacatctcgactacggtatttggatagtatgggcattgttggaaccaaggtgtacttgagactgtatcaagcagacaagagacaaagatttatactggttgaggccctcaagatgagtaatagccctagtctattttatatgaattatggatggaaatatcataaagagtagaatgaggagtaagaagatcggactaacccgccaactagatgatgacaagaacaacccgatgagatatattcggcgagtacggcgctggctccctcctgattgatcctccttatgatgatggccacaccatgtaattcaatgcccctccctgagcacggggggcttgtagatatagcatagatcatcttcttctcgaagtagatctcggagagataaaacaggaaacaggctcaagaatacattatcttccccagtagaactctaacaccttatatctggaaagataatttccttccttatccgtcgtatttccttattcataggatatcttcttgtatgtagtcgagtatatgttattaatgtattccataaatccgtgtataggatgtatgccctatccttacactgacagaaagtatgacaacccaatgtatctcctacatttataatcaactcctctatagtaaccattgccaattgacattcgtgattttttcggtaagagtttttcacgtaaaattcgtgtctccgttgtgcatctaattttataacaaatgggtatcagagtattggagatccgttccgacatccctcgctgcagtgtttatcatatccgtcgagttcatcgttccgctgtatgaccatatcaatctgtcagcaagattgcttccgaagcggagttgtgatatcaattccgagttgtcattgcgtcgagtccatgaggaaataagcacccggcgtcgtccacaccaatctgccaagactcaatggaagtacaacagcctgtgcatgtcacatcgtccaccagggcagcagccaacgtgcacacatccactgaagagcacggttcccaaggcgcacacgcccaggaaatcaagtccttgcattgttttggttttattcggtgaatccatgttcgcgttcaatccatgatgtgtggggcacggttgtcatacccagaaattcacgaacgagaatttcaagcagaatatgtattaaaacccctatacaggaccagccagggtacataaatgacaaagttgatacacaaatccacgtcttacaaaaatataaaaaagtcctacatatgcaacgaaattaaataatcgagctaactagccaatagagctctcggataagcgtagcatctccaaatccacaagcatcctcgatggcagcaacaaccctactcctccgaataatactctgcttctaagggtcgggggaaaaataaagcaagaatgagtactacccactgtacttaacaagtcataccaaaagaagaggcatgatgcatgataatttcaaaggaagctatgcgttatttgcataaagcagcatttacaaatcacaatttgaatatagtaaaatagcagttagaaattaaactatattaaatatcactgcccaacgctaaaccacattgaaataggcccaacaaaaccacctgaactaaaccagttcattaaggcaaactactatggtgagactaatcatggtgaatccagttgatcacccataatcacaggcacaactattcgaatagttttactctgatcagaggtgtacaactgtacccacaagatacaatctcacaacacattaccgagcaccggcataccacctcgacataccggacagagattgtgacaggacccttcacataaccctccctaaccaatcaagccacacctcaggtttcgcccccacccctaaactggcaaagggcagcgacgctagtgggagctagcaacggccggagattgaagtgtggcggcggcggcaagggcaatggcgcggcggcgatgtagggcctgggagtggtggaacaaatagggaaaaggatggaggggggttttgggatgctttttaaggcgaatgtgggctcgaaggtgtccggtggtcggcaaatttggcggcggcacggttgggaagggagagagaggtggcggtggatagggttggatatcccgccgattaggaggggaaaagacgcggcgattgcgggctagttgggaggaggtggacagaggcacaggcgagcgagggcgaaaccgggagcgacacggctcgcggcggaatcggcggcggccggaggttggagacaggtcggacaggtgggccccaactatcggtgtccgaacgacggggctgttgatggtcgttatagaccaatttcgaccgtcaatataactaaaataaaggaggactagcgcttgcaatgaatatttgttttaggataatctatttccacttgtacttggattcttgtcggtgatatgggtccgagggtacccaacctgtgaggaaggccctacccccgatagccacgtggttgttggtaattcttacggtcacagataaaatccgaaagcacacggatatatcgatgtagcacttcccctacggattatttcaaagggtatcgaatccaagggaacgtgtgtggtcagatcttcctccagttcatccaagggtaccaagaaaatgataggctaggatagagaagatttactagtgagaaatagtgtctagggaaagcttaagtttaatcctaacgcaatactttaggcactggcaacccgctgttcccagatgtcactctactacatacccggatagggagggcttaagtgatctcgaaggctgtcaccacctctacacctacctcaaacgtactatgggatacgcagcaattactggataacaattacctaaacaccacgtctaagcaattaatatctactttagtgtttataactcaccaaagcaatcactatattttagttgattatagtgaacaataatcccgtatgctatttaggaactaaccaagagatgattctcacaagataaatctaaattacttaggaagataattctattgaaatcaaagtaataaaccgaataaaagaaatgagagaagattaccgacaactccggaattcttccgacttcttctactctaatctcttcctattctagtatacaatatagtacaataaagcctcttataattcaggtcaagcttggaagtgtgtgtgagggtgaaggagtgaagctccttttatagggcagttatgacaattgtgagaagaggaaatgttcgaactgccctgcaaccgccatcagggagtgatctggagcgtccatgccaaaccccaggatcaacggtgatcaccaggatttggccgaacctgtgctgggccctcctggcctaggcttcggcctgtggactccctctgctttgctttatccatttctgtaaattttgggctgattctttggtattttgatgaagttcacaactcatcctagtatggatacatgtttctccctcactttagtctgattttcctcccaacttctgggtttaacacctgcatcaaataaacaccaacacttgtggaatatgtgagatttaacatctatctctatgttggatgttttattatttggactttatacagaggttagcaatatagaattggcatttaatgaccgccaacagtggcctttcctctagggggttcggcccgaggcagggcggcggccgttccccacgtgccccagggttgggtcaccccgacccccaccacgtggcggcaaatgtgccgcgccagacaggcgctcctagcacccacctaaccgcatttaaggcggtctgagcgagcgctccacacatcaggctggtatgtgaccggtccatgacaggtctgtgaccgatgattgaagtggccgaggtagtgtgcctgcgccctggctgcatgtcaggcggcctgctgcctgacaccccccgtctcatcacaattgtgagaggcagctcagcctatcacgtctgccgaagacggtttgcctaactgtttatggcagggttcccatcttctagtgcaaatgaggaccgaaaagtcctcactctttaaatgtcgaatgacgactacgtctcctgcgtcaggcaggaggatttgaaaatcgccatcattatcgtgcacgtgcaaggcacgttttgacagtatatattaacaaacgaagaagaatctatgtaattgtttttatgcaatgcactccatataaattcttttagtaattaagacaatttcatataaactatactaacctgacaatttggatggttctctataaaaacagaataaaagcaaaaatattttatggatcaagcacaatttatacattgcactcctaaggtcaactcaatcggagtaaaaaattgattatcacaaacaagaaaagtacactaaaaaacaattacaagaaaagcttgcacttctaatgtcagtagcaggacagaggagagggagatcaattatgccatcaactttggtcctacaaaagaaagcaaggacaggagtttaacatatccgtgaggttacacaagaaaacggtagctgaggaggaaaacaatgcattttgtttaccttcaaataactattgatcaactccatctactacaccaaaccaaccgtcacaagctataatatagcattgtctccacctgggagatatattatacagatgagaaatatgtgaggttatcttaatggcatgcaacttgccacatctaataaatcaaatactaatggagggtaactattcagttataaaaccaggttttgaaaatttgcacaaagagatctatgggtaagggcgatccctctgtacttttttttttaaagataatggatagaaatccaacctttatatcaagggagccagaaaaccgatagatcatatagaatgctataaccttagatatgcttcactgataacttaagttcatgtttcaatctttagttctaactttataggtcacatatacactggagaaggagcaagacaagccaaaaagtaagacagcgcagaatgaagtgaactattaccagcatgcatggagtaggcttattcttatcacatagtaattagttatcgagttagtgtagctttattattcctgaagtgtgtttgtcggagatagtaaatatacaacacggacaagggtccgaggaaaactaactataatttacctttgaaggaagatgtggcattgctgcacggctacacctgaagccaatatgttggtatggctactgaagccatcctacaaataaattaatcataaaaatgattaaagtatcttttcaagatctgcaagttcacaagggaaaagatgggaaaaaagagaaaacatgtcatcatcacaagtatgtaccatgcagaaaacagatgcagagcactattttgggctgtgcaatgaaccctttttagaaattactcatcattggatatggtgctaatcctggatcagggaatccactattgtacacagtagatgagaaattagaggggcatgacggctgtttccacattctttcactgcgccctgacatttccatcgttaatcagtcaagcatccataccaaggcatcatcagctcacggactcaccaagtactacctgacaaccaaattatattcagtttagggttcaagtaacacattacattcctttccaatcagaaaggataacaagttagtctatctgtactccaaacatgtaattgtgactaaagaggataacatgaaaaaaaatacctctggcatgtaaggaaaaaaaatgagcagccaaccgaaagggaattgtatttgttggtggataaccaacaaagaagtaatttacaaaagttttctagaaacaccctatcagcacactgcagattttattccaatgaaaaaacagccaacgtttgagaggcaagccacgatttcagatgttgggatcgactactttaattagcatcaagcattggtctttctaaaaaatagaatggatcaatagtacttatatcaattgattaagaaatgtcaaattttgtttccataaagtggtaaaagtgcttgcaatattgacagggattcattttctagtatagatatgtaccttagcataaaaaaagaccaacaattcattgaaagaggcagctgcgtcttcgtccaccggggcaacaatgatttgtgatcctgtaattccaaatagattgcaaaatgaattgattgggcataagaaccaagcttggagacgatggtgagtagagatgtcattgcctcttctgctggtgacgcccgcgatggtggtgggtaaaacgtgggttcgtggttgtagctgcctatgcaatctcgtcgtcggagatcgcgaagcagtgacgctggcagccgtctggcagatacttcggcggcggtgaagacgtacgatcccggtccacatctggccatggcggctggcgacaacgacaccaccagaggtaggctcttctcgggatgcagcgatgggggcagcgacgcgagagtcgaacggtgaaggcggcgtagcagcgaccaggaagcaacagagtggatgacgccatgtgacctcgccttcgagcggctggaagtcggtacggtggaagatcgaaacactttaggaatactgtcaaaaagacaataatttacaaatccgcggcggctggggacgaccactccgtcggcggcggcgacggcggatggggacgacgtcgactccgggcgtggccgatggggaagaccacggcagcggtggagtgcgcggtggcggtggtggtggcggcggaagggaccgaccttggctccggccacggcggatggcgaagaagtaggatccggcggctgttggaaaagaagtcagcgtgggcggcggaaggggacaacctcggctccagcgagagtagcgctggagcaaggctgcggcctgcggcgccagtacacgcggagaggagcgaggaggaggataggattgcgcgtggagaggcgtaatcttcgcacgcggggaggcgttgtcttcgtgtggtaaaatcgtgcgggggagattggtgaaccatacggattatacctgatttgcggatggacggttgggatttaacaggtgatttcaccgggtccaactcctcctttttatattagtatatagatacatgttaggataataatattccactagtacttggttcactaaccttttgcagagaataaccataagtggaggagaattgacatcaaatcaaatgataaatcaatcgaacgatgtcgaggaccagacttatgtatgaataggccaagaactcagaattgacatgataaattgggccaaaattcacaagtatataaagtaaagcaatggaggaggccaccagccgaaacttgggctagttgggccagcccctagttcgaccgaacctcccgcagcgccgatagatgcagggttttgatggaccgctgggattgatccccaatgacggttggatggtattaccgaccattccaaccatcataaccatcattacctacctataaaaggagttcactctcttcagttcaatacacacctcaagcaagagctctctcatattctctcaagtttgtttagtattcttatgctagtggaacaggaatagagtagaaatcggagtccggaagccttcggaagagttcgggtatggctctagtagctcttctcttctcttttgtaagctttgtactttatttagaatattcttctttatacatttatggtattaaaatactttctgagtatatgaatgccaactttacattatgtttatgttatctgggagatgctttggtgcgggtataatgtttgcatatgcaattactctatgtcatgacgatgatattagagtagtatctggtagcttaggcgttgtaacaccctaaaaattcgactgacaaattcgaaaccctaaaaatacggaccttcaaaaactttttaaataaattacatcatgccgattttattcgcctattttatttggatttgatttcggagttcattgatcgtgagtaaagaataatcaattaggaataaaccctaaaaataaattggcaaaataaataattgaaatataatttaaaataaagattaggcgaggatagaaataaatagaatattatcgtgaccatattggtaataattaaatttaagtgcgatggaataagaattagccctaattaaaaattcaaataaattatataaaaataaaatatgggtaatattaatctatggtgaatcattggttagaataacacaaataatgagtaaacttcatttatgcaaaaattaagatttatagaatagaatttagataggaaataggctacaatagggttaattgggatctggcactattcattgcgcgctaggtgttcgtgtaacgaccgagaataccccaacgggcgttcctgacgtgcgtgcattaatccctgtcccaggaggcaaggtacaccaaaagttgagacaattcagagttaacaagcgcgagcgtaaat

SEQ ID NO: 4882 - DNA, 9299 bp, Oryza sativa
cgttgcccaaggagccgggcagctccaactggtaagcgacttctccgcgccgagcaccgatacggaaaggacccacataccgaggtgcgagcttcccttttgtctgaaacctgtgtacacctcgcaatggcgtgacccgaaggtacacaaaatcatccactgcgaattccaggtcacggcgacggttatctgcataacttttctgccgggactgtgccacctttagattatcccgaatgattctgactttagcttcagcttctctcaggatatcagtcccgaacacttggctttctccaacttggtcccacaagagcggtgtccggcatttgcgcccatacaacgcttcataaggtgccatttgtatgctggcttgataactgttgttgtaggagaactcggcataggggagactcttatcccaggtcttcccgaaatctaggacacatgcgcgaagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatacgattctcttgggaacgccatggagactcacgatcctagcgaagtagagctccgctagtttgttccctccataggtggtcttcacaggaataaatcgagctaccttggttaatcgatccacaactacccatatagaatcatatccgccttgggtttttggaagtccggtgatgaaatccatcccaatttcatcccatttccattctggtacttggagaggttggagaagtccggccggtcgctggtgctctgccttgacacgctggcacacatcacacagggccacgaactctgcaatctcccgcttcatgctaacccaccagtatttctccttcaagtctaggtacatctttgtactgcccgggtgaatggaataaggactttcgtgagcttcctgtagtatcagctgtttaagttctctgtcatctggaacgcatacccgatttccgttccatagggttccgtgttcgtcctctgtgaaaccagcggctttaccctgtttcatattcttgaggagtccatgcatgtccggatcattcttctgagcctcgcggatttgatcgagcaaggtaggcttggcttccaacgcagccaagactccatgaccaactatgcttaggttcagggcttccatctgttgactaagttcgggtggaatgccacggacgttaagagtgttgcaatggctctttcgacttagagcgtcggcaaccacgttggccttaccaggatgatagtgaattcccacatcatagtccttgatgagttctaaccatctcctttgccgaagattcagatccgactgggtgaaaatgtatttcaaactcttatggtcggtatatatttcacagcgattcccaatgagatagtgcctccagatttttagagcatgaaccaccgcggctaactccaaatcatgggtagggtagttgccttcatgaggtcgtagctgacgtgaggcataggctaccacatgaccgtcctgcatgagcacgcaccccaatccttggcgcgaagcgtcacaatacaccatgaagtccttgcgagtatccggcaagattaacactggcgaggaaaccagcttttccttgagagtttgaaacgccttctcgcattgcgggctccacacaaatttctcttctttcttcaacaactgtgtcatgggtcgagcgattttggagaagttctcgatgaatctccgatagtaccctgccaaacctaagaaactgcgaatttgagtgactgtcttgggttgcttccaatcggtgacggcgatcactgtttcgggatccacagcaactcctttagcagatatcacgtgccctaagaatttgacttcggacaaccagaactcacacttgctaagtttggcatacaattgatgttcccgcagctttcccaataccagacggagatggtgctgatggtcttcctctgattgtgagtatatcagaatgtcatcaatgaaaaccacaacaaacttatccaagtattccatgaacactttgttcatcaagttcatgaagaaggcaggtgcattggtcaaaccgaacgacatcaccgtgaattcatacagcccgtatcgcgtggtgaatgcggtcttcggaatatcttcttcacgaatacgtaattggtgatatccggaacgaagatcaatcttggagaatacagtggcacctttaagctgatcgaacagatcatctatccggggaagagggtacttgtttttgatggtgacttcattgagagctctgtagtcgacgcacatcctcttcgtcttgtctttcttctctacaaaaatcacaggagcatcccatggggaagtactcggacgtatataccccttttctttcaactcttccaactgtttcttgacttcggccagttcatttgctgccatacggtagggtcgcttgtacagaggagtggttcctggagcaagatctatccggaactcaatctctcgcttgggcggcataccaggtagttcttccggaaacacgtctccgaactctctgacgatgggaatctctgacagttctatctgatgaagttctgaacttctgacagaggttgggggtgcaaagaaaacaaccggttgttccggccctcggtacagagtgaccgtgcgtctcgcgcaatccactactccttggaattgagccaaccaattcatcccaaggatcacatccaagttcttggtgtctagcagaatcagatccgagggaaaaggaatcccctgaatttctatagggacggtagggctataatactttgctgtcataacccctccaggggtggtgatgagcagagggttcctaagcctttctacccccaactgatttctccccacaaatggcacagatataaacgagtgggaagctccagagtcgaacaaaattgtagcagggatggaatgaacgaggaacgtaccaacgatgacgtccggagttgtcagcacgtcctcggccgtcacgtgattcacacgaccccgaatgacatccctcccgccgttgttggagcggggaggcgcttggccttgctgacgccttggctttgggcatttatccgcaaagtgcccgggctcgaagcagttgaagcatagacgctgctgaccttgagcgtccctgcggccttggccaggctgcacagttggcgtaggaggacggggcgcacgagtcccttgctgattctgctgctgctgcggctgtgggacgcgcaccacgaattgaggtcggggcgcggagcgaggttgctgctgctgttgttgctgctgcgaggaggatccccctggatagggattggtgtagcggaccctttggttagcaccctgttgattgcggaaattcgccaagcgacgcttgtgcgactccagctccttgtgcttagcttccaagcggatgctcttgtccaccagtcgttgaaaatccggataatccccagagactagacggacggacagctcggggtccattcctgccaagaacttttcttgcttctcctcatcttcccgcacatcctccggagcgtaacgggccagattgttgaactcatgcaaatactccatcacggagcggttgccttgcttcaactctcggaattcccttttcttaagggccacgactccggcgggcacatgggttctccggaaagcggcggtgaagcgagcccaagtaataggctgtccctctggctgcgtagcctggaagtggtcccaccatagagatgcgggtccttgcagctggtgggcggcgaagatgactttctcctcatcgctgcactgcacagtgcctaactttttccccacggcatgcaaccaatccaaagcatccacggggttgttggagctagagaaggtaggtgggcggatgcggaggaattcggcgagtttagagtgttgtgggggtggtggtggagcattttgttgtggcgggttttggaggtggtggaggaaagcggtcatcatgttggcttgctgggcgaggatttgggtgagaatggcgttggtgtctggtggtggtggtggaggaggaggaggaggtggaggtgggttgccctggtggttgtggttgctgcattcgggttggttgccatcaccggtgttagcatttctcctggtcgtcaccatctgaaaaccccacacagaaccagcaaacagagagagctaacaattaaaactaaccacccacgactaccataattcttgaatttattactgcgattaaattggttcattaaagttcaagttgcttaagcaaataaaataagacaggctccgacatagttatgccacacaccggcataaccatgccccacacaactcaaaaagacaaacgagaaagaacatacgcgcaagcctactaactgctcgtctactgctgcgacgggccaggacggaaggtgagcaacagcgcaccctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcggcagatctctccctgggcgatcttgagctgatgcagctgcgcctccaccgcgtcgaggtccttcttgagctgcaggttctcctgacgcagctccaggatcttcatgttgttctcgaccatcccacggcgcaccatctgatggaagtcgatacgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggaatcgccacccgcggtgactgtcagcgaagtccgctcagaagagccagcgaggatcactgcagtgacctcccaaccagcgcggggctccgcatcgtcaccctcctgctccgggagcggcctggcctggtagtccactccgtgtggataccccagggccacgcacatgccccgcaactccaagacgaagccagtcatgtccaaaccacgacgggtgacgctgccggccatctacaaacaaaaacaaaaagaaaagcaacattttcaaaggtcagattttggcgataaatgaagcagcaagacagagagagactagacagttttcacaaataacaaaggatttttatttttgaaaatattgctaaggcttgggatctacggctcgtcctagggtcaaaggtggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcaacggaggcccagcacacacaaagacaaacgggaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaatggaattataacataaagggttagggttgcagtaaacagcatttaaagacatttagttactcaaagctattttgtaaacacgatcttagaactatacaatattattaatcaaggccgtgaacccacacgaacctgccttaacccaaggcctatgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcctgcctacggccggaacacccgggacaggcaggcagaactgagcccctagcagcaggacaccggccctgtgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctactatcaaaaccctgcaccccgagcccagcctaaaaccatttttggggattttgaatagagggggcggggtgaagccaattccacaatactccaataattccacagtgtccaggtgatatgagaatttcccaagtctaaagttgtaaaaccacctaatgttacctaattaaattgcgaagcatctacctaaaatcatactagtggaaccatgaatagagtacccactagttgaggttttgtttgctctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaccgacggcttcgacttccacgaagagcggatcttccgaagctgcagcgtctacacgaccaacggaaaagaaaaggcttttactctaataaactccacatacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaaccgggtttattgcgtcagccgagggggagggcgcgcggaccaggtccacgggagtggggcccacgcgtcagcctctcggtccacggtggaccgggagcacgcggctggcggcggccggcgccgtgggtcccacgcgtcagccgcacccgcgggcgcgggcggctgacggccgggccccacctggcagccgcggggcgcgcccgaaggcggcctcgccggcacggccgacgggaggcggcgcactcacgccccgatggtcgccgccggcgaccaacggcgtggcggagtggcacccgagagagaggagggaagggggaagcgaacggagcggtccacggctcaccccgggacgacgacgacggcggaaacgacgaccggagcggaggaaagcggcggcgcggttcgggacggcgatggcgacggtgctccggcggtcagcgagcgaagcggaggggcggacgaggtcgacgacgacgcggcgaaaccgatggaggtgacgccgagacgggaggaagtccggagcgacgacggcggcgaaccggaactcggcggcgacggcggagagaagatgcgacggcgcgagcacgattccgacggggagagcgagcggcgaacggcggaaacggaggagagaggcacggggaacgtttatatagcgccgggagagagagagagcggccggagagagaggaatcggccgcggagatcgcggctccatcaatagcgccggcgaactttacgggaataatatcggacgaatccgagagagagagagaggggaaagtgggggaaacgggagagggaatcgcggggaataattccccccactttaatgcgcgcggggacggcgggatgcggcggattcggcggcggcggcggcgctagggcacggacgggcggcgggcgcggcgcgaggaaggcgatgacaggtgggccccacccgtcagcgagggtggcgggcgggcccgcctgtcagcggcgcgcgcgcggggaggggccgatgggccgtgggggagaggagagagagggagggagagttgggccgagccggcccaagaagggaagggggaaaagaagacttttagggatttttctttttataaaccttttcaactttgtttatttcttttcaattattatttgtgctctgaaaattccactaaaatttatttacgcattttaggcttttaggaaatatacaaaaatcctccaagccttatttgacttttaaatttgcacattttaattgttggaggctttcacatgaattttaattattctttgcacaatttcgaggatgaattttagagtcgatttgggacgtgacaaacctaccccccttaaacggaatctcgaccccgagatttggaagaactggcgaagagatctggatgggctgccttcagctcgtcttcacgctcccaggtagcttcttcttcggcgtggttgctccactggaccttgcaaaaacggattacccggttcctggtcctgcgctccatggtatccaggattttcactggcctctccacgtaggtcaaatcttcgcgaacttcaatttgctctgagtcggcctgctcggatggcactcgaaggcatttcttgagttgcgacacatgaaacacatcatgcacgttgcccaaggaggcgggcagctccaactggtaagcgacttctccgcgccgagcaacgatacggaaaggacccacataccgaggtgcgagcttcccttttgtctgaaacctgtgtacacctcgcaatggcgtgacccgaaggtacacaaaatcatccactgcgaattccaggtcacggcgacggttatctgcataacttttctgccgggactgtgccacctttagattatcccgaatgattctgactttagcttcagcttctctcaggatatcagtcccgaacacttggctttctccaacttggtcccacaagagcggtgtccggcatttgcgcccatacaacgcttcataaggtgccatttgtatgctggctt

SEQ ID NO: 4883 - DNA, 1436 bp, Oryza sativa
ttctttccgggtgcacacgagtgagcacaaagtgtgcagaaaagatatgtgttggtctgtgagggcagtttatgacctatgaaagctatcagatgtaagcgggcccggcctgggggaaggcgggacgttacaaaatggtatcagagccaactctcgcggtttcacgggcgcgtgtgtcgcagttgcgcaggcatggtgcgcatggctggtgtagaccgggagtggttacacagcatggcacatgcgctggcactggacatatggacgtggccaagagaggacgttcctggcctagggttgatcgacggggcgtcgatctctcttaagggggtgagggtgtaacatcccggcctagggcttaataggattaatagaatactcatatcaacaagttgcaacttcttttccggaagccaatctcaaaagaactccagggttaagcgtgcttggcctagagcaatttgggatgggtgaccgaccgggaaattctttccgggtgcacacgagtgaggacaaagtgtgcagaaaagatatgtgttggtctgtgagggcagtctatgacctatgaaagctatcagatgtaagcgggcccggcctggtgggaaggcgggacgttacaactgaaaggagctaaagtgttttctaagatagacctgcgatcaggctaccaccagttgagaattcgggaagaggaaattccaaattctttccgggtgcacacgagtgaggacaaagtgtgcagaaaagatatgtgttggtctgtgagggcagtctatgacctatgaaagctatcagatgtaagcgggcccggcctggttggaaggcgggacgttacaactgaaaggagctaaagtgttttctaagatagacctgcgatcaggctaccaccagttgagaattcgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtgttcatcgacgacattcttatctattcaaagtccgaagaagaacatgaacaacatctccgtctggtactcgagaagttgagggagcaccagctatacgccaagttcagcaagtgtgacttctggttgacggaagtcaaatttctgggccatgtcattacagctcagggtgtggcagtcgacccatcgaacgtggagtcagttaccaaatggaccccaccgaagaccgtgtcgcagattcgaagttttcttggacttgcaggttattaccgtcgattcatcgaaaatttctccagaatcgcccgacccatgactcagttgcttaagaaggatgagaagtttaaatggacagccgagtgcgataagagcttcgaggagctcaagaa

SEQ ID NO: 4884 - DNA, 30571 bp, Oryza sativa
  unsure (1)..(30571): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatccaggccaggagagatccgctcagactacacggacccgaggaccccggagtccatctaggatctacttcgctcaacaccttaatatgtggattttgtacgccactatgcttctataagtggagcttgcatgttgtatgagggcgaaagcgtatccaggccctagaacagtctgggtcactgggcacttcttaccgtacttctttgagatatatgaatgctaaagtacctaggacgaggtctaggagccaatcaacctatttgctttatccctagttgctttatcctaagtaccccacctattttaaggatggtttaagcatgccatttatctcaattgtgagttaataactaatttactggggaaatggggtaccctagttcccatttcaccaacaaacaccattcgaggaatgggagaaaaagaagttaaatctctcatacttgcgcaaatggggatgtttggctaaggtcaatgttcctatagtaaaaaagcgcaaacttggaccaaagcctgtagattgtgtgttccttaattatgttattcatagtatgtgatatatattcttaatagtaaattctagagtacctgacatgcgtgttggcacaataactgactccagagatgctatattttttgaatgaattttctatgaacgatgcacctagcacttctagttaagtacctattttatcccccgagtcatttgtgccgatagaatacaatgattaaacacctggggaaaatcctaaggaggataatattgtcgctacttgacaaaggactgcaaagtcttttggtgataactacattgtatatattgtggatgacactgcaaaaaccatagataaggcatattcatctcctgacgccgactattggaaggaagcggtacgtactgagatggactctattttgtctaatggtacttgggaaatcgtcgagcgtccatatgggtgcaagcctgtacgatgcaaaagggtcttcaagaaaaagtttaggcctgatggtataattgaaaagtacaaggcaagacttgtggccaagggttatacttaaaaggaaggcgagtaatttttgtacacttactcaccagttactagcttgaccacgattcgagtattacttgctctggcagcctctcatagtcttcttgtccaccagaaggacgttaagacagctttccttcatcaagagttggaggagtagatctatatggatcaaccagacgtttatgtattagaagatcaagagggaatggtgtgcaagctattgaagtccttgtatggccttaaacaagcacctaagtagtgacatgagaagtttgacaaaacaatgacacttgttgacgttgttatgaacgagactgacaaatgtgtatactattgctatggtggtgggggcgagagtgatcttctgtttatatgtcgatgacatattaatatttgggaccaacctcaatgtgattgaggaggtcaaggacttactttccaaaaactttgagataaaggacttcagtggttgatgttattgttaactttaagctaccaagaggagatgatggtgggattacacttgcgcaatatcactatgtggacaaggtattgtgtcactttggttatagcgactgcaagccagcttctactctttatgatcccagtgtgctattaaggaaataccttagaatagcaagggatcaactgagacactcctagatcattggttaattgatgtatttagctagtgaaacaaggcgtgacatctcatttgctgtgagcaagttgagccggtttgtttcaaatccaggagatgatcactggcaagctttggaaagattaatgcgctatctaaaaggcacaataagcagaccatttcaacgagttcaacaatagaagctgaactcacagcattagacactgtcacggttgaggtcgagtggcttcgtgagctcctaatggatttgccgatggttgaaaaaccagtaccagctatcctgatgatctgtgataatcaaacattgaatattaagatgaacaattcaaatgacaacatgaagtcatccaggcatgtaaagagaagactgaaatctgtcagaaagcagaaaaactccggagtgatagcattggactatgtccagactgctaaaaatctagcagatcaatttactaaaggactatcacgtaatgtgatagataatgcatcgagggagggcttgagacccacttgaattacaaaacagtggtaacttgtcctatgtgatcggagatcgtgtgaatcaggacggcgaaacaaactattgaatgactaggaggagagtctctaaaataggtccatctctttgatgtacttcactcattttctataaggcaggatggtttataacttaatgtgatatgtatggctttcttaagcagagatgttgtcctacagaacatcttataaggaacacgcctatatgagtttgattactagtaacactctatgagatttgggtgatctctaaatactcataaaaaggtatggagtatgaagtataccctccaaacagaggggatgcaaacgacagcctagtttgagctaaggaattgagtacaaactaattgcacaagactgacaattcaaggtttagtccatttttcagttgtagccaagagttgcctcttttcaaggtggaagttcaacttaacaatctcaagcgaaacactgatataacaaacagattcagaacagagaacattttttttgtgctcttaaatttggtggagattgttggaataaatgggctagcccaatttattcctaataaattccattggcccataattaacgttaagagattaatacaatcatggatattgatgtggagagatcacaacctaaataggtagctattagagagcacatgttggccggttgaggtggtggtgggactgccacacgggggctggggcccggggctggggggttgtgggcctgggctggggcagcgaggtgaggctaggcgaggcacttgctctctctctctcgttttgcaacggatgggaaatgaatgggtttgagtcaaagcaattcaacgccattgaatcaacatcattaccattgtaacattcgagagaatcaatcccgatttgattatcagattgattctgttgattactccggtaacggacgaagatattccactccctctcgcgcactacataagaccaccaccgggacaaacagataggcatgtgtgctctctctattcatcctcactctcgcacatctcattctacttgggaaactctttgtttttctattcctactattctgcaacgtcgtctcctttgcaacggctgtttactacgtctacttcctctacatcacgatgtcttccaccgacatcagtgcaactggagtaggagggaacgacggcacacctggaggaggatggaacgacagcacaggagagaacgtcaatatcaatggaggcaataccagtgcctcattatcaactggagcgttctctgggtatttcacttctctcaacttggtgttaaacatattgctaaatgcttttgttccttttagcatattcttgtttatcaccatgctagaatcactatcctttgtaaatatcatgtttattacattaattttatggattaaagtattctgaattatgaccaaatttccaacagctacaaggttgatctgttgcagttgatgaagagtcatttcaggtttgggcttcgagcccacttaaacttgaaactgggagaagcacttgagtcggaaggaattctgtgttaactaaggctgacaacaatttctttgcatgtctacttacatgacgtgcggttaactattactcttgcaagaacctgtgttttttttaataggcacaaagtttgctacagggcatccaaaaaggtgtaattagctgatggacaccgcaagaacacaaatttgctattgggcacagaaaaaattggtaattagctgatgtacactcatagccatattttattacttctggaggaattggagagtgaaactgatgtgagagtacgattctacccctgagtcgccggtcgtcgaccacgccgctgctactattttaccgcgtcgccgtgacgctgctggaccccaaggcgctcctgctccggtcggtgaggacgcagtgggacgccgagccggtcggggtcagcttcgtcgacaccctcgccgccgccaccgacggtgccgccgccaagtactgcttgctcagccctcgtgttgggccgctcaaatctccagcctcactgcgcaaggactgtggcggcactgcgcccggagctcgccaagacgatttcctgcgcggcggcgcccgcgccggccgccaccaccgctgtcggtatgtccatgccgccgtcacccacatacacacagaaaaaccataaattgccaaatttacagaaccaacagtatgcactacctcgctggaatggctcaccaccaacgaccaccacaagcacaatcaaatacaataccccaaatctttcatatttggaaaagcaagcaaattcttcgagataaaaaaattcgagctctccataaagtcaacgtagatgtttgcaagattgatgctcccatatgcagcagtagccattgccattggagtaggctactgccatctagcggcttggagaacttgtggccggaatggcggtggtgctcttcgaggatgcagaaaggcaaaattgtccttaatgactgtttctctctccaattctgtaaaaaataataaaatatggccgcgagtttccattagctaattaccagttttttttttttgcccgatagggatgcaaacggggtgggcaagcgggcttttttttccccgcttatcccaattctagttcatttttttaaaaaaattatactaccattttggaaaatagactagtaagtgggtttttatgtgggtagcgggactacccacttacatccttagtgcccgacaccaaattcgtgttcttgcgatgtccatatgctaattacacgttttttgagtgtactatatcatattttgcctttttaatatagaaagggcaatccgtaatggttgttagaaactcccttcgctacaaaatataagtaacctagtactggattagaaaatatactgttggcccttttttggcaagaagacaaatataattgggatacctagatgccttgcgatgatatggagtcgccaaccacttcaacctagcaaaagctacattaagatgggttttgatagattaaaccggctagcagagccgatttagatgaaactagagataaacgcccgactcgtgagcgaatagaaggtttacaagacaaacctacaaaggggtttcgtactctcgcagccaaggcgcacgatttacaatacaaatcggcaaagatggatgaactaggcgaaaagtagatacagtattgaaaaaagcgattcaattggctcaattggggttgagagtagattgttctccaattgaaccggccttggcccttatataggggttcgtattgcctcctataggtcctccttcacattcaactcggagtagaaaccaatggaaatccgaaacgaaccttctcgagcaaggaaacccgaaacgaacctgacgaaaacagctcggggtcggactttgccggtcagaccagccacatgcatgtggccggttagaccggcccacaggcggcagtcagattggctccgggatggaaatcggcgctttcctaactttgcaatattttccgatcttgatcctagttgccaaatttagatataaacatatactacatatgtatacattgaacatccagattaatatactagcctgtgtttaatccagtatggtgtattagaaacggaggaattagtacacttagcaaacacggaagaatggataagaaaaacgtctcaggcaaggcgctggctaaacttgcacaatccttagttaaatgtaacatactgtattttgcattatagtagcatatgtacttgttgaaagaatttattacttccattaattgtgaggaaagtttctcagtacaaatcgtttcaaatgaaattttaattacatgaattcattaccagctaattcataagatttgggctgctggaatcagaaaatattgtgtgatatagtgtaggggccacgctgtggtggccctcgtgctgctcagtcccggggcggcacggggggagaccaggcaagcaccgtcaccactctcttccccttctctccgccttgccaccacttgagtgatgccagcaaagctgggcgggtgtaaggatagtggaggcatggctccctaccttcctctcgcagttgcggcggcttgggcgctaccaagactagagggagggcttcgggtgtcggatggcggtagccagatccagcgtccttagggccggatccagtccccacgcggtcggatctagtgccctagtcgatggatccaatggtggtcgcgatggcccaacgaggaagagaggagaagctggggctgcgtgacggtgggattacgggggagcacgatggaggatgatggtggttgagcaatggagcaatagttgcacaccgactaggggcacgtggcaggtgtaaaacctagctcggtcttgccaggccaatagcgacggtgcttcgggcaccgttttccttcttgggggtgttgtcgagcctttcctctccctttggtggggctatcaggtgatagccttgtcttggttctcctcgaggcatcgacggacagcggcgtcgatactcatcatcgatactcctctcagataggttgtgcatgcggtctctagatgtttgtcctcttgccggcgacatcctagcttatgaaacttggccatgttgataggccttgtgtggaaaagcggttcctttcttctctctcaccctctccccttcaatcccagggcatggataaagttgagtgcggtgctcggctattagggtttgattttgggcagttcggctgtagcttctttgttagtgtggcagcaaccggtccggtgttagccttcttctgggttctgtgtacgtgctgtcggtgtgtggtgatggggttttctttctttcttgacttttgccttccagggtgctagtattggaattttttcctactctattcaatctattcaatgaatcatttccgtctggtgttgttcattaaaagaaaagagaaaatcccctatgtacccttaaaagtttactcaatcccttctatacccctgagatttgctcattcccttccatacccccaaatttcagtttagatcccttctataccccttccgttagtggaccattaaattcctacgataaagtccattttgcccataggtatcaagaaaatataacattatgaagtatattaatggagtgtaaaactttaagtttattttgcaagatattatttaacaaaaataatattttagttttgccacagcgaaggcaaaacaaaaataatttttatttatgtcaaaatttatatttagaatattctttatcattaaaaactgtatatatagcatattttgtaatagtagtatgacatttttataagataaatctattgatgtgctaaataagtaatttttaataactaataaataaattctatttttatgccatatctaaaaataaattattttaaatattatttatgactttgttatgcaagatattatttatgataatttatttttgttatgcaagataaaaattatttttgttaaatactatctcacaaaataaactcatagatataatagtcgcatacaatatatttatgtactcgatcaatatacttcataaatttatattttcttcatatcaaagggtaaaatgactttatggtaggaatttaagggtgaactagcgaaaggggtatagaagggattaaatttagaggtatgaaagggaatgaacaaatttcaacggtatagaagtgattgggcgaactttcagaggcacacagggaatttcctcttaatgtttgggcacggacatatttttttaagaataaaaattgagcctctacaggccataacatgaacctatgtgaaacctgaagccaacagatatgtttttacatatatattttttcacactttctttttccaccgaagccattttatcagcaaccttttggttcgggggtggctgatgcgctcagccatgcggcgcaccgcgcacctccccctttagtctattaagtatctataagtattatgcatatactttgtatacacaagtataaactttggatcgataataaaatttttatacgtatttacacaaagtatatacatacgtatatatataatttctatatataaaaaaattgacatataaaaaatatacatgtatacaaagttgtatacgtacatatacaaagtatgtatgcgcatgtatacaaaatttgtatatacaaactttgtacaaaacgaaaaaatacatcacgtatataaagtttgtatacgtatatattaaaaaaaaacatcacatatataaagtttatatatgtacgtatacaattaaaaatagaaaaaaaccagaaataccgaaaggaaataaacaaaacagaaaaaacctaaaaaaacgcgaaaaaccagaaccagcctggcacttgcgtcccttgcccgccacaccgttccgccgccgccctctcctcgcacgccacgaggctgcgccgtgcgggagaggcggcgcatggatatccgcgtattatcgatttcgttttggttcttcttattgttattgcaggtggtgatggtggaacaggggtgttgtaatccgcttaaggttcaaatcctattcaattacttacaaattgatacgttttaatggaaactaatttatcgatactttgtgtatatttggattgaaaccaaatcattgataaaaccaataatcaattcggtattaatctctatatggtcaatatttagcttcatattggtgtgaatccaaatatgtgtaatacatcttcaccctatcaaaatattagtaatgtcaaaacttaccaagaatttgtagacaaaccatccaattaaactatgtatttactgcacttttatctctttgagtgtggtagggaaattcgtggatgtgggcatttatagtatattgttttatgcatgtttctttgacgtgatgaacaaaatttagccaattttgtcttactaatcatgtcaccatcgattttaagtcagctccacccgccagcgtgatgacgatatgacagaaagcaaaacgattggctagtagaagtactatacagtacaaaattttacaatttaattttcattttcattgaatcaacattttcaggaagaatttgctttgctgtgtcaatgaactacacggtttgctgcagttctatactactatgatataagcgggtcaattctatgtaaaatgtaacggggagagattttattgaggcaccagaaatactacatctccggcttcaaccgcagaagcatgcaaccaaaaattcgcgagtaaattaaacattttccagtgagtagttgaatcctataaattctagtaggctctaatcgtgagagcagcaaatcgtcaaagtgaccaaaagtcacttacgcaagcgatgctatacctactagctagctagctactctggtaggtagcactgctatgccactgccaccacccaccagttgttgctgattggtagtacaagtcgataccgcacgcatgcagatggttacgcatggcatttgcgaagtgatggcctaattaaccacaagtaattcgaggcacccaggaattaagtagacgaaacaaagacgatgagaatgtagaatcatatagttatatgtccgaagattaacttttttataaacacaaaagcttatctgaagactgaatagctatctagctcatagtacaattgtactccgaaaaaaataaatattgagctagccaaaaaaatcacagcacatgagttgaccagaatgagcaaattccaccgttcacattatagtgttattcaattgtaatgaagggcaaagcgttcctggaagctcacttggattctgcggaattcatcttcttctctgcttggtcttatgaagttgtgatataaggttttagggtaattttatcatttttaagaaaacaaaatttaataccttcagatattcggtatctatgtaaaaaatttttagatccctcaataaaatttaatacctaaaatctaaacgtattaaattttgttttcttaaaaattataaaattaccctaatacataatacctcaataaaatctaaaaattttacgtacttcaataaaatgataaaattaccctaatacctaatacctcaataaaatctaaaaatttttacacaaaaaaataatacctctatgtacaaaaatttaaagaccgtaaaatttctcaaggtttaattttgggttactagctatactgttggtatttcttaacgacattattaggaatataaattcccagcaatggcgccataaatggtcctggatataccgcaagcgcacggatacaccattgtagcatttcacccgagagtattataaggtatcgtatttatttaatcctaagggaagattgtaagagagaactatgctaataatgtatatatgccacttgtatgatcagagtctaagcaggggttaatatattcataagggtacagtgacacgaagcaataaactcatatatctcattatgtggaagaagaaatagaaaagcaatcaattcctatactcctagtatacactcaatcttagtttacatctgctactatacagctatatagccaataacccctaacagtgccttcctggtgtttcgagagaccagcccgggttgacaagttccttaccacaacctgtcatgaccgtccaaccggggctaaatacggaggagtaccctccccaggaaaatttcttaggaatatatactaacgtagaggaatacccatactgagctgtcaccattagtagtccaccttgactgtcccgcaacatatatgcctagataatgatacttaataatccagacaccacacctacattattaaatactactctatatccccaagaatgacatagagcaaccgaataatcgcacattaaacccacaccattgcacctctcgtagtaggctagctacacaactatatcgatacagatatgaaggtaagcccgatactcaagataagctaaaggtaccgagagtatataaagaattataagatttcattaattccgaaagtcttacaaaagaataaagaaaagctactagagccatacccgaattactccgaggactccgagagctattatattctactccacttagcactagaatactaaactaaagtgtagagagaaatgtctagcttgcttgagtgtgctttgaagtgaatgaggcctaattcttttataggcaagtaatgatggttacactatgcgaattgtccaatttgccctgcaaccatcattgagtagctatcaggagcgtccacatggaaagccgggatgagaggagctcgctagggctggcccaacatgcctccacacttcccagggtcactgacagggggcccttaaggcgattatggtagctatggcggtttctaggacagttacacctgacatgtgggcccatcttatcctttttttagaattatacagtacaacgtagacactcacaacgcacgcgcactcacccctatgaacacacgcacgcaaaccctacccctatgagcatgaagtgtcctcatttcttcttcatttatgtattaatctctgcaaataaataatactccaggtacatagctaattctcatagttaatctatgcaaataaataatactccaggcactatattattttgaaacaaatatgcattgcaagcatagctaattctcctttattttagttatagtgacagacgaaattggtctataacaaccgtcaaccaaccccccaaggttgaacctttgctcgtctcgagtaaaggacttacagagaataaacttggttgttgaccaggagttgctactatgttatatatctagaatgtacaagtgcaaaatttgagtacactatctcatattaagcaagtaggcacggtggcttaccaatacgcccaatcccgtggtggaacatgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaacaaaagataactggagctaagccttgactaaactgcagcgggaacaccactccacaggcatcctcgacggcacggacgaagcctactcctcggggaaaccttcatctgacaaaaactcatcctctggggttgggaaaagtagagcaagactgagtactacccactgtactcagcaagtcataccggaataggggtatgatgcagggaattaacaaagaagagctagagtggttcatttgcataaatactggcatttataaacaggaattgaatgcgaaaacggttgtaataattaagcagtattaaacatccgctgtccaacgctaacccacgttgcgacaggcccaaccatccaccaaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgctcacccttgcctggatgcgtcggctagaggaaagctacactacaagcccagccgttgcccacgctggcttgtggtaagtacgataaatccttccagggcatcccgcgaaccggtccttaactgccatgggtgcgaccagcaaaaccatgcgcccacagcccaccatgtgattcattttaattaaccaacaccagagcggtggtactaatccaacattaccattagaaccaacagtctaaacattaatatgattttccccattgtgaactagttgaactaagcatggctaagcaattcctagtccaaactctactcatgttataaccccaagctaacaaaggagcatggtatcaaaatagtatggctgtaataataggtaaccatcccatagtaatattgcaaaacaaatgcggtatttgaaagaaaacaatagagcatttacaatataggatcaatatgatcaagtgacaagcatgacttgccttgctctgctgctggagggacctcggcgactatctcgaagtacaccggagcgtcggagggatcggaatctaacgacatacaaagcaaacattgcaaacaggctataagactactgaaacagagaacaaaaccatttttaatggattctacacattttttttgatttactgagacttgaatgggattaaacggagctcggatgaattagttatcaattttagaagattcactgtgtttattactatacaagaaaaaccttaaactatttattgcgcaatatattccagggctgacgtcagcacggagggagtgcggcgccgacatgcggggcccaccggtcagcgacccgggagagggcggtccacggcggatcgggtccacggaccggggaggagcggcgccgacatgcggggcccactggtcagcgacccgggagagggaaagaaagggcggcggcacgcggctcggcttggctcaaggccggccgaccgaccgcggcgacggcgacgacgcgcgcgcgaacgcgttgccggcgacgcatgcgaccgacgacggcaacgaccggcggcacgcgaggcggcggcggtcgaaggcgacagcgcgcgacttgaagcggcggcgcggcactaagaggagaggaaggggaaaagaggggaggggatgcctcaccgagggtggccggcgcggaggaagacgatggcgaacggcgacggcaagccacgggaggacgatgtcggcgagcggacgagcttcggggtgccctaaggaaggaggagagagggattagagagagggagatgagccacggcgaccggaagccatggccgaaggcggcggtagaggtggtgctcacccgagtgcgagggaacgagggctccggcgacgaacctcgacggaggagaggtggacggggtggatctcggccacgcgaacccgacggcggcgatggcgcggcctggcggcgaccctaacggcggctagcggcggctggagtagcggaaacggcggctgcggatgggcgcacggcgcgagagcgatgggaggctcgagagagtacggcggaatggggaaaaagtgagaggggacgacggcgatgcttaaatagggggagagaggaccggacgtggccgggagaggcgggaatcgccggccgacgtgggggagtgggggaagagagagaggcgggattcgaaaatcgaatcccggccatctcgggcgcgggcgcgagcgggagagagaggagagtgggcgcgggagacgcggcgcacgcgcgggcgtggccgacgtggcccggaggaggcggagacgtggacgcggcggcggtttcgggtgcggcggttgcgggcgcggcgtcggccggaggaaggggaaagacccgacaggtgggccccacctgtcggcgaccccgggagaggtgggaggcgggcggcctggctgggcctcggcctgcggccggcccagcaagggggagggggaaggaaaggggagaatgggccggcggcccattcgaaaaaaggaggaaaaagggagggaaaagaaaaagaaaaaggaaaaaggattttccctggaattacaatattgcttgcccaattttaactggttaaaattatttctagagctctgaaaattccactaaaaatcctgttaatgaattttgacatgtagaacttaagaaaaattccacatgtcaagtccgattattatttgcattactttcttagggttttctcctgatttcacctgcattttcttggggtcatttgaaaattacaattttggctagggaggaaaacttcggggtgtgacaaacctaccccccttaaacggaatctcagccccgagattcggaggagctggtgaagaggtgcggatgggcggctttcaactcatcttccctttcccaggttgcttcctcttccgaatgatgactccactgaactcggcaaaaccgggtaaccttatttctggttctcctttcgctggtatcaagtatacgaaccggcttctccacatatgttaggtcctcctggatatcaatgtgcttcgaatcagcctgttcttcaggtacccttaaacacttctttaattgggacacatggaacacgtcatggatgccgatcatattggatggaagttctaactgataagcaacttctccccttcgttccaagattttgtatggtcccacgaagcgtggtgccaacttgcctttcgtctgaaaccggtgtactccccggagcggagtgacacgaagatacacgtaatctcctgcctcaaaagtgagctcccttcgacggttatccgcgtagctcttctgtcgagactgagcaatcctcaatctttccctgatgattctgactttctcttctgcttccgctaatacttctgttccgaacagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcacaagctctcaacatatcttccaagatttgattgactcgctcggtctgaccatcagtttgcgggtgataggccgtgctgaaatttaaacgggtccccagttcttcctgtagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagatcaaatcgtgacccgatgatgtccggggcagtcctgttataaagtccattccaatctcctcccatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttagtgctgcctgggtgaatggagtactgggtctgatgagcctcggtgagtatcagatccttcagttccttgtcgtcaggtacacacaatctttctcccatccagattgtgccatgctcatcttcgtggaaatcccgggcttttccgactctcatgttctttttcagctctgctatctcagaatcatttacttgagctgctctgacttgatccacgagagtgggccgtgcctccagagcggctacaaacccgtgttcaacaattcccatgttgagatgctcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaagtcatgagttggataattcccttcgtgtggacgcaactgccgcgaggcatacgcaaccactctgtcctcttgcattaggacacatccaagtccgtgacgggatgcatcacaatagacttggaagtctttcatcgggtcgggcagaatcaaaactggtgcggatactaatttcttcttgagctcctcgaagctcttatcgcactcggctgtccatttaaacttctcatccttcttaagcaactgagtcatgggtcgggcgattctggagaaattttcgatgaatcgacggtaataacctgcaagtccaagaaaacttcgaatctgcgacacggtcttcggtggggtccatttggtaactgactccacgttcgatgggtcgactgccacaccctgagctgtaatgacatgacccagaaatttgacttctgtcaaccagaagtcacacttgctgaacttggcgtatagctggtgctccttcaacttttcgagtaccagacggagatgttgctcatgttcttcctcggattttgagtagataagtatgtcgtcgatgaataccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagaaaatactttagctcctttcagttgatcaaataaatcgtcgattcgcggcaaaggatatttattcttgattgtgacctcgttgagtgcgcgataatcaacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtatggtctcttatagattggagcggttcccggtgccaagtcaatccggaattcaatctctctcttgggtggcatggtagtgaggtcttcggggaacacttctggatactcgcagactatgggtatatcttccaattttctcaagttcttctctacggtatccactgggatttccgtctcaatctgattcaacgagacccctttctttggtgagactagagatttgtacaccactgtttctcccttctcgttggtcaaggtgactgtgcgattcgcacaatcgatgactcccttaaacttggtcagccaatccatcccaagaatgacatctaggtctttggattcaagaagaatgaggttggctagaaatggtgatctttggatttctattagcactgaggggctaaaactgactgaggttgaactatttcccggggtatgaaccctcattggtgtgctaagctcttctttccttaacccatacctccccacaaatttctttgaaatgaaagaatgcgttgcaccagaatcgaaaagtactgttgcagggattgagttaacaggaaacgtacccagtacgacctccggtgctgtttgtgcctcctctgcagacgcgtggttgacacgagcctggataaaccttggcccggcacgcctgggctttgggcatttgtcagcgaagtgaccaagctcgccacagttgaagcaggaccctggttttgctccagtctccttcttggcttgcgcgggctggcctgactgtgccggtgccactgatgggcgtggagctgcaccgcggttgggctgacctccatggtggttctgactgccactagtgccctggggaaagttgctagggttgaacgggcggtgctgacggacgatcatggtggtaggtccaccctgctgcccgggagtgaagcgcggcctctggtgacttccctgaggtgccctgaactgagcggccttcctcttcctgtcgatcttgttgcgttgatcctcctggcggattgccttgtcaaccagcctctcaaagtcagcgtagtccccggatatcagttggttggtcagctcatcatccagacccgccatgaacttctcctgcttctcggcgtcggtgcggacatcctctggtgcatatcgcgcgaggcgattgaactcgtggaggtactgtgtcacagtcctgttgccctgatggagtgcccggaattccctcttcttttgtgccacgaccccgtctggcacctgcgccttccttaagctacggcagaactctgcccatgtgacttcagtacctggtgggcgggtggccatgtgattgtcccaccaagctgacgcgggaccctgaagctggtgtgtggcgaaagcgactttctcctgatcattgcactgcaggagattcagcttcttctctatggcatggagccagtcattcgcctccatggggttggtggtgctggagaaggtgggtggcctgacgcgtagaaactctggcaacttggactgagggggagggggaccaaactgctggtgctgctgttcgacgtgctgcatcatcctctggtgcatctgctggtgctgctgctgcatctgctgtatcatggctgccatcatctgagtctgatgtgccataacttgggcaagggtcggattctcgggaagtggtggcggaccattgccggaatctgtcacgaccggaactgacccaacgggcgttccttacgtgcgtgcattaatccttgtcccaggggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccaaagccttcatcttcaaggggctcctcttctgggtttgggaaaaattgagcaagactgagtacaaccaccgtactcaacaagacacacccacaagtgcagaataaatgcaagggagtacaaaggagttataatataaagggttagggttgcagtaaacagcatttaaagatatttagttgctcagggctattttgtaaacacgattctagaactaaacaatattatttatcaaggccatgaacccacacgaacctgccttaacccaaggcctacgatgattcagaccgaactggcaacccgaccctgggtcccagctcgtcccaagccaacccaggccaaccattccatattttagttgttaaccaggttttaagaattaaaacacttacttgggtacaattgctcggcttgcccataccggagggcgcggctattcgaataggttatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccgggacacccgggacaggcaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaatccaattccacaataatccaacaattccagtgtgtccaggtgatgagaacatcccaaagtctagagttgtaaaaccacctaatgttacctaattaaaagcgaagcatctacctaaaatcatactagtgatcccgtgagtagagtgtccactagttggggttttgtttattctagggtgaacaaggaaataataacaatagcaataataataaggtcataacaaagataaataggcatggctaaataaaacagtgataacgcgggaatttaaataaagcgataatgcaataatttgaaacaacataattttacaaactgggattcaatatgttcaaagatgatgtgacttgccttgctcgctttcccaaacgtcggcttcaacttccacgaagagcggatcttccgaagctgcagcgtctacacgaccaacggaaacgaaacggcttttactctactaaactccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcgggtttattgcatcagccgaggggaggggcgcgcggaccgggtccacgggggtggggcccacgtggcagccccacggcccacggtggaccgggcgcacccaggctcgcaccggccggcgccgtgggtccctctgaaaattccactaaaaatcctgttaatgaatttcgacatgtagaactcaagaaaaaattccacatgtcaaatccgattattatttgcattactttcttagggttttctcctgatttgcaccggtattttcttagggtcatttataaattacaattttggcttgggaggaaaacttcggggtgtgacaaactggcccaaaactaggtcaatgtgcttctcgttgattcctcggtctagctagtagtgtagtgtttgggcccatttgataatattttaatgggtttagaggcccatacacgcataagtctacctcttgatgaatttccatttgtgtagcaatatctgcaaacaagtaaagtccaagtaaaagtggagatagattattctataacaaacatgcattgcaagcatagctagttctcctttatttcggttatatagacggtcgcaattggtttataacaaccatcaacacacagctgcaagaacacatgaccacgagatccctcctcgtaatcaggaagtcatcgatgatcctccccgctgcgcaaaacaaaaacggcgagaatgcctcaccacaacgtcttgcccaacatgtcgccccgatgagttgcccacgatcttcgcgagcatctgaacagccgaaggcataattgacaagaccaacggaacaatggccatcgacaacatcgcgatcggaatcgccaaggcaatcgtctacacgagaaccaaaaccaagaccaaattcgaaatctttaagatcaacagcgttagcaggacaagaacggaggaggtcagcgcaatcatcatgaagacagtcggcgaagcggttcacgatctccagctccaaggcgagatcaagtccatgacatacgatattgagatcgcacacctaacgatagcgatccatcttcatcgtctaggggaggttcgtgacgacctcgcggtcaccgacccccactcatacccagcggcggatgcaggatatttagacccgctcttcgagaagtcaacaggccctcaaaattccatcccgtaccattggacaaatacggaggaagcactgatcctgaggaatttctatgcgtctactctactgtcctatacaccgccagcgcagacgacaatgcattgacgaattatttgccgatagcgttaaagggatctgctcggtcatggctcattcatcttgctccatcatcaatctcatcctgggcagatctttggcaacaattcgtcatgaatttctaaggcacatacaaacgacacgcagtcgaggacgatctacacactctcagacaaaacctagcgaacctctttgggacttcatctggcatttcaacgaatgatgtaatacaatcccggaaatcaccaatgcaagcatttaagttgagcgtctgagatcgctatacgatccaagagatagctacaagatggatcaccttcgccatagattgtgttaaatttctactggatgatgaaaactcaagcagttagacttaattctttcttcttttctactcaggctgaacaaaggagaaataaagctcgattattgctggcttgttgctgggaaaattgttacggagagatttttcaaaacgaacacatcaaatccactctaatatgtccaaaactcatggtatagtgttttttgaactatttcattccggtgaaaaacatctcactcgcgtgagtcaaatctgtaataaatacacaagtactccgataacttacagtggctatcaaagattccttttgaattggtcatacagaactttaatattctatgtttcaaatgacaatgcatttgtactgaatgttgatggctgaaaatttgcttaaattgatgaattggagtatatagtagtaaataaccaagttcatttgcataacctgttgaggaagttctgtttaataatccatactcaatattggattgcattttagttttatatatcttttttgggcttggaacacaattttgctaatggtatcaatatgttttctatgacggttgtccgtcggactccattcacaggaataaaccaacagaaatgttttttctgtatggaaaccaacaagaaaattgaattttttccgtggcgattttttcagctattaccgatcgtccacccaaaggaaaaaaattctaatggtaaaagcagtttttccgatggtttcgctcctactagatggtgttgacgatcattagcgatcagtttcgcccgtcaatactaccaaaataaaggagaactagttatgcttgcaatgcatatttgtgttagaataataaatattccactagcactaggattactaaccttttgcaggcaataaacataaaatggaggagaatcaacatcaaaacagacgatcaatcaattggacgatgtcgagaatcagacttgtggaaagatgggccaagaactcagaaatgacacgatcaattgggccaaaattcacaaatctggagtgagcaataggagaggaggccgcctgccaggaactgggccggttgggccaacccaaggtttagctgaaccagccgcagcgccgatggatgcagcgtttggctggacgggtgggattgattcccaatgacggttggtgggtattactgacctttccaaccgtcattactagcctatataaacccctcactctctccatttcaagacacacatcaagcaagaagcttcatacatctctcaagtttagtatagtctctagagtatagtggaatagaaatataatagaatcttcagtcctcggagtctttggaagaattcgggtatggctctagtagcttttccttcttttgtaagacttgtacttttattagattatttttctttatactactttggtattgtattattttccgagtatatgaataccagctttactatatgttcgaattatatttattatgatgctagcttacctgggagatgcaatggtgtgggtataatgatcgtatttacgatgactctatgtcatgacgatgatattagagtagtatttggtagtttaagcgtggtgtttagattactggatatcattatttggggttgtatttggggttgtatgctgcggaagcgaggtgggccgctgatagtgacagctcagggtattcctccgcgcgtgtatatagtcctaagttaatttcttagggagggtactcctccgtatttagcccaggttggatggtcatgacggattgtcgtaagaaactcggcaatcaggggtggcttctcgaagcaccaggagggtatcggaaataggatattagctaagtaatgatataactaggatgtgggtataatatatatgtatactagagatataggaatagatctttctatattatttccacttagattagataattatgaatgagtataaatgcttctgcttagtgtcactctaccctctgaactatattaaccctgcttggacttttgttattacaagtaatatataaattgtatgattctctctattataatctttccacggaattaaacaaatacgataaccttggaatactctcgggtgaaatgctacaatgttatatccgtgcgcttgcggatgaactctgtaaccataatatatcagaagtgtttctgcgctattgctgagaattatatttgtaataatatcgtttagaaataccaacagatgggacgatgatttggctagatattcgtcaagatgttacattatatagtacagcttttaagttgttgcactagcacaaaattaagtactccctccattctataatataaggcataaatagtttttaaagttgtttcataatataaggcatagatacatgcatgccattaactaacacatcttcttcaccaaaatattattattcaaattcttcaccatcaaaatctctaattttattggatgcatgtattacatttattagattaatccaaattatgaggtgataataattattttttggtttttgggttaagggtggttgtgtcttatattttggaatggagggagcagtatcacgtcgttaaagttgttgtatattgctaaaacatgggagtaataatttatttgcgaacttaatatcattatcattgttgttgttgactcctctttcatgtaaaaaaatatatatactcaaattattcaactagatggggtggtaggtaagggatctcaggatgggacctggcacccatatccaccaaccactgttgtccctgagataatagacgcgtgctttgcagagtgatccaaagctagctagtcctaccaacaatggaggtcgccgccatggagatctctacctcattgctcctcaccaccgtggctctctccgtcatcgtgtgctacgccctggtcttctcccgcgccgggaaggcgcgtgcgccgctgccgctgccgcctggccccaggggatggccggtgctgggcaacctgccgcagctgggcgggaagacgcaccagacgctgcacgagatgaccaaggtgtacggcccgctgatccggctccggttcgggagctccgacgtggtggtcgccggctcggcgccggtggcggcgcagttcctccgcacccacgatgccaacttcagcagccggccacgcaactccggcggcgagcacatggcgtacaacggccgggacgtcgtgttcgggccgtacgggccgcggtggcgcgccatgcggaagatttgcgccgtcaacctcttctccgcgcgcgcgctcgacgacctgcgcgctttccgggagcgggaggccgtgctgatggttaggtcgctggcggaggcgagcgccgcccctgggtcgtcgtctccagcggcggtggtcctgggaaaggaggtgaatgtctgcacgacgaacgcgctgtcgcgcgccgcggtcgggcgccgcgtgttcgccgccggcgcgggcgagggcgcgagggagttcaaagagatcgtgctggaggtgatggaggtgggtggtgtgctgaacgtcggcgacttcgtgccggcgctccggtggctggacccgcagggcgtggtagcgaggatgaaaaagctgcaccgccggttcgacgacatgatgaacgcgatcatcgcggagaggagggccggatcactactcaaaccaaccgacagtcgtgaggaaggtaaggacttgcttggcttgctcctggctatggtgcaggagcaggagtggctcgccgccggcgaggacgacaggatcaccgacacggaaatcaaggcccttatcctggttcgtgattcatgctctgatttagtagatagacactcactcgttcattgcatattaactaagtagctataattttttaagaaaaataataaaatatattagtatataatatattactttacaaacatataaattaaattaaatttgatttttataaataacatatagattataagatccacgttaaatgagtctacatccactcaattattagaatctgtcccctgaacttttttactgttgtctgtctacgtcatgtccaaaacactagtaatgtttgtttctcctttgttgagaatctgtttttcccacgtcgatgtgctttctgttcggaatttggtttgggaatttggggatatgcgtcgttttgcgcaccagaagaccagaacacgtacttgtcgtcatcaccactcatttgggtaacagattatcaagtagactggttgtcgggcttccaatagtaaaatctaattcgagagccctcctgttttagcgctatcattcgacgctggcagagccgtctgatcgctcgcgtcattatcgagtccatctgcgtaggcctcgcagtctactggtaattcttacgatcacagataaaatccgcaagcgcacgggtatacagatgtagcacttcccctacggagtattccaaagggtatcgaatccaaggaaacatgtgtggtcagttcttcctccggttcatccaagaacaccaagcaaaggatagggcgggatagcgaggattcactggtgagaaatagtgtctaggaaagtttaagtttaatcctaacgtaatacttcaggcactggtaacccgctattcccagatgttgctctactacgtacccggacagggaagacttaagtgatctcgagggctgtcaccacctctacacctacctcaaacgtactgtgggatacacagtaattactggataacaattacctaaacaccacgtctaagcaattaatatctactttagtatttataactcaccaaagcaatctctatatttcagttgattatagtgaacgataatcccgtatgctatttaggaactaaccaagagataattctcacaagataaatctaaattactcaggaagaatattatattgaaatcagagtaatgaacaaaataaaagaaatgagagaagattaccgacaactccagaattcttccgacttcttctactctactctcttcctattctagtatacaatatagtacaatagagcctcttataatttagctcaatcttggaagtgtgtgtaagagtgaaggagtgaaactccttatatagaggtaggtatgactgttacacgatgcgaattgtcggaaatgccccgcaaccgccatcaggagatgatcaggaccatccacgccaaaccccagcctgaacggctgagattttggttcggccgaaccaaggggttcggccgaacgtgggctaggcccacctggcctggccttcggcccatctcctccgctggtcctcctttatccatttctcggagttttgagctgagtctttgatattttgatgatcacaacccatccttgtatgaatacacgtttctcctcactttagtctgattttactcccaacttcggggttcaacacctgcatacaaatgaacaccaacactagtggaatatgtgagattaaacacctatcgctatattgaatgtgttattatctggactttatgcagaggttggcggtatagaatcagcatttaacagccgccaacatagtcgtaggcatggctttctggataaggatcgagatgaaaccactccaaccacacgtcacacgcaaatcctgctttagagagtcacagagagagaggttacagtttctcccccatgtccttttcctcttcaaacaatgttttctctcaaattacctatccgatcaacaatccgattacaccattgtgttcgttacaattaaatcatcacaacaagctctgacatgattatattacgatgaaaaaatatttatatttataaattacttttattatatatgtaagttacttttatcatacatataagttgcttttagatttgactaaattccttttatatttgacatataaaagtaaatttaataaagtctgaaagtagtttacatatattataaaattaacttaaaacaaaacggaagtacctttgtcacgacattagaagtaaattcgttgtagggataaaaatattcctttatctaaaattaaatttaattagcacaaatcaacacacgtaagtttaacaatttttaaaagtaacttcaatgttaattggaagtaacttttgcatggttcaagttgaaaggagatactagatggagtacaaactagctaccactagctgtgtagtcacgtccaatgaaaaaatgcattaattaaagttactttctttttgttatagttacttctataatatatttaaattacttttaggctttattgaatttacttttatatgtctaagaagtaatttagtgaaatctaaaaataatttagatatattataaaagtaatttattatttttcatcaaaatataatcatgtgagatcttgttataaagatttaattgttacaaacacaacgatataatcggatcgtagatcagataactagtttaagagaaaattgtatttgaaatataggtggacaatgtctctcatatatggagtggtagctggtttagacaaatcagctaccacttgctgtgtagtcacgttcccaatcgtaaaatcctccttttccgtgggaataggataatgcaccacctaaattattttaatgctaccttactctaaacttcggatatccgcacggtcttcaaagcagtgacaaatctagaatttttattttggtgtgcccacacaatcctcaaaagccaaatcagagtcactcatatacacaaatacagtaaaagttctttttttaaaggaacacaacaagggagggccccattgctaaaagattattattaaaaaagaaagaaggttacaaagcaaattacaacaaaaggatccaatctctgactacatgttgatcactcactttcaacctaaacagcaaaaggaggaagtctcctttaagaagttgcctccaagaaaaaaacaaaggtaatctgttctcaaaaatgaaaccattcctttctttccaaatattccaagcccctaaaaggaacttttctataaagcattgcccattgt

SEQ ID NO: 4885 - DNA, 865 bp, Oryza sativa
aaattcagagcatataacttctgggaagtatatttcaaaccaccccaaatataggaccaaatatatggctatctcactctcctgagaaagatcaatagtgctaataaaatctgaaagagcctgaaactcagtataagcttggtgagacaaaggcagctgaaaattgtctgacatttgagctgacagatagccatgcacaaatgatattttgttggcagcaaatgaataaagtctaggcattgagaaactgagagggggattatcagaccaaatatcctcccaaaaagaacatgttaaaccattccccacattgcatctagcaatccctctatagaaatccatcagcttataaatatctctacaccaaaaagaccctttagagatgacaaatgaggggccacttgatcataataagaggaccagataagatcaacccatggcacattccttctattatagaatttgtccaaaaatttcaccaaaagagcttgattccgaatagaaaggttgataacaccaagccccccttttactttaggtttacaaactttgtcccaagctgctaaattttctgcttgaattcacatatgaacatctccaaagacaatgtttccttgcactatcaatattatcaattactgtcttaggcaacattatagtgcacatgtaattggttggcaaggaggagaaaactgaattaactagagtaagcctattaccatataacaagaaatctgagtttgcagacaatctcctttcaattccttcaactagaggagcaaaatcaaccactctaggcttagttgttcccaaaggcagaccaagataagtaaaggggagtgaaccaattttgcaaccagaaacc

SEQ ID NO: 4886 - DNA, 956 bp, Oryza sativa
ccgcgagagttggctctaataccattttgtaacgtcccgccttccccaaggccgggcccgcttacatctgatagctttcataggtcataaactgccctcacagaccaacacatatcttttctgcacactttgtcctcactcgtgtgcacccggaaagaatttcccggtcggtcacccatcccaaattgctctagtgaggccaagcacgcataaccctggagttcttttgagattggcttccggaaaagaagttgcaacttgttgatatgagtattctattaatcctattaagccctaggccgggatgttacatcagttgatcaaacaaatcatcgattcgcggcaaaggatatttgttcttgattgtgacctcgttgagtgcgcggtaatcaacgcacatcctcttcgtcttatcctttttctccacaaaaatgaccggagcaccccaaggtgaagtacttggtcgaatgtaccctttctgcagctgcttatcaacctgcttcttgacctctgctagttcgttggccgccatcctgtacggtctcttatagattggagcagttcccggtgccaagtcaatccggaattcaatctctctcttgggtggcatggtagtgaggtcttcggggaacacttctggatactcgcagactatgggtatatcttccaattttctcgagttcttctctacggtgtccactgggatttccgcttcaatctgattcaaagagacccctttctttggcgagactagagatttgtacaccacggtttctcccttctcgttggtcaaggtgactgtgcgatttgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtg

SEQ ID NO: 4887 - DNA, 799 bp, Oryza sativa
gtattagcggaagcagaagataaagtcagaatcatcagggaaaggttgaggattgctcagtctcgacagaagagctacgtggataaccgtcgaagggagctcacttttgaggcaggagattacgtgtatcttcgtgtcactccgctccggggagtacaccggtttcagacgaaaggcaagttggcaccacgcttcgtgggaccatacaaaatcttggaacgaaggggagaagttgcttatcagttagaacttccatccaatatgatcggcatccatgacgtgttccatgtgtcccaattaaagaagtgcttaagggtacctgaagaacaggctgattcgaagcacattgatatccaggaggacctaacatatgtggagaagccggttcgtatacttgataccagcgaaagaagaactagaaataaggtcaccaggttttgccgagttcagtggagtcatcattcagaagaggaagcaacctgggaaagggaagatgagttgaaagccgcccatccgcacctcttcaccagctcctccgaatctcggggccgagattccgtttaaggggggtaggtttgtcacaccccgaagttttcctcccaagccaaaattgtaatttataaatgaccctaagaaaataccggtgcaaatcaggagaaaaccctaagaaagtaatgcaaataataatcggatttgacatgtggaattttttcttgagttctacatgtcgaaattcattaacaggatttttagtggaattttcagagctctagaaataattttaaccagttaaaattga

SEQ ID NO: 4888 - DNA, 565 bp, Oryza sativa
ccaatatgatcggcatccatgacgtgttccacgtgtcccaattaaagaagtgtttaagggtacctaaagaacagcatgattcggaacgcattgatattcagcaggacctaacttatgtgaagaaaccggttcgcacacttgacaccagcgaaaggagatccaaaaacaaggttacccggttttgtcgagttcagtggagtcatcattcgtaagagcaagcaacctgcgaaagggaagatgagttaaaagccgcccatccgcacctcttcaccagctcgtcagaatatcggggctgagattccgtttaaggggggtaggtttgtcacgccccgaagttttcctccagagccaggattgtaattttccaatgaccccaaagataatgcaggtgaaatcaggagaaaaccataataaagtaatgcaaataataatcggacttgacatgtggaatttttcttaagttttacatgtcaaaattcattaacaggatttttagtggtattttcagagctctagaaaaaattttaaccaattaaaattgggcaagcaatattttaattccagg

SEQ ID NO: 4889 - DNA, 4795 bp, Oryza sativa
gtatttaattaaattttggagcaaattaaaaacctaatcggcaaatcaaagcatcatctacttgtgcactaatttgaacactagggtataactttcataatttattcaaatactagattatttatcatgagttaatataatttttgtagaatttttacactttgttttgacctcattaaaattcaattcagttctcagcattccccttttcacctttttgccagaattaaaatattacgaatttttgagtgaaactttgaaaaatggaaactaggtaactcaatctatctccacaccagaaaacacatttttgacactcttgtagataggtcaatctagttacccaagaatgagaggaagaaaatgcctgcaaatcaactagtttcaatgtgtacctatgtttctaaccttcctttatctgtcccgtggacccagctcgacttggccccacctgtcactgacctaggctctccaccaagccccatcccacctccaggtcgtgcacccagctcaggttcataaggcaagcaggaaaccctttcatcttcttcccctttcttcctcccttgtctgttctcccatgagctgagctctctcctaattttctccttcccgaatcttcttgaaaatgcaagaatcaagccctgcatgtcacaccactagatccttgtgattctaagctttccatccatccaaatggcttgcacatgcatagatttgtgagggagatcgagaagaaaagagaaggagcttgctgcttggtgcagtagcagtaacacttcgttttcctccacttggtgagcttccttccccatccatagcttctctcttaggttccctaatatggtgagcattcctagcctcctccaccggtcgccggttcaagatttcaaggataggagcaggttgcacgttgttttctgtcctttggtgacaactgctcggtgtcttctttgcttccctgttttggtgaggtatcagctcttcacctcaagccaaaaagtgtcttcttagcagtaggatcaagtccttaatgtatgtttttcttgcatgtgatgttcttgacatgcatgcaatagagcgatccacccacagcgctgcatcgttacatgcatgacatcccgagcgctggcacttgcagccgctgcctgcacctgtccggccaccactgggctgggtagagtataggaatggaatctcaaagacttgatctgcatggtctcttttgaccttgccccaattagagccatcgtttgctgccagcgagcttgagatcgagctcagccatggctgtctatgattgctgctcaattggagaagaagctggaccttgttgagaaatgggaaaacttcaaaaagccataagtatttcattttaactcatctttgaatgaatcaaatccctgtgtattcataaccttgtagaccttatgtttgtaaaggaaaacttttcaacttctgttaagaaaatgtcagtttttcatatgacttaggttagttcatatgtaactgaaacaatgccattttcagtgtatatggcttgttatttttatacctctcaaaccataaatgtaaatgagttgattcttgttcctaaaattagtttatcatactctctacctactgtaattaggccatgatttatagagcatgttgcatatgcatatttatttgaatcttatttgcatatttgcctcttattggtagattcggagaatttggaatacgtggagcaagactcagaggttgagtgtgtttccgcacagcagcaaggcaagcgtctatggatattgaacctatgatttcacaaaacttatttgcttgcaaaaactatatatatgcataagttgaattgccttaaaatgtcggtaacgggtagagttgtttatatccaagttcatgcatttcccttcctttaatatattgttgccatgtaaccttgtcaccttcaattgtaaatggttaggatggtttattctatcatcgaatgcttagccatgcttaggtctactgttgttagaaatcgatggatggagccatcggatgaacttattcaccacccgcgatttatgggcattaaaatctgattacctcactcaatgattaatatggaaacatgctttagcttggacgtgtgatagggcgatgacgggatggtcattttccctgatgcaagtagccttgtctgggttgttaaggaccgaacatgttgacgtctattcaagcaccatacgtacttccacacaccttatttgggaccggcttgtcttagtactatgttgcactgtgctcatctacgtcttgctggtcattcgtgagggtggttttccctttggattgccccgggtgtgcctgattttggcagggggtttctcccccgatggtgagctggccacatcacacgcacgtggctaagtcgacgggggcctaggcgtggtttaggtggttggggtgtcactaggaaaggacatgttatgagcttgtatcacttgtaggtcacacctgtgtgcgtgtgaagcatttgatccttgttcatttcgtgtgggtaaagttgtacacctctgatcagagtaaaactattcgaatagccgtgtccacggttataggacgatcgcttgatgtgttagtcagtctatgttagcatcaaacttgggttaaatggctggtttagtcatggatatggtgatagttatgtttggaatccatggttgggcaacggtagcccatggatggtgatgagagcaccggttgtgctcatttgtgattcaatttcagatttacttgcttgctgtcctaaatttcggattatgctattttgtacaaatgttatatttgcaactgtactacttgctcaacaaaattagctctatgcaaaatctgaaccacttagccatttcctttgatgtagaaatttgcatactcctttgtactatcatatatggtgtaagtcttgcggagtacctttcgtactcatgttgctattttcaggtgaggatgccggcgttgatgttgtgccctactactatcccaccaagggtggcgagggtagcgagtagttgaagttcgctcttgccccgattggttgcccttgtggggttgttggcacaccacaggtttttcttttgcttatgagaaattatgaaacttccgctgctatattttgtgttgtatgatgggcttgtgaaccccgttatgaaatatgtaccttgctgtccttgtatctagatttatgcatttgtgatgtttatcaattgcttgcgatgaaagtgcgaggctagtcagttttctggggactagctgagcatgagtatgaattttgagcaattgagatgttgtagagctttagcattttgagtcaagtctcctgagatgtgtaacacttttggtcgctgccttcgtgtggtttgacgggcatgtctcagctgcagttgactggcatgctgagtccgaacaatatctcctttgctcatgattcggcattgcggattttatatcgaatggtgttaaattgtgatcatgagcacattgaggtatgagtggctatttatacgtgtatggatcccactcatccaaaattatgtggtggtcacgaattgcactggacgatataatgttcgagtgcccacatgcgggatcattgttcgctatagcccattaatttatagtgattactttactgtttagctagcgctaaagtagttattaattgcatagacgtagagtctgggtaattaatttccggtgattgcttcgtatcccaccgtaggtttgaggtaggcgtagaggtggtgacagcccttaaatacactaaagtcctccctgtctgggtatgcagtagagcaacatctttgagcagcgggctggccagtgcctaaagtatcacgttaggattaaattgagctttccgtagacatggtttctcactaggaaatcctctttaccctttgcctacatttgcttcatgtccttgggtgaacctgaagaggagctgaacacacacgttccctgaggaaatcgataccttggaatacttgagggtgaactgctacatcggtatcttccgtgcgcttgcggattttatttgtgacgttaagaaataccaacaatagcaccaattataaaatgagtaattaattatatggatgacacagcgtcacatcccttcatctgttgtagggacttgtgaaccacatcgatggtggatagttaataatttcaacttacaactaatcacaactgattatacgaaatatatagttaatgtcacacccggagttttcccttttttgtagtttctaaatcattgctaaatcgtctatagaaaatacgttgttaaccaagagaaaaccctaaataacaaagtgtttaataattggaattatcagggagattttttttttgaattctcattgctataaatcattaacgggatgtatagtggaatattcagagtaagggaaataacaaaagttaatttaaaatgtcaggagttgaagtaataataattttcttgcccgcctttggccatgaaccgtgcctggttcacttatccgttagtctgcggttccattttgtataacgagccgagtccgaatccgcttctagttccgtgtccgttcttttcctaaaacggcaccgcatcaatttttcttttcctttccctttttggtcgccattttcggttttcccctccacccccttcctgccgcgcgccgtgccctcccaccatcgccatcgtcgccgttgcgtaccggtaatccgcactccctctccgtgctatggccgccgctattct

SEQ ID NO: 4890 - DNA, 14185 bp, Oryza sativa
ccgctgccgccgctgccgggtgccgtagctgagcatcgccgccgctgtcccgtgtcgccatcgctgttcagctgctgcccatagctcggtagttgagttgcttagccgctttagtacatgcgagtctctaccggcctattgtttgccataccgggtcattgccgcaaaccatgcttagttgccgactttgctgcagccgttcgctaagttgctttaggatcattcgcacgtagtattgccaaagctttagtccgttcggtcgttctgagtcgttctttagtttagagtcgttctgagctgccggttccgttcgccggtttggttgacggtcccgtgtcacgatgtgttggctggttgagtcactaatttgtgaggcttgcttactggtgatatatttccattgatctatttctctatgggcattaatatgtaataattgattaaggtttttcggttgttagtaattacacagctcatattgtaaaattcatatctaaataatctgagctccgttttaacccattcaagttgcagtgaattcattaaaatgtatagaatccattaaaattgatttcttttactatttcagtagccttattgcttgtatttcttgtataatttgtttgtcgtatagattccggtagttccggtgatccagcttattttgaagtggttgctgaggttccatctgttcaagagcaaggcaagtcatacatacaacattgaacatgttgaacctattttataaaatcccctgctttttattaaattgcattattttagaatgtcatgtgggatggatgcctatcgtcctcagcttgttgatatcttatgctattgataacttgggatataattgattagatgtttgttgtagaaatgcttagccatgcttagatcaattagttcacaatgtgattcattataatttagtccttaattatatgatgatgtacccccatggttattgtttaattaaactaaaatatgctttaatagtgggttgtggatgcgtggatttggaagtcatgcccatgacaattaaggaccgattctcgggaatccttggaagatataatcgtacttaccacatgccagcgtgggctccaggcttaatctagagtataatttaacctagctgacataccatggtaagggtagaggcgatggtgcagttcggacctggcttttggtcttcattgtttctggatttacctagaaataaaaggggactggccgacttggcataaggagggcgtgaaccctgaggtgggtatgttcggtaaggaagggttatatgacaggttttgtcacgattttcccatttgcagtatcgcggtggtacttcggggcatggtaacatgtgtggaatcgtcccatgtgggtaaagttgatgttgatggtcattatcgatcagtttcggcctcccgatattcctataacaaaggacaactagctatgcttgcaatgcatatttgttttaaaattaactatttccacttgcactaggattctaacatcttgtagagaatcaaccgcgaaacggagaagaattgacagcaaaatggacgatcaatcaatcgggcgctgtcgagaatcagacttatggatagatgggctagaacacaaaattgacacgactcacaaagggccaaaattcacaaactctgaagaaagaagaggtcaaagagcaggcctgccagaaactgggccggttgggctagcctagggttcgaccgacccagtgccagctctgttggattcagggttttgagggaacagtggacattcactcccaatgatggttggagggcgtttccgacctttccaaccgtcataaccgtcattcccagcctataaaaggccctcacctcattcctttcatcacacactcaagcaagaagctccaagctttctctcaagtttagtttagtattctattgctagtggaataggaatagaatagtttctttagtcctcggagtcctcgggagaattcgggtatggctatagtagctcttccttcttttgtaagacttatacaattattagaatattcttctaaatatatttacggtactttacttcactctgattttttgagtaccgactttctgatatattattcgagatataattgtctagctagcttacctaggagatgcactggtgtgggtataatgttcacttatatgattgttctatgtcatgacgatgattttagagtagtatttggtagcatacgtgaggtgcttaggctattgaatatcattattaggtgttatatgccgcgagacagtagaggtgggtcgctgatggtcacagctcagtacgggtattcctctacgttagtatataatcctaagttactttcctggggaggatactcctccgtatttagccccggttggatggccatgatgggttgtcgcaagaaactcggcaaccaggggtggtctctcgaaataccatgagggaattgtaaagggggtattggctatataattatatagtagataatattatctaaagttgtatgtattttagaagaataggaatagattcttttcttattcttttcctcttagcctagacttagtatttatgagagaatgagttattttgtttcgtgtcactctacccttgaattaaattaaccactgcttagactttgattatgacaagtaacatataaatattagcatatttctctttattataatcttcccacgggattaaacaaataagatacccttggaatacttctgagtgaaatgctacaatggtatatccgtgcgcttgcggatgtgatttataaccataatataccatgaatatttctgcgccattgctgggaattatatttctagtaatgtcgttaagaaaccaacagttataaacctctgatcagagttaaaactattcaaatagccgtgcccgcggtttttgggcggttaaccagctcaacgtgattagtctcactataataatttgacttattgaactggtgttgttcaggtggtttggttgggcctgttgcaacgtggtttagcgttggacagtgatattttaatattacttaattatatctactgttttacttattcaaattatgatttataaatgctgcttttattgcaaatatcctatggcctatcctttgcgaatatcttacatcataccttcccgttggtatgacttgttgagtacggtggttggtactcagtcttgctttatttttccccaccctagaagcagagattgattcagatggtgagttctataaggattgagcttgtttcggacattgaggatgcctgtggttctatggaggatgcttcgcttttggtcgtgaagattaagtccagtttagttgtttattttcgctgcgtttgtaagaattatttattatttttgtaagacgtggatctgtttatcaaattgtcgtttgcgtactccggctagtcttggacagagattttaatacacattctgcttgaaattttggtagcgaatttctgggcatgacaattaatcatccaagggggtgtctttcgcatgtgccatgaggggtgctaggccaaccctgggcctcccgttggattcgccaccgcatccacttatgtttaccatacatccacatgtgctatttatggggtggccttatccaattaagttatgtaatgtctagccttcctattgacctgtaaaggtagtagggttgtctagaggagctacttatttactcgctgagagtagtttaggtctctaagtttgtccaatacaatggtacaatgcctcatggggaaacatatgcttttgccgccactgcgttaggtttaaggcgtgggcctgccacctaatggctctaggttattcctagggtgaattcacatttgtcgtgctggtgcaaggctaggcattaggtctagtttaatgtaaaggctacattttaacctctagaccacattcaacgtgtagagtgtggttatgctgacgggtaccgaataaactagagcaattcacatcatgtggataaagctgtataaactcggcagaatctaaaactaatcgactaaccgcgctcacagtcagtgagtgacatagtgatgtgctgtgggtatagttttgtgttttataaatgcttttggaacttgatgatttgaaatgatgttgagtaacgtatatgatattgttgccttactaccggttgggtactaaggaatgatgctatatgacgttgccttactaccagttgggtagtaaggaatgacacttatttatttactagtaatcgtgcacgtgcaatgcacgttatgatcgttatttgattgaaccgtctatgtacatttatgtgtagaatgtttaaaacatttgatatctaattgtgcacagcagtgcttactattttctggaaaaaaaaagataatagtgatttgaagttctttttctatactaaccattaacccaaccgaagaacagcagggcaagatatatactatctttgaccaacgacaataaaagaacaatgggagacagatgacaaatatcactaccccaaacctttatgccccaaaatttgatcatatcggtcacgtcagttgccaggtgaagaaatatacattcaaagtttctattgcatgtaccaatttacaacaataagtaaataccatttgattggaacttgagcccaattaatcaactttgtataagtagttttgcaacttcatagtgttacaaataagcaagtgctaagcgtctaacaataaagaaacaaaaacccttaaatgatcatttcttaattcacacgatcctcgttttcaaacatttttcatgaacatgaaaaaaaaacaagaacaatactatatgggcaatcaaagctaaatatcaagaagtgttcatagttctcacaagctccatttattcttgaaggagtgtatccctgccattctgtcccaaaggaggcttaccttgctccaaaacagattcggcttaccaacttgtagttttcaccgaatcaccgtgttcaatgccgattacttcaaataatagaggttattcttcttaatctctggtcatggacgacaacttgcctctcgatcactgtcattgttggtggacactaccaattgaacaaaagactcccaatatcacttctgtcaatagtatagatccaaccatgtcagtgcacgaaccaacttcaaataccagaaatatattgaatatttccctaattagtttgcttcagcacctcaaaaccttccttcataatccacagttatgagccttcatgttggctatactggggatggaaattaaatttaagtcatgtacattagaagctacgaaaattattttgatcaacaaattacgattcctaaggatgacggtaactaaacttcttcaagataaggtggcaaatggagagatgattataaaatttatattcttgaagaaagctatatataacttaaaccaggtcataaaaaattctttattagcaaatatatactattctactccataatatattagatgtttcctactttggcatttcaatatagtttctttcagattgctgcatttatagctaaggaagacacaatgcaatgcaaatactaagagtgcacaaagtgagctggagacgtaaaatatcatctggtaagaaaacagagtatttggtaacttaatagtttcacattattccagtgataaaataaaggcattgtgtaaaaaccataaactaaagcatttaacaaagttaacaggaaaaaaatgttttccccaaacaagaaagtatcaatttggtatttagatccaaagcatgatcagatccttcgcatcaattcttcactttgtttgctaaactaatatgcatgaatcaatcttccctttgtttgttaaactaatataaatgcatcaccttacagactattattccttcaagcctcattactcatcattcctttctgttgactcttctcagtgcatatacacatgtagaaaaataaattgaccgagccaaggatcaatagcatgaatccaacaaattcatgccacagagctgtatatacagtttgccagtgttatgatgatccatatattcagatggaaactgagaactgaactaaattgaaaaattatgaacttgcctgtgaacaaattgtacaggcataatttaattcatttggaaacataattgcagcaaaaagaaaaatataatgacctctactttatgctcacttgctctacaaggggtaattgtttaaccagacaggaaaagcagaaattgggtgagacattttcttgaagttagcaacaccatatctttttatactcaatttaaatactttcataattccttctgaacagtaaaaaaaaagaaaggcaatactttgttgtacctgaagcctttggagtatgtattgtgatctcgaggttggtggacaccccaaagccatcacctctgaagctactaacagagccatctccagtatgtatatatctgtatctccaagttccatttccctgtaactcattggctgtgggcaattccttgcgtactaacagatacaagtgaggaaaaaaaattccaattcaaccagagaatagaaaacagccactctacaacgtggacaagtgcacaacaacaaattgaccgctcatttcagttgctggcacatcgtaataattgtgcacacccgagcgcaaggaaagcaaagcggtttctgtggttcttatcctcccaagacagtctcccaaagttccaatcatcaacatccaacttgtcataagtcataacagtagtagttgtagaatgcgagggaagcatttcagtgcatgtcatgcattgggtaatttcatcgaccatcttgtgtgcataaagaaaagatttaacacctgattagcatcagaaatatatgcagagagattgcattagtaaaaaaaaaacagctttcaacaatctcctcataggtaaaaaaagaacagaaatctgtcaccatgcctgttgtttccgcaagattgccagcatctctggtcggctaaaaattaccaccgacatctcacgttcttagctggagagctgcattacaatagcccatggttagcattaccaatatagcataaatctcatagcagtcgaccacaaacaaatcaaagaaatttaatgactcacatgagttggccggtggtttgttgacggagagcaggtgttgacaggaggagctgcgacgacgaagattgagtgtgtggccaactggccatggagattgagggtgcattggtggcgcagatgagaagatggctggttcagttggagaagtgctccatagcgctagccacgcacggtatggagaagaggggacattgatctgtcattcacggaggagaaggggatcgagatggagttaccggtgcacggaaggggatcatcaggggatgaaatgcgtggtctcgtgtcgcgagagccgagaggaaaccgtcggccggagcttgggcgtgaatctaggggggtcgcgcggtgtccggcaaggaggtgccaatcgcggtgactcgcgacctgcggcaaggaggtgggaggaatagcggcgtccgtatcgtgccggcaccggtggtagcaccggagtcgttggtggaaggccggaggcgtagcggcgctggtccgggtctgcctggtggggtttggctgtttgcgatttgggatggcggcgctggtccggcggtgcggcggcgctggcccgtcgcgaggaaggaggatgcgtgcggagggaggagaagcgaggaggcggcggggaatcgcggggcggagtcagcgcggcggggatttgcgcgacgggtcatcgcgtgggtgcggaatcggtgcaatcggcgaggaggacaacggatggataagattagagtcgatcgtcgatggacgaatgagatgagaggggatgatttcacccgtaggattgctaggcacaactcctcctttttatattagcatagatgttaacaccatgctgtgatttatatgctttacatattgcaaatgtttactttaaatacgttgcaaaatatttgtgaatcaaaattggctttatgcgaaaattgagacaacatatagcctctctttgaattatagccttcatatatgtaggtttgattgtgcgctagctttgccagtacattaatgtactgactcatactttgttcatatatctttgtttagacttcactgcaagtagataagtgctcggtaccgtttgccagtttaggatggccctatctagtggtctacccctagtctgttgcttgtgggttaatttgggtagacatgcttccgatggacattaacatttggccggttggccctatgtatgtagctaagttatttgtctatatttgtatataagtaatgtctttatgtaattgataacttggcttagatgaaagtgcaaagatagcaattttctggggttagctgagcataagtaagaattttgggtaattgagatattatagaggtttagcaatttgagtcaagtgtcttgggatgtgtaatacatttggttgcctgtttatgtggtatgatgagcacgtttcaggctatagttggcatgctaaagactcaacaatgtctcccttgcccaatgttcggcattcgcagactttataccgaatggtgttaatttgtgatcatatgtaaatattaagaattcagtggctttttatccatgcatggattccactaatccaaaatcatgtgatggtcacaaatggcaccggacgatgtaaattcgacaatgctcgatatatctttagtcggataagctgtttatatggatatatgtctatatggatatatggtacccataatctccataatatgcaactttaattataatgttttgtaataattgattttcttctctgttttttttttcgttctgtgtagatgcttggcaaatcaagcataacccgccacaattttacacatgcggtgggatttttttttccgtctatctgacctttatggttcagtggctggtaatagcggctcaattttggagcaatatttttgtttttgacaaacatcgcaggagactatactttagatttatttttagcagcctctgcccttcagatagttctgctctttgaactatcgtatatgtagcaaagttcacatatttaccatctcataaatcatattcacaaagctactaaatcagattcacaagtctttggacaacccttcatacagaatgacacatttataattgatgcaagttccagtatattgaatatacaacttattttttcttgcacttatcggaggtttatacactaagtgactttttgaggtacatatttgtatatattgctttcacactgaacaataatcttctgatattaatattttggttccaaatggagcaagcgcatatgccatttacagagcattagatagagcatgcaactgcacatgtgtggcgacgaattttccaaatatgacagcaaaggcaggaaagccgtacagaagtgtatgaatttgcataagcaaagcagccggagtgctgaaccaagcgagtttgatgccctttgtgccgcaagtttgcagtttgatgcaccttttgattagtgcatttcctatgttttatactttatttatatgttgcatgcacatatcataagttgaaattgcacaaagttagtgcaagtttcacgtaattatagtgcaaatctgaatattttttcggttcggattatattatatgcaagacaacgacaacattaacttctgtaacagtttcatcgaatttgcccagtaagaacattaacccacggcccaacaaagattcacatctttgattctagatcggatgacacagatcgactgatggattgcaatttttttagcgactgacaattattctgtcccttaatatatgtatactccttgtgaaaaacaaaaccaatcaacatacatcgaatgatataacacaacgacagttcaaacccactatttattcgcacggtaataacctttcacaagaataaaagttggtgagagtaatgacatatgggcccactaatcctagatgtccttaaaaaaagataagagttggtagtggggtggtagcagaatcatcaccactactcctttttataaggagtatagatactcgtgaaaaaccaatctaccaacatacaacaatgatgcaacaccatgacaaaagttcataccctctatttatttgatgccacacacacggaaataacttttcgttaattatattcaactcgtaaatctttatgcaatattgtaagcggatgggagaagccttggtaccgggtgaaccaccaatggctctgccctttgcagcaggagggtaaacgcctcatccatattgagcttgtctggcgtctggtccgctggtagctgccagtcgaatgcatgcaccagcgtggccgctgtcatggtgaccatccgcaggccccaactgaggccggcgcatatccttcgccctgcaccgaatggtataagtccgaaatcatttcccttgacatccacatcagtgtgcgtcccaccggggaggaaccgagagggcttgtactctagtgggtcaggccatatggctgggtcacgggcgatcccccacacattgaccagcaactctgcacccttggggatacggtagcctgcgatctcacactcctcagatgccatgcgtggcagcgagagcggtgttgatggatgtagacggaatgtctccttgatgatagcatggaagaaggtgagatgtgatagatccgactctgagaggagcctatcacgacccacaacaacatctagctcctcttgggcgtgcttgaggatatctgggtgtcgaatcagctctgccattgtccactcaactatggttgatgttgtgtctgtgcccgccacgaatagattctgcatagtcagcagaaagacatatgacatcataggatgggtctatataaaaataactaaaatttaatatatgaaaaatggtatataataatatatttataatataaacacattcatgtggcaatgttttcaatatttttataaacatattattaaaaatgataatgtaacatgtattagtagtacttcaaagaggggcggacgggttcctgccttcccggtatggactggcagcatacccaaaatttgcaaaataattttaaaaagcagtatgcagcaataggcctaaatgatcggttggtgcctggtcacaataaataaataaatgccgaaatagagtgcaaggccccgctgcattgtctggactccaccagcacacgaatctatcgggcgtgcacgtgcgtgtatagggttttctctgtatctcatctctcgtcttgtggcacatgcgaagcggcgagcgctgcacaacgggcagtgagatggagtccagcgtagtggtgcagcccacgacacgcaggcacgctatggccgacggtagttgtcaccgccaaccagtcaagtagcaccaacatttactatataactgatctttttattgtggtatccaaaataaaaaatatcttggttggattaagaactggtataagattctttagtaccgattctaaaagtctaactccctagaaacagttttactcatggttaatgttactaatcggtactaaaaatacttctttagtaccggttggtatcaccaaccaaaaataatgctggaggatctttattctctgttggtaatactaacttggactaatgatatttttactaaagatgtctttacgattagattaaaaagaaagcatatttatctaagtcagatgtgtgtactaggtgggatggtaacgcacgtgaggattggggtgagagatcgtaagtttgagtcccacatcccacatatagttttttgacttggtatgcatctttagtacttgttatttcaaccggtactaaagatcgagatctttagtctcgatttgctggttacggctattataaccattatcctaaccagtatagggggtaatcaggcaagttagtaggctcgtagcacagctaattttctagcttttacaattttactttgtttggatgatgcatatttgtgaaatgtgaaatcaataagttacaatgaatcattaatgatggtgcgtgcaagcatttctaagcttaaaaaagtgtttcattaacattgtttcatttctttgtttgtgttatgtaagatatgatctacactactatcactgtttaaaatgaatggtgcttttaggactggaatgttctgtgttagaatgtaagaggcataaattctgatgatgggtggttggctattaggaataagatagaggaaagcggatgtgcatttttttttgtttacatgaaactaagagaagtaattttgatcattccttcattaggaagttcacccctaagcgttttgacaaatttgcttttttccccttctaggggtgcatttgggggtattttggtttgctgaaatagttatgtcttctctgttatgaatatcacaattgaaagttttgttgtccagctcacttttacttctaatgattctagtttatcttggacaatggttactatttatgagccctgtactggtgttgaaaggtctaatttttttggcttggctttatagtctccaaattcctgttggtgatttttggctgttgcttggtgattttaacttctatcgttcagttctaaatagaaataagccaggagcggatatgaatgatatttttctttttaatgaggtcatcagtaatttgggtttagtggaagtccctattaagggcatggcctttacctggagtaacatgcaaaatcaccctcaacttgagcaattggactggtttttcacttctactagttggtcttcctcttttcctaatactttattcaagcctttagctaggtcaacttctgatcataccgcctgtattgtgcagttgttattcctagatcaaatgtgttcaggtttgagaatttataggttgagcatgaaaggttttttgatttagtccaatctatttgggctaatcatggcagttttttggatgctgctagaaatatttcatctaaactcaaagctttaagaaaggggcttataaaatggagtaggaatctatgtaagcttcagaaactcatcacaaaatgtaatgttgtgatctttttttttttgatatcattgaggaatatagagatctcactgtgttggaatggaatttcagagtttttgtcagatctaagttgcttacatacttagaaatataagcaaacatactggaagaaaaggtgtactattagatgggctaaatttggaggggaaaacacaaattttttccatgcaatggcaactgaatcatacaggaagaattctatagctattttggttgatgtggatgggtcaaccctctctgatcatgaggctaaagcccatactgcttggaatgcttttaagatgaggatgggaatttcttgttttgaatgtatgccttttgatctcccttctttaatcccttcacaagacggtttggaaatcctggatgcccccttttctaagaatgaggttgataagcttattaagaatctccctattgatagagctcctgattcggatggttttaatggcctttttattaagaaatgctggcccattatatgtcaagattattataaattatgcgctgattttcattgaggctctctagacttgaatcctttgaatcactctttcatcactttggtgcctaaaaaattgtgtcctgagactataaatcactataggcctatttctcttatggggatttctctgaagattttgacgaagttgttggctggcagattgcagatggtaatcctatcagtaatacatccaaatcaatatagttttataaaagggagaactattcaggattgccttgcttggaattttgagtttcttcatcaatgtcaccactcaagaagggaaatcgttcttttaaagttggactttgagaaagcctttgatactattgaacatgaagctattttgttggtgatgaaagctatggggtttttagaaaatggttaaactggattcagaagatcttttcttctgcttctcttcagttcttctgaatggagttcctagaaagaattttcattgtaggcggggggggg

SEQ ID NO: 4891 - DNA, 627 bp, Oryza sativa
caaaatcaagagcgcaagctctcaacatatcttccaagatttgattgactcgctcggtctgaccatcagtttgcgggtgataggccgtgctgaaatttaaacgggtccccaattcttcttgtagtttctgccagaactttgaagtgaactgactccctcgatcagatacaatctttttgggtaccccatgtagacacatgattctcgagaggtagagctccgccaaccttttgcccgtatacgtggtatgtactggtatgaagtgagcaaccttagtgagtcgatccacgactacccagattgaatcgtgacccgatgatgtccggggcagtcctgttataaagtccattccaatctcctcccatttccattccgggatttgaagaggttggagtaaacctgctggtctttggtgctctgccttcacccgttggcaaacatcgcagagtgcgacgaattcagctatttctctcctcatgctgacccaccagaatttctctttgaggtcctggtacattttagtactgccgggatgaattgaatactgggtctgatgagcctcggtgagtatcagatcttcagttccttgtcgtcaggtacacacaatctttctcccatccagattgt

SEQ ID NO: 4892 - DNA, 1035 bp, Oryza sativa
taacttcacagtatcaccacttgtcacaaggaagaacacaaaatgatgaaccgggggcacagcatagctgtttacatgggcttaaaagagcattacatttccatcttttattcaacttcaaattggaaccaaactggattcactggtctaaaaggcaacagccctagtctttacaatgcgaggttaggttttcatataaggaattaagattaaaacataaaaattgctgattcattgcagtacacgtccaatcatccatggatgaacggaataatagagatggattcctattgctcccatcaaccttgcctgctatcgaagaaatggataatcagtacaacgttctcatatgtacagttgcgcatcacgttgacctgtcaatcttcccaatggtgttctgtcttgcgttccgtagaatggccttatcagcagtgatgaagaagccagcgatgcatgctgtaaaataaacaggaagacatgtaaggtttccagtgtggtcttcaattcaattttgttctgcacatgaatgccaatataagaaaatggggtcataaagtctgtattgaaaagaaactacagaaacagaatctagtagtgaaagctagattgttatatgcctaaacttaaaataatggtcagaatcataacaacatgttaacttccacggttccatactgcgtatatcctcgtagctagttgctactgtgcatatccttgtgaggcaaatgctaccaaagctcattggaacaagctgaaatcattcaatgtcattaacagggataaatccactcaaaacaactgctaaagttagtgattatcatatgcgactcatgaattaggacatattgaacataagaatgttaaaagatgcaagtggtcgctaatcagtaattgctcaggtacttcacttcaacagacagaaatactggcaagcttcatttactgtcagtagtcagtagtcaatactaagcagaatatctgtgcagcatcctgttcagtactaaaatttaatgggaatcctatcctagaatctga

SEQ ID NO: 4893 - DNA, 446 bp, Oryza sativa
tccccttgtatgtgtcccatggagtcgatgaataccatgactaacatatggtttgatacccattttttgctcatatgtttgtgtttgtttcacagctcaagttgggtgacatagtaatctctcttgacactgcacaacgcaaagcgtaagaaaggggccatacactgcatcatgagataagaattctcatggtttgtttcgctcatttcaagcatcactttttattatgattattttggtgtaatgtggtgatccggtgcattttcatcatcttattttatttcctaattcccaatttcggagtagattgtaatcctattcaatgctaacgagctccaacaggtgcacggattattgcatttattgggctttgatcatgagctcagcaaagtggctggagaagagatggagaccggggaagaacatatcttagattctctagattg

SEQ ID NO: 4894 - DNA, 590 bp, Oryza sativa
aggggtccactgtatcaggcaacaactgtgcagcagttgccactattggtttggttgatgaaacaagttgacctggctgcttgatgcccaatgttgaaaatgatccaattcaaacaattttagagcaggcgcttcagtaaagtgtggttgagaagtatgaaagagaactagaaggaattgaaagcttggcaagtagcaactgtactgaattcatggaggttccagaagtggtcgctggaccgatccttactgagaatggtgatatacgcttaagtggacatgaagtgatctgaattggccttccagatggaggttttgctttctgtgcactcactctgtactgtgcttatcctttcatttcgttctgcttaaattgactgacctataaatatgaatatggtgttggattggtttgcaaagatcttttcaggtgtggatccggatgcatcccaggtttgaaagcattcttgaggcatgtcttgtactctcacccttcaaatttaacatttaaaatgttctttttgtctatccggtgttgtttggcaccttctctgccatggaagagctcgtctgtcatgaactgagcaatt

SEQ ID NO: 4895 - DNA, 184 bp, Oryza sativa
ctcggatctattttcttgagaattaaagcttcctcggctgctttgaagatcagatgcagtgggtccatagctagaataaatagcataggagaaagtgggtctccttgtcttaaaactctcttatgtaaaattgggttaccggggcatccatttaggaggattctagaggaagaacttcctaata

SEQ ID NO: 4896 - DNA, 7476 bp, Oryza sativa
atcctggaattaaattaagcccactatgtggctgcaggaaaatataacaaaaataaatcgtcgatcggtaaatttattgcttcgaaattaaacaatatacaataggatgcctctagaaacataagcaacttgcatcaaaaaatgttgagttcatcgatcatgacacataaacgtacaagttaagcattaaacacacgagcacaaacaaaaataaatattattgttagcacatactccctccatcccataaaaacgaatctattatcggatgcgacatgttctaatactataaatctagacaaatgtatgttcagattcgtagtattaggatgtgtcacatccgataataggttggttttttatgggatgaagggagtacttcctctgtaaaaaaacaaaccctagcatatcaaaaataatttaggaaagagacaaaaaaaactataatatccttaataaatgtaaaagttgtattgattaatatgtaggtgagaagtattgaaataataaaatttctcgatttacggattggtggtaggtaagacggtagaagttgatttattttgggacaaatttaaactctaggagttgatttattttgggacggagtgagtatattttcctctggcggtttcaaaacaaaaaaattcctctggtagatggtgcacacattaacaagtatagatatatccatcgctgtgaattattttgagtgtgattctaagcaacttgcatctaaaaaattgagtttatcatgacaatggcagatatctgatcattccataattatgtatatactgtataaaaaaatccccatatttttttaataatttcgtaccattagtgaatcctagtagtttctagaaagaaccacatgattcaacgatatatacattgctctcgttgaatacgattattatattttattagttgctacatgcattatcaccttctgcattaacgtacactttggacgtgtacttattacttaatctactcattgagcagtagtaatatacacccgtacgtgcaacttataattaagataatctcgtttcatgcggtagtttcacacaaggagaatactgctacaaagtcaaaaaactactttaatttacaatttggtcagattccagctagtttttacttaactggtccatcgaatctgccgcaaataaaggatgtattttgtagggggaaaaataaaggacatattttgaccatgccgtgtttcatgatgtatatatatgaacttgcagttttcaagataataaaaattaagttcgcagtatttaaaacatttcagcaagtttcataacttcaaacttcagtagcctgcatgcatgcaattaatctcgcaaatgatcgatcaatcgagcgtgctgttttagggctggtttggtttgaggcctaaattaggcttaccaatatttgacaatttcaatagtgttcagtatctatttggtttgaagccaaattttgacatgtctaaaaaaatagaccattttcaatagtgaatttaggctattttggcttcaatctaaacataactttgccttaccaaaattagtcatgccaaaacttaccaaaatttagcattgacaaaatttggtaagacctatttaggccacaaaccaaaccaacccttatctgccgtcagatgtcctcgcgattcgtgctattacggccccgatgctctcttctttctccggcaccctcggctcgtgatgaggtcagacaaggtggcagggggtgattgtcaaaaggcccagtgggacccacatgcagagacactcaagcaatgatcaatgctgacatgtctatctcgcaacactacagtgatgtagaaacgataaattggagaaggtacgaattaccccctcgaacaatcgtggtcgtctgaattacccccctaaaccacaaaaccagacattcttcatcctcaactatgcaaaccggacgaattaccccctcaacccaatacacggtggttttggtctacgtggcgtacacgtggcagtctagtcagtgttttttaattaaaaaattgtaggacccgcatgtaattctcttattcctctctctctcgcgcagcgcgcacggcgaggatgagcgcggggacgggcggtcggcaagaggctgcgccgcgtcggcaagaaggctctggctgccgaggtggatctagacgagggccacgcggcggaagagcgcgatgatggtgcggtggtgctcggcgcgttgagcgagaggtagcaggcgaggaggtcttgcaggtcctccaacggccggacgccattggtgcacaacatctcgatcatgctgtccaccagctccggctccgtcaactccatcaccaccgcctcgctctcgtgcagccacatccgtcgccgccgcggccgtcggctcggcttccccatgcttactgacgacgacgacgccggcaccggcgccggcactggtgtgccggcattgttgctgttgtggccaccgccgttgctgccgacgcgcgcgcggcagccgacccgagctccatgcctcatcaccgagctcgcctttggatctggggtggtggagcgggattggtgagtagaaggggctggtggagcgggattcccggtcgccatccatgcctgcgtcctcgatggaaccgcgtccgccagtctccgtcgccgatcctggcgcagggaggtgggatggggcgcggcacgaccgctcggaggaggagccgcggtggcggcggtgtcccaccgcgcgtccctgcgcgccactgccaaggaggagcccgctgcccaccatgcgtcctagcacccccacgatgaggagaaggagcctacggtggcagcggtgtcccaccgcgcaccacgcgtccccacgcgccaccggcgagtaggagcccactgcccaccgcgcgtccccgtgcgcccacgacaaggaggaggagcccgccgcccaccgcgtgtccccgtgcgcccggttggcctccgcttccttcgccggctgccgtcgtcctcgggccccctccgccacccacaactggctctgccccccgcgcaccgccgccgtcctcacctcgccaatcgaatcaacgatgcctccgcctctgccttcgcgccgacgtccgcgccgccacgctcgcctcacctcgctgaccgctcacgccgaccgcccgtccccgcgctcgtcctcgccgtgcgcgctgcgtgagagagaaaagagcgagagagagataatagagagagaggaagaagagtatgactggcgtgccccacaatttttttattaaaaaaacgctgactggactgccacgtgtacgccatgtagaccaaaaccactgtcgattgggtcaagggggtaattcgtccggtttacatagttggggttgaaaaatatccgattttgtggttcaggaggtaattcggatgaccgcaatagttcagggggtaattgatactttttccttaatataaagttagggcacgaaagaaaaagacaataacacatgattatgattaattgagttttagttactataaatttgaaaaaagaatttatttgatattttgaaacaactcctatataaaataatctcacgtaaaatatgtcttaacagtttttaaaaatatgctagtaataaaaatcgagctaaaatctgcaggttaatcaccaccgtacgtgctcaatgcatcaaatgaatcgcatgaacgagtctaccttaaaacaagaagaaaaaaatacagagagggccacttaataacgtgattagcaccggattaattactgcattcccagctaatgacgcatctggtggctcagctaatcacgtgattagcccttgccaatctcgtacatcctgcgtgccagctcatcgcatctcgaactggcactggcagctcatctatcttcccgcgaattgtgcgaagaactgggccgggctcatgccctttggcccattaggcctttctccttacagcaaaagtttaatagtagaactcaccacttactacaaatccatggtatacctaacctgtataacaggtttgctagtataaggttagctctatttttttttcttttctctctttctcacactataaattaaatgcatatttttgaagcatgtctagagctaactcttatatgagagccaacactctcatttttctttatctatcttacacacaagcatataacttatttataagtcactattatctttataattatatcgtctatgtaaaatgtgtgtcagtatgtgtgtgtgagagagtgtggtagcacggaatcctgcgcaagtaaaaattaggtggatttattttgttgctttgctagacttaaaatgctaagtattactttcgtctcaaaataaaattatttttcacccatcttacacataccaatacaaaacaaaaaaaaaagaaatacccttataatcaaatcccactacaactattactcaatttatctactcccaatacaattattattttttactttcacaaactctgatacaatgattacttaaaaagaacttatttttgtgataattgaaagaaactaaaaattaacttattacggaacagaggaagcaacaatttgcatatagatcaattatccagcggatagaaacgaaacagatgagatggcagagcttattattataaattttattagtagagagtgtgtgtgagttacaccatgcatatttaatcatccaaagtttagaaaaaaaaattaagatagcatactcgtgccatttcgaaaccttgagggttaaaaccacgcaactcttaccactacactatcaattgcatcttcaaatacaactacctttatatatgaattaggatgagtagatttatgggagaatatctaatatggtccctaaagtttcacttctgggtcattttagtccttaatctttcatattgttcaaacaagtcctttaaatttgttatgtgggctaatatagtgcttggtctcaccaaaacgccacatggacatgccatgtcaccttcctatgcaaaatctatatgatttgtccaatttacccttacgcatagaaaaataaaaaacaaaaggaaaattttttaaaaaaatatatggtatatgtaatagcaaaaatatacctcaaaagggtgaaaaaagaagtatttttttcctatggttatgtctaattcaccattatatttatttttctatgatatatataagggtaaattggacagttcatcatagattttgcatgaatgatgacatggcatatccatatgatgattttggtggatccaagaactattctaggctttatgacaaaggttaaggatttctttggaccatttaaaaggttaggaactaaactgatcctacagagaaactttaggactaaagcagctattctccctagatttgtaaagtaagctaagaaaattcaatagcattaaataaatacacttagtatgaagacttttggataagacattgcccctattattcttaacagaccactatgttttaatggtagcgggtatcttactaccaccgttaccaaacttaccaccgctatttaagtactagaacttaaaatggatctacagaggccaggaagaataaagaggggaggtagccaacaacaaggagacaatagtcacaagacggtgctcatcagtgtaccgtgatgcagactgaggatgaatcacatccccgttgtatttggacccatatatatgtgaacaaatgtactctccattcgacgacactggtagtacactatacataaaacatgggtgaccatgccatcctatcctcctcctgctgctgcatgacatgagccgtcagctcagaacacaacgctaacaatattcctgcacggccaagtggcatcacatccctctactgcaccttcagttggcagacattattatatcgttcagatttttgggtctttcttttgccattgtttggcacctttttttaggggaaaaaaaacctagaaatcgatctatattatgcatacagtaaatatccgtgatattattatttatccgtaaataaagagatttgcttcggtcaaaaaaaatacctcgttgtacttatcttgatgttcgttttgctggaccagagtaaatctcgtaaataaaacactaagccggcctcttctcatcatctttagacactacggtttaaatggatatggatcctccacggtattgtaggagtatttaaagtcaatgagatgggagcttagacgatacaagtaagcccacgtatcagtggctctcattaccctaatagtattgtaaagagtccttcatgaagatcatgaaatcagtttcacaggattttatagttcgatatcaacaggaaccatactatgttccagacaggctaacagggtctattgctaaatgaatccctggtatttttgctccaatgaactgtcaactctaacacgcattacgagtgggatgtttgcttgagacatgagaaccacgtttgtggcattcacctttaaccaagttagcctaggtccacatcggttgtccatattctctaataaactaaaacagcttataggggaataaaaagtaatttataggtaaaatttttatatatgtgttattagcgacttaaaaaccaatgctgaaaaaaaactatgttgaaaatatcttaaaatcaactgcaaaactaaatttgaaaatttaaattttagcttttgctttagcttgttagggtaaccgatggggctcgttgtatttggctgttaccccactttactataatttgccacatgtgtggccacgtaaatgcatgaattgccgcactctgccaaaacttttgttgtaaagtgagaatatcatcaaaacaacatttaaaattgttgttccctccatgctaaaatataaatagttcagaattttttcatgcgagaactaaagagaggggtgtttataattggttaaaataagaaagtagatgggcaacatataatggggaaattacacatgtatcgagtaattcccatggttttattctccgtaggattaatattgcaatcatgtatttttttggattcttattcttttttggattcatataattcaaagaagacctaaataccaaaagttgctatactttgaatggaggtagcacggttcatagggccgaaaccgaaaacatcacatgtgctctcatgtggcgatccgtggacgaaacctggaacaagaaatactccagctagctagagcctagatgttcaggtagctggattcagtgctgcaaatgcagataaaccagcaccacatttttgtaccttggcaatcccaaatccattcaaatttcacttcatagatgcatgattacccgatggatccatgctaaagaggtcatcctcccattcgcgctagctccagaaatactttactgctccccttaaaaaatattccctccgtcccataatataagggattttgagttttt

SEQ ID NO: 4897 - DNA, 4433 bp, Oryza sativa
  unsure (1)..(4433): unsure at all n locations
tggtcaaacagttcaaacaaaaacttaaaatcccttataatataggacggagggagtataaggatttctagaatttaaattttataccataatataaatgtatttttgtgctaattccaatgaatcccatcatttcaatgattccatagccaatcaaatgcacaatgtgaaaatatgagcggatcttaggacatcaacaatgtgaaaatatgagcggatcttgagcccctaagacgtacgcaattcaaaaaaaaaaattgccaacctcagaactatttactaaatagcctaaatatccttataatttggaactgaggtagtactaacaacaatcaatcccaaattttttaactgatttttttactgcagcctactcaactgaaaactcagcaattcgcatcgatctcccaatgaggtgctcatgatctaccgcgaaatgcgatcactgcaccggcagcttttatatatactgaaaccatcgaattaaactgagttacaattggtgatcgataaatagatcaatggcattgattgatcttaatccgcagctaacatcgccatcaaaccaagccaaagctctaactggttaactgaccacatcttggctgttcatatgctccattgctagagcttgatttccagcaccaccacccgagctcctcttcagctcctcgcacatctcctcgatcattggcttccatagccgaactcgagcgtttatgaaccaattcgacacctaccatcgccgcgcaaatcgaccgaatcagccacggaaaatcaaaaaaatcatgctaaaatgtagtacaacaaatgtgttttcagataatataattcagccaagaacatgatcactgggtctatgatttatcatctttgcagttttgtttcgtcgaaaatgcggagaagcgtttggtttacgaatcatttttgtttgacaaaagtttggaaatgagttgtatatagtactcccttcgtttctaaatatttgacaccgtttactttttaaaacatgtttgaccgttctttttattcaaaaaattaaataattattaattttttcctatcatttgatttgttgttaaatatatttttatgtacacatatagttttacatatttcataaaaatttttgaataagacgaacggttaaacatgttttaaaaagttaacggcgttaaatatttagaaagggagtattacctggttcctgctgaggccgctccttgctgcgagcatctccttctcgctgtctttcggatacctgacgcaagaacaccaaaaatgaatcgaatcagattgtttgatgaaggtgttcgatcaaatgcgtgatgtggcaagatcggcgtcaatggcggcgtgggtggtgcttacgggcggaggaagttctcgaacatccaggccttgaggacggcgacggacttctccgggaggccgcgctgcggccgccagcactgctgctcgccgcgccgcagctgctgcaccgcccagtgcttctggatgaacgccgactcccagctccgctccctctcgccgccggtcaccgccgacgacgactcgccgccgcggcaaggcctgccggccgcggcggcggcggacatgatctcgccggcaatgcggcgcctcaggccgtggtacattgccgacacggcgcggtgcgcgaacggcgcgcagatgctgctgctgctcatcccggcggcgcgcgccgtggcgtgcgtcagggtgttgaacctcgccgtcgtgctctggatctcgtcgaggcattggttgtacttctgatccatctgcgcatttgaattcgtatcgtcgtcaaaagatggtttcaaatttgattcgaaatggtagtacgaaatttgcttgaactgatgcctcgggagtcgtgtggagaagggcgagctcaccagctggagcatggtgaggagctcgctcctgagccgctgagccgaagcgtcgccgccgccgtgcgtgtgctcgccggaggaggcgatgagctggttgttggagctcacggcggacgacggcgcgccgccggccaccgagcagctcgacggcctcgagctgccgctgtcgacgccgctggccgagtcggcggcggcgtccgcgacgccggccagcacgcagccgacggcgtcgttgagcacctgctgcgccaccgcggcgtatcgggaccgcgccaccaccacggcgaagttcgccgccgggtagtacggtacgagcggcggctcgggctccaccaccaccaccctgctcatttgcgtcagcccggaacggctcgccgccgacgagcactggtcgccgccggcgttgagcatgctgtccgaggacgacttggagcacaggctcagcgacagctcgctcgccgccgccgccgcggacacgaagccggcagcctccggcaccccggcgaggtaatacgaaccaccgtgcacaccggcgttgctgctgctccagttgcagctcggcttcctcgccgacgtcgagcaccaccccgccgccatgtcgcccggctggccgtggccgaggcacgcgaggctcaccgcgccgccggagctgtcgccgacggcgacgtcgtacccgccccccatctcctcctccggcggcgtcgtcgcgccgaggtagtcgccatgcccgtgcgccgccgccgccggcgcggcgccgaacagctgggtcgccagggacgcgagcacgaggttgttcgccgccgcgaagtgcgcgccgacgtccatcgccgccgccgccgcgtcgccgtagccgaagctcccgccgtgatcatgcggcggcgccatggccggatggaacagcggcacgtcggcgccattgccgctcgccgccatgaagtagccgccgttcatggcggcgtccaccgcaccgagctgcgagaacgatggattgccgctcatggccgcctcggaaatctccaagaattgcagaaactagtgataataatcaaaacctgagaagaagaagaagaacagcagcagcacacacgcatcagacattcagacacactgttcttcacgagatttttgttgttcttttgacaaatcaggcttgtactaggtgtacccttgaaatcaaagtttttgatcttttcatctactaccacttttagtttttaccttcacagtagcaaaagaatcaacagtacaagccacaaatagatcctcacagaattgttccattggaacaaaaagagattcaatcttgcaactaacatacaactgatcttccaacttttaaaacaagaatcttttctttttctgttctcatttgataaattcataaaataccagatgaactgatgcatggtgaataacacaatgcatcacaaagatgaacaaaaggagctgataccagaggtagaaaccaagaagacagtgaagcttgagttgttgagcacacttgcaggacctaaaatggaaagatgaagccttccaaaacccaaagagaccagcttccagcttctacttctactaggaacaaggaaacaattggggcagggagaagtgttatcaacttatcactcactcactacaagtagtatcaggtaggcctaatgaccaccaaagagaaagggaaagggaaaaaaccaatgcaaacatctcaaggccagcaagggagcagctctccctgaccttgacactgggtcagaaaattttttggccttggaggagaggctatcaaagaaccaatgggccctactcaggaggcaaagtgccaatgacaaggtgttggtgcccatacacaactagtagtagctcactcattatactactgtaggagtattatagatgccgagtgattcactatccgattaaaaccatttataaaccgataaaatatagataaatcttgacaaaaatttaaatttagtttgaaaattttaaacttgaccaaaagaccgagtagtttgtagctttctgacctggtcaagaaagtttggatttcaccggttttcatcggttttctaaacacagggcatacacctatggcttattactacttcctctgtttcataaaagataagataagacattttatagcataatgaatctaaacatacccaacatcacatctcatcttagataggagtagattttttatgggacagtgtaaaggaggagtggtgacaaaagcatatgggatttatcacctaatgattggtcactggggaggcaaaccataggctcattggtcagttatcctaatccaaaatacaacattgcattataaaaatgtggatcatgcatgtgcctaaaatctactaaatgactgtcccaccactcatcctttactacagttaaacaggtgctggcattgagagacactcaaacaagcaaggtaggtttcgcttaaactaatcaaaatccattcatggaaggaannnnnnnnnnnnnnnnnnnnnnnnnnnnnnnnnnnnnnnnnnnnnnnnnnnn

SEQ ID NO: 4898 - DNA, 632 bp, Oryza sativa
ctggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacaaaaagtacgtatcttaagcattgtaggaaggttgtatacatgggtcatcgtcgattccttgcagcaaaccacccggtacggaagaaaggcaagcacttcgaacataatgccgaccaccgtacgaatcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaa

SEQ ID NO: 4899 - DNA, 1102 bp, Oryza sativa
acctttacggccagagccaactcggcctgctgtttgttgccccagaggaggacaacatggagacgatcgtcgcgcatgatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcgggccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttccttttcattgggcacgggcacatccaaggctacatccgtatctgaaagatggagggaatcaaaatagagaataagatgatgctggacgataaggtacgaccttaaatggaatttagatagcatcaaatgcttcaaagcaaccgaaccgccgccagccattctccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttct

SEQ ID NO: 4900 - DNA, 1495 bp, Oryza sativa
cttacaacgatggaaagttcatttgtaataatcattttactacctcaataggaaaaacaaaacatagagcgagcttttatagcctgaggctgtgtttagttcagcgcaaagtttggattttggttgaaattggagatgatgtgactgaaaagttgtgtgtgtatgacaggttgatgtgatggaaaaggactgaagtttggatccaaactttggatctaaacacagcctaaatgtgaaactaattctgtgagtagatgaggttctgtgataattttcttgagcataagtgcacgttttgatgttctctatctgcattttcttgtatgctttccccttttgtgcagataaataactggcaagatattggaatgcctaagaatggtacaaaactaagagcaagaactttcggtgccaatacaacactgccagcctttggtcatgaaaacattagagaatcaacttagacatcaccatgtacgttgttattagtaccatcaacatcctaattaactcatcttaattagctggcactacaatactatatttttctgagatatgttatctctgttctacagaatttaattattgttgtatagtgactgctttcatttgttgcagatcttacaggtgggcttaaagtatataataaacaaagtggaacaagtcatgaatgtcatgcctaattgttgttgttttaaccaggcaacaaactcaggaaatcgagatgcacacttcaaatgatctggtagaaatccccaccttaaatcctttatactctacaaaccacaactatctttaatcatttgttgcccttattttgcttatatctacacatggccatggtgcttcatgtttattttctgaaaatgccaacaccaaagattttgaagcacacaactgacaaagtggacatgctacaacaatttctacaacaagaagcaccatttatagaacaaaatgcagtacacatgtatgttgattgcagtgctaggagtgcagtaaatttttttacatgggtgtattttttgcaatgatggatgttaataattgagggatatgatgagttagatgatataaacaaggcacaatgaatgaattgaggccatcctgatgttgggttgcacatgtattatattttattggatttctccttttatgcactatgtacaatagttggtcagagaggaaaggctagagctagaagactttttcactttctttttttccctctaaatatgggctgttagacagagttttactaactgatagcaataacaacactcctctgaaaataagagagatgtgttcctctgtttgctagatgctactggccagcctaatggtaattgattaattccatgcagcaccatatttatcttgtatgtgacagtttataatatactgcattgcatttgtccacagtttgatcatgcagagttataaaaaaggtggcgtggtggtcttgcataggtgggtttcaaagtttctatatcag

SEQ ID NO: 4901 - DNA, 3636 bp, Oryza sativa
cgactaaaatagtattataacatatcttatagtgaaaaaaaaaagcttatactccccccgttttttaatagatgatgccgttgactttttctcacacgtttgatcattcgtcttattcaaaaaatttacgttattataatttattttgttaggagttgttttatcattcataatactttaagtgtgatttatatcttatacatttgcataaaaaattttaataagacgaatggtcaaacatgtgagaaaagtcaacggcgtcatctattaaaaaacggaggtagtatattaaaactctaaaatcaaaatagttctttatttgtcaccctagttgatggcttgacgccattgcaaaaccaaaatagtcttctagttatcattcgcaaccatgaatggatcgcggggactttggggctgtttggttcgtgtcctaggggccacgcctgagaaaaacttacgccgaataggcagcgttgggagatgtaacacttgcctcatcaggcagcctgaagctttgtgtgtttggttcgcacacatgcctgaagaataataaaatatcaaaaagcaacttttaccagagcaaagtatggaataaatgacacatgcatcattaagagtagctgactgaagctcaggcgtccaaattcgatggcctggctcaggctaatgaagttgcctgaggatttagcaagctaatgaagagtcaggtcaggctagctcaggatataacagcgcacaaaccaaacacatagttgttggagctcaggcggcgctccggccaggcatacaagcatcaagacgcgaaccaaacagccccttcctccctataaaagcagaccaagaggagttggtctcattttcttggtaacaacaaccacaatactccatttgtcctataatataaggtattgtgttattttttagaaaaatgaagtaagtgctttggtttagtgctaaatcttgccctaccaaattgtttgtacatgtgtaatgtttaaattgattccaaaacttgccaaatcaatagaaatatgtcctaaaatattggtagttccaaaaattatctaaaacttggcactaggtaaggtggcaatccaaatatgctcacagtaaaaggatatgtcctcgaaaaaagtaaaaggatatgtgatgttacaaaatgtgttaggtgaataaataaaatactagtaaaatagtgatagatgtgaaataaacagtataaagatgataggtgggggagtaaagtactagtatcttaggaccttagagcaagtagaataaaagaattgagtaggctataatatctccaccatgataaaaatgatgagccggagagaataagaagagagaacttgagagggcgatcatattagcgtcgactgtatttagcctttgagactaggtgagaccattgtaattggctaaacttagcacatgtcggtggatctggatcatctaatttactaaaggaacgttacatgcgtgcagttatgctatatttgccatccattttcatctgacagctcctgctggctctcctccttgttcatatgtacaaaagaacttctgacaacattattggatttaggttaaatcatttagcatcatctaccgtgaagtgcgaataaaattacatcacgatattgtcccaaagaaaaggcagcattttggttcatgtacaaaagaacttaaaaaattaatcagtgtaatttaaaattagattaaaaaaacctctaagccaattctaaaattaagctctaaaatttaaaatagatttcctctttgtaatgttactggtgatatttattttgacaagtgcttttatttgtaagtttgatttacaagtgctttcatatgtatgtttgttttaagacaataatcacaggctacaattaaattttaactattaatattatattttataaatattaatattagttttacccgttacaacgcgcatgagcaatactactagtattaaataaaatacaaccattaaccctgaaaaagaaagtacaactacaaattggccctaatttgttaatctcggggtaggaaaaccaaacaaactctaatccccctgttgcaattccaaatccccgaatttgcatcgccattcgcacatgccacaacatgtgtagcactagtacaccggtagacgtgacgtgagcaatgagcttttcggccgtcgcgtgcgcgagccgccggctgctatgcctatgctagctaacccaagtcgagtagtagtagcaaagtccgacccgttcacaccatcaccatcaccatcaccaaatcgatctaaaaatactcgccttcttctccacccgagccgagcagagcagcgaagagggcagcgaagtcgccgacgaggaggaggagaaggagccatggccgccaggagcttccaggcccggtcccccaaggaggagtccgacgccgccgtccatggtaatcaaatcccatcccactcaccaagctccgaaatccccatccatggtagcgggatttcatcttcttgcgcggaggaggaggagggatgaggtttagatgtagtagtagtaggaaggacggtgtgagatttcttgggagaaagagagagagagagagagagagatcagatcactccccttgattgggggtttttgggttcgccgcgttgtcttcccaagctgtttatagtggctatctgatgatcatggttcaattcggctctgtttatctaaggcttcccacttctgggtgcctcaaacacaaattcacttgtgatgttgctagattgtgtgtgatatatggtatgcattgttggttgaggagaaggcaatgtataatgtatgtagtgtgcgtaatggttcggtgaagtaagctgcctgagttccgaattccgattcatgtatgcgcggttgcgcacaatgccagtatggttgatttctttgtgttctgttcattgcagaggcagtcacgctgggattgaagaacgcagccatatctggtaccgtggttgcggtccccacggtatgtactagctgtttgtcatgccaatgttatgtagtttcattctttagatcaatagtatatagtttcaagtgcaatttcttcctagaagaaacatatgtacgttggccacacattatgttttttttttcccacctttacaaatcattgtttccatcaagtgtttgcatcttcgtttcaagtatcaataataatgacggaaatggaaatctagtctaaattactactactaatttattacaatctggctcaatacctggtcatatgttggaacactttgattcatctggctgcatatattctgacatctgcaaaaataacatttctgctgcagttggttggttgccgtgtccttccttgggctaaggctaatctcaactacaccgcacaagcactcatcatatcagcaggtacggtttactatactactgaaagttatcatttttcaaattgtattatactagttattatgaccgaagacctactataaagtgctaacatctcgtagaacttattttactggtaccttggatattgggctaaacctaatggagccaatgtcactattttaacttgctggatatatactgttttactccctccgtttcgaaatgtttgacgccg

SEQ ID NO: 4902 - DNA, 6686 bp, Oryza sativa
catataattttacatatctcacaaaagtttttgaataagacaaatggtcaaacatgtgctaaaaagtcaacggtgtcaaacatttcgaaacggagggagtacaatacagatttggcgtatttcttaggatttaggacatgcatgatttggcttgtttctcatgcatgatttggcttgtttcttgggacatgcaagaaattagacctttataaaatgtaaagtcaagtctaaggttgattgtgttactgtattgcacttcaagcatttcattatcaggttctagggaaaatgaaaaatggtgctggctcaagtttaactggtgtcaccagctcacagcctggccttctctattttattttaatttggaatttttatctttcaatagcctcatccctcatgccctcatcagattctaggataggattcccattaaattttagtactgaacaagatgctgcagagatattctgcttagtattgactactgactactgacagtaaatgaagcttgccagtatttctgtctgttgaagtgaagtacctgagcaattactgattagcgaccacttgcatctttttacattcttctgttcaatatgtcctaattcatgagtcgcatatgataatcactaactttagcagttgttttggtggatttatccctgttaatgacattgaatgatttcagcttgttccaatgagctttggtagcatttgcctcacaaggatatgcacagtaggaactagctacgaggatatacgcagtatggaaccgtggaagttaacatgttgttatgattctgaccattattttaagtttaggcatataacaatctagctttcactactagattctgtttctgtagtttcttttcaatacagactttatgaccccattttcttatattggcattcatgtgcagaacaaaattgaattgaagaccacactggaaaccttacatgtcttcctgtttattttacagcatgcatcgctggcttcttcatcactgctgataaggccattctacggaacgcaagacagaacaccattgggaagattgacaggtcaacctgatgcgcaactgtacatatgagaacgttgtactgattatccatttcttcgatagcaggcgaggttgatgggagcaataggaatccatctctattattccgttcatccatggatgattggacgtgtactgcaatgaatcagcaatttttatgttttaatcttaattccttatatgaaaacctaacctcgcattgtaaagactagggctgttgccttttagaccagtgaatccagtttggttccaatttgaagttgaataaaagatggaaatgtaatgctcttttaagcccatgtgaacagctatgctgtgcccccggttcatcattttgtgttcttccttgtgacaagtggtgatactgtgaagttattatcagtttggagggttagatcagctctagtgataaagatatataaataactgaagcttgggcaaggtatgatagatcacggcttcggtgtcaagaggagtggtcgcatctgttctgtttctttgtttctgcaggttgaaacaacacaaaacaggttctgatctttgtaacgcaagaacagacgacgtacgtggtacgtaccactaaaaatttagaacatatccagttcacttgtgctgcatacaaaagcacagtgatgccttttttcttccctgcttgcttgatttttaggctactgaatgaagagagcgaggtgtagtgaagtgttcttccctctttatccatccctatccgactcctccgttctaagcttgcaagaaaaagttgaaagggtagcaagtctttcgggcattacaagtggaattcttgtttggtaatacatgggtttatcagggaaacggcatataaaatgcattctttttttttgtagctttgctgctgacaagacaagcatcgtataactaatggtaatggatttaagaatttcacgtggttaacctttgacgtgagaatcactctcatgagatgtgtgcaaatgtaacccgttcatttttgcgatcatacggcacatcatgagaaggtaaagcacgcaacacaactgttcttaccgtgagctaaccaaattagaatcttattctggtaattttcttcgtggatctcaatacaaatcgtagtggaacctgcggaattcaagtgaagtgacgtgtcggtcaaaaaatcgagttaattaagtcttaaaaagggagaaatatttttctccagagaagatcagaagaacagtgcgtttatctcactggagactggagaacaattttcaccttatgaaacagtagcttcaccaaaagaagaagaaaaaaacgtaatggaggagacttgcaagtaacatgatcaggccaaacctccaggaacaggaacaggaaggaagcattcatgggaacgtgtagggatgaaagggagcaacaaggggttgctttcacagttccattaacaaaaaagaaaataaacaacacgacttgaccgatatcgaagctgactggctgcaaccatgtaaccaccttaccagagaccacaataataaacaacctaatccgacactcaaattagcataatcaactccgtagacaagcaggcataccaatctccagctgcatgccttagccgacaccaccttctcgccaccgtaatttaccttatctatcctaatcctcaaggataaacagatcagataagatgctcatctcaacccccataagtaagtttatcctcatcgttttcacatgctcccctataactcacacactactaccacatgtagatgcatctaacttataaagcaaaattctctcaatatgtgattgcatgataaatatgtttttactttatctatctacattaataagtaataactatgtaataatatatggcgtgtttatcaccagcctgtctagaagacctgatggagcaaggaacttgaggatagcttcggcttacttttcggcgccagagtccatgaaccctatctgaatatacaggaaacctatgtatctatccatgaccccatcagcccaccggaacggctgtttcttttttagttttattttttttatttcaccctatctcttccttgcgtctactacatatatgcacatggggaagagaggggaacttaacttggatacttgcctttgccttccaaaatctggagtccaaaaatacacaggagataagcagccatttgctcctggaagaatgagagaagcttgcgcgccggtgcctcctggggctcatgaggaggcctgcatagagcaaagtgatgatcgatctgaagatggttccttctcgggttcgtccatcgggtcgtcgtgctcatcggcatcggatctgagtgatgatgggagttcttaccgtcctggtgattatcttgagccgtcatcgtcgtcgtcatcagcatcttcgagcacattgcagctggattctgaagggccgctctgtgacttgtcctcactgatagcccagcttcctatcaggtgctttgctcctcccctgcagaagtactcgtagttagagaaaattgcaccatgcttatatgaatttcaagtttcggtagatgctttaacggtgtgaaatttgttgcttgtgttcccaatttgtgccagcaaacaaggatttatcacctgactactgtaaactatattagttgaatgaacacatttgcaaatgatatagtagctactagctagttcattttttcaactagacaatgattttctccgaacagcttttcagatttgttggttgaattttaatgatattgcctacctgctaaattgtagagattctattttgcataacatttatgacaagcaaaatgttcaaattgggcttgatctatgtatgtatgcagcatcaggtcttatttgaacattttgttcaaaagacgaaatgactggagaaaataatgtcgatattaaaagatcaaacgttccagaccacttccataaaatctacttcaattgcaaaattgacactaaatcatatgttttctaacaagtaaatttgttttctgcaggagagggctgtccaactattaccaaggaaaatcccaatcattcacatcgatatctgatgctacatgtgttcaggaccttgcaaagaaaattacctacaataagaggatgaaggcgtgcaaaagctatgcagcaggactagacatgaatcaacgatcaaatcacttgccaaagccatgcaacaagatgatagcgaagaggccctcgaaaggatcatttacctgtctgctgtcaagaccaagcagcaccagcctcctgtgcagcagtgctaaaccacctacacaccagagcaagaaagatgtacaaatgcatattaactcgtaacaaaaaatatgaccctggaaagtggaaacaaacaagtactagggtttcaggtatccagtttcagctaacatgttgtgctgcgcttgtactgctccttttcacaaggaaactcaactattttttttcttctgggatcaacctggcttcttacatttccttaagtccatccatttgaaattcaactactaaaaacgggtggaatgaaatacagctagctaataagcaaaatcctatcagctgggaactagagtactcttgcattacatgatcgagcaacaactagcaatgctttgtgcagcgcagctatacaggtattctacagaaaaacaaaattggcatgaatttgacacgtttgctcagagcaaaggaacactaatagtctcacataaaattttcactagttgcaaattgcactttcttgatgtttgttttcttgacatcacagatgggctggtctgattttatttccaacacacctccataaatgagatctgtgaagtgtgaacaacaaaaggatgagtttcatgctatttaaatttaaacaaaaggacaaatggttctcacacaatccaatgtaaatagagtaacgtaatctaaatttaaaaaaatacattacctgaaggaagtagcaaactttccatccacacccatatccctttcaaaagtttaagggtacagtaatttctcttccagcccaaaaggacggtggtatgaagtttgttttcttacatgcttcaaaatagacatgtccaatgtggaatccttgtttgttttcctttttgtgcatcacatatgcatgtcatttcttcttatctcaagcttatcaccaagcttttgcttaagaatggttaagtaaatatgttgcttagccatcttgtgtagtctcccacagcatcaagatcagactgcataggagaaacaattttgtaaaagaaaaaaaaatattgttagcggcgatgttcccttctaagagagcacaatctagagagcaaaattacgcacaaaatgaaaaaggtaaatgctttctttgatggaaacagatacatacatcttcagttattccaagatgatcaagtaaaatccttataccaccaccctttgaagcattaagtggaacaatctcaatcatacttgaatgcgctttgataacacgtgctcttccttgtgttagttctgaccaatgctgtctcagtacagatgaatccccatccactttgtcaaggaaaagcaacttctgcacgtgcaaataaattgtgtaactccaatccaaataaaactggtctaaatatctatctggttgacttactgaagattcaccgaggattgttaaatagtacttcctccgtttcacaatgtaagtcattctagtatttcccacattaatattgatgttaatgaatctagacatatatttatctaaattcattagcatcaatatgaatgtggaaaatactagaatgacttatattgtgaaacggagggagtagttttctagccatattctagaaaccccatcttcaagagatttgtgtaagccctcctatgggttagcttaactttttatggatttatttttatgttggacagccaagaagggagcatacatcaggaattactacatttaacactactggttgagtggctgcagtgattagaatggaagatttttgtctgtattccagaatgctaatagagaaaggctttcagaaaatagcagctctaccgctattgctagttccggcagtggttatccagtcatggactcgagtcgtgacgataatgtggataattcaactacaattctgtctattttggaagggtcctcatgctatatcacaagttcccagcaacagctgctcttttaccacatcgcagtgttacttcaaaaattgttcaactaatatatactaatgcatttcacagtaaggtagaaaggcatactatccttaacagatatgatatgtaaacttttgcatgccaaagttacggatagacaaacctgaaaagatgaataccccaagaggtcctcaactgaaggcaccacttttacctatgaagagaatttaacatttactcagctgccgaccattgttaaaaaggaagaaaagataagtttgcgtagcaaatatctttagatcagaccttggtctcatagtggattgtgtgcaacaaatcaaccaaaggatgttcaaagagggtcaaacattgttcctcatggtatgcaacaagaggtatactatacttcaaggagtacaaaaatgcctgcaaatggaggaaaagacacatcaacatgac

SEQ ID NO: 4903 - DNA, 19363 bp, Oryza sativa
atcaaatatgaaaagaatgatgagatctcaacattcacttccttgtatattatgctctcatataggcttgcagaaaaaatcttaataaaatcctacttccatatgtaacaaatgaactatggagtacctttttacataactgagacagctcacatggattggcaaaaccttgagcagttcaatttaattcaagaatttaaagatgaacgaataaagcaacaatatatggcatcctatctttaatgctatgtcctctctagaagaccagttctatatagaaccattgcatgttatataaaaagcgtgtgctcaaaagcaagaggtacaccaaactgcacatactggcatatccacacattagaccactgggatgtttaaccatagagtaacatacaataaactgaagcctaaactgaatggtcccgaatcccgattcctgattctaataaatgttttattaaagaacaggttgtgatggaaaacatcttcaccaatcaccattatatcgcaggggaacagataaggtaagataacatggccacaaagctctgataaccaaaacaacttttctcaaattattcaggtgaaactggagagtatgtacctgtagaaatacaccaggtgaactctctgatataaaacgatatttccctcccaaatcaagaagcctgaaagttcttattgtggaagcccgggtctaagggaaataaatcaagagaacattattacagtgaatactgatatactcagctggcttgcaaataagaaaattgattcctttaagcactaaacatcctcctgcggtaactcccctttcatcagggaactttaatattccaaatttctaatactctgttcttctataagaaagctagaaatagcattgataatatgttgaagaaagcagtctacagtttagcattcacttcagataggtgccacattcactttgcatgcacgaatacatgaaacccacctttccagtcaccgtgataacgtttattccccttgaaactgcctctctcaaagattctattgattcttcatgcgggtatccttcattatccacaatgccttaacatttatatagaagaagttacctgctagaactaggaaaggtccaacacaaacagcatacttctatatgctccatcaactcaccatctatatcacatacgatatggctcagttttggttgatgaacttcccgtaggttaatttcatctgaatctctactggcctctgcatgcaatggggaaatcagtgggaactccaattagaagaaattgactgacaacataaagaaaaagcatgctaaaatgtgtgaagatacctaccaacataactttgtgaatgatccatgtcatgaatggaatcatatgcactcttaataagtcctttccctttccaatctagagaatttaagatatgttcttccccgctctccatctcttcttcagccactttgctgagctcatgatcaaagcccaataaatgcaataatccgtgcacctgttggagttcgttagcattgaataggattacaatctactccgaaattgggaattaggaaataaaataagatgatgaaaatgcaccggatcaccacattagaccaaaataataataataaaaagtgatgctagaaatgagcgaaacaaaccatgagaattcttatctcatcatgcagtgtatggcccctttcttccgcttgccgttgtgcagtgtcaatagagattactatgtcacccaactgcagctgtcaaacaaacacaaacatatcagaaaaaaatggtaatcaaacaatatgttagtcatggtattcatcgactcaatggtacacatacaatgggaatgtccagcccggggatatgctgcgacattgatagaacatccgtagcgtgatcctcgtccctccattccttattcagtttccgaatgaaatcgtcatcacaaagcagtatagagacctcaacagtatcgtacttattcacatcgcttatacaattgtctctggttttgtactccgagttttcgaggtggtcaaaggccaccttcgctgccttagcaacatccatttgaagcgcttctgcaatgctctgcatagcaactcaggtcataagagggacaaacaatttcaacatttttcagtgcaagaaccgtatataataaacagagcaaattagcttcaaatcgtcaaatgcgatagataattttatatggaaatggtgagagaaacgcacgcagaagctactattaccaggatagtggggtcgtcggggagggcttcctcgatgccaatctgcacgttgagctcggcggggccctcccgcggcggccgcctcgccctcctccgcctcagcagcatcggcggcgctcgcctccggcgtccaggtgtcgacgacgcgtagtgccgcgaggccgcggcgagcgaggagtggggcacgccgcgaccaccgggaagcggagaaggaggagaaggaggacgcggtggcgaggggagcagcggtgggaggaggctggaggagggcggcggacacgggaggaggtggtggtggagggggtgggaggcgagcgcgcgggaaagaagaaggtggtggaggcgcgccatggaggagcgcgaggggtctagaagattctagaaggtttttagccggaggaggaagacggtggcggcaggagggaggagggagataagaaaagggtttagggccgggcctccattggccctcctaaatgggccggtttaactaacggtttgcgacacagttggttgaaggaacagcgtggacactagacagtgcatgattgattttatttcaaagtatttttgttttactagatttgaagtttcaaacatatcatacaggaaatttatgttgtgtattaacggtacacgaatacaaagcaacatttcattcatttcaaagtttaatttttgtttgtagcacagtgtacaccataggagtacttctcatgatggcatgagtgcatgagacatagacctgcctgttcaaataaaacccatatactctgagctccgtataataatgtaatctcaagctttattacttagtacaaatgtacaatatagtattaattggtcagaacaaccatcactgttattgccaggttatagactgatacatggtgacatgttttgctaatggatagaggaccaattgttaatctttgcatataggacacagataactgaactgacctgtgtactacaatgatagcaacaatactacagactttgctgctcaccaattaaccaagattattacgatttataatctcagggacacatcccagttgcttccctagtatccccagtgtagagataagccaccctgttgtcgagcattgacatcacctgatgcgcggcgagtcctgcgtagcacttgtgatgtgccgaaatgcagatgtcagtgatggccctggacatttcatcctcctgatggaatggctggctgacaaattcttcgaccggcatccactgaaaatgattatagcgggcataacccaaaaaatcattagtgagagctcaatcatctaaactagtagtacaaactacaaagtatctgaattatggttagggagtacccttgctgcttcaatctcggactcgtcgatagatatgtcagatgagagtggcttgagtgtgcatatgaagagtatatccgatttatcgaaaaggacttgatgcgcatgtctgtatgaacagaggcagaaacgtgaagaagaaaaaaaaaacatgaaggaactctcagcagtaaaaggttcgaataactccattgattgtacttgacaattacctgaaagcaacgacatccaggaaacaactttcgatctgaaaagtggagttcttgtaaaacatcaaaataacatttcatcttaagtagcatagttcagtaaaacaagtcaaaacagtgtaattaccccagtttcttctcgaacttctcttatggctccagaaaacaaatcttcaaactgatagcagaaaaagaaataatataagattagtaaagccaacataaacagcttaaacaaaacatagaccttttcttgaataagtttgacatgacttggctattggtttttacacagagaaaaaaaattggcttttgacttatcatagatcaataatttgttttactagggagtctccgctctgtgttttgtaccttatctataaagcccgtagggatcttccagatgtctgaacagtgcgatggacattttccttctttgacaacaagcacctaaaatcaaaggcatacattacaaacacaatacatacgcagataaatggttgcttttttctttcgttcagaaagtatatgacaaggcaaataggcataatccagaaattatcaaaacctcgtttttgtcattcatgacaaatgctccaacaccaatttgatgcaatgaagtggaaggcaaaccgggaggtccatctggaagccagaaagttagcatcacgtaccctggctctgcatgatgataaacaaagcccgcctaaaaaaattgtaaaacaaataaagttaaggttgcccatctaaaaaaatgtaaaacaaataaagttaaggttaactgcaatttttaactgattagttaagaggtaatgaggtattgttatcaaacaaaagaatgtaagagacatgaaaagaaaattggcatagacggttttttttttcctttccagcaatagtggcatacattagccagccttcagtgaaaagaatattatgctctttcagataagtctgatgctaaactaaggtcgataagataaaaaaacttataataataagattaacttgcctttattgcaattggaactagatcagcttgatcttcctgtatcttcaaccaaaccccccttttcccctgcagtaatgaattaatcaacccccttttatatccatctactttctagcaatatgtatgtgtattacctgcttattccaataacaaagtgaggactggagtgatgaagaaaatgcattggatgtatttggtaaggaagtagggttaacaacaatgccaccataatcatcctcaaaggcatccagcacatcaatagttccaagcaatggtgtatctgaaatagctgcattagttcccttgcttaaggtcttgccaccactgaatattgacaatttcaagcaaggctgtctgaacactgaacctgcaaaatataacactgtaagatacagctaccagaatctgagaaaaaattatgcataatatagtaaggtagtttggcgaaatacattgcaaagctgagaaaaactatcacactgaacaatgagttaggagatcaatcaaattgccagaccctcaggtttgctattccaaacaaaccaacaaacaaagtaaaaaaatatcagactaataatacttaaatagcacaaatcaacatgaaaaacataagaaactgattgcagcttcttgtttctctagaagcagatgcagtaatgcacactaacattttttctttattagaaagttgaataaagatttcacacgtcatcacctgctgctatgccaaaactaacttgttttgtacttgaaatcctcggatgaggcaaagaaagatagctctttgaatatgatgagggcaaaacaaatgccattggttttcactcgctgaacttgaagttgtggcaatcctaagagacctatgcgtcttaaatagatctgggaaatatacaaatcacataataatatacaccacctacacatgtccaagtggtgtcccctgctgttatttcaaggagaagccatctaaaatctcactccaatttggaccagaaaataacctttttaagtgggagtacatgccatattagcctccacaacggaatgattcccaactttgcatattgttaaggacctattgggatcacagagaattgagatcagaactccaatggaatacacgactatattgcaagtaaacctcacataattcaaaataattgggtggaagtctccggaagcatgttctatcaactgtcaccattggcaatttcatggtctacttgtcaaataactgtaaaattctttaaacacacacattataaaaacttatattacatttaacttaaatttcatttgacattaaaaacgaccttagcaagtatcaaattttaatttgtactggaaaaatatagcttattaacttcccaaatctgcagattacactcttaagattgtcctttctttgcttagtagtagtggttatttgtccttgtctccacaaaataaggagacatgctcagctcaaataaatattaacaaaaatcgagttccatcatatagttcaattccttggattgagaaaaactaaacatagttttgattaaagagtatttgaagttgtgtggcgataaacctttcttgctgttcctacaattttgacaatgtggtaaagagtccaagaccaactgattcactatttgatccatgtctggaacattgggccttacaaacaaatataatggcaggtcccaaaccatcaataaatgcagtagaaaaatgatggccagaaggtaccgttgatgaacttttaacaaaatacagtgagtaaagaacaatattctgtactgagtatgttgtaaaagattgaagttgtcattgcatcactctattcctgaatgtattcacttttacaacatatactcagtacagaatattgagaatgtgttaggcattcccttttaatatgcatattccccaacacaatattcttacgtagccactgagccatccagaatcaggcaactgcagccaccattcttttgctatgctgcttcttttttttttttaaagagcactatatcaaatattatggtagaaaagataggattttatgttcttttgaactttgtttcgaccgcaaagcaataaagaatagttagaaatatatatatatttttcaaaacgtctgtctccctgaataatatagcatcagtaaattggtaacgatcatgaaaatctagaattgatggaagggaaaaacaacttaacatcagatttgtccatagaaacatgtttgtatagaacgatataatgcaatgctattgcaagcagcacacaagttcaaccaagaacaggacatggatcatgatgcaaaatgaagtatctgaacttaagattaatcagctgtttccttcaccaagttactagttgtgattataatacttgtgctagcagttgtgtcttctcagtacaattttcactgaacagatgctaacatttagccacatattttgcaacacccggcaacctaaattgaagctacgccactaatccaacagagtgctacaactctaaaattgcaagattcggtatgcatggctatcattcatttccaatgtccaacttgactccagacgacataagtgaggagcgagcctcacttacaagcaactggcctattggtgcaacttactaagacactccgaccatcactactcactaagttacattgagcaaccattacatctgacaaatggaaacaatactaccatgggaagacacagtatggcaaaatttacagtggcctgattaaacatagagaattgagcttcatagtgtgacaaactacatatcaaaccaaaggcttgtctgtatggaaactactgatgtccaggtaacagtaacattttcagcaacagaagctcttttaaaataaaaagaaatcttcaccagttggcagattacctgacaatttgaaagcatattctaatgttgtccagaaaggttgacagaagcaaatcctacccacacaaaaggtcatccatatcttatcctattgaaacagaaaattcttgtggcaaattgcaaggattgagaatacaatgaaataagatatttacaattgtttggaatactatttcttttcaagctgaaactagttgggaaggaatctggtttcattcctcttgattgctacctgagtggtgacagcaggcacaagaatatggactactgcaaatgttggactaatggaaaagatactggacagtgaaagtgttacatttgttctgttttattaatatagtaacttgaggtcatacaataggaaacacaatggtattaaaacaaattaccactgagtgccaaaggaattcttactttttaagaataatttatacagctattgtacatactgcagaaagaaataaagggggtttaaataaatgctacaaccagtaaccaggcttgctacaaactccaaaaacagctttcatagccagcaatagaagcattacacaatagaaactaaatgaaaaaattaatagaaaacaatgtagcaggaccaaacatttgtggacataaataatacaaaagctacataggaacgttacaacatattttataatgtttggttgattacagtagacagtaattactcagtaacaggcccccagggtcccagacagcagcatcactatcaatgaaaattgaaacatggaatgttctatatactactacaatacaatgtttgggtaaccgtaaacatttgatcagaacaaagcaacaacaaataaaaaattgcaaaagaggatcctctctgtggccacatttgggacacgggaattatttcctgattccagtaggtgaaatgttccatttaaaattcccatgatccaaacagtaactaaaagaaacaatagatccatgttgtttcagccctttaacgtcaacagaccttataagaaaaacacattcagggcaattaatagctaaatgtacagttgtacgtatctacttgactatttgacacagattaaggatgtgttcgatagtaggggttgggatcttctctcacgcacacataaaatggagcaagttattagtgcatgactaattaagtattagctaaaagaatttgaatatcgattaatatgatttttttttcaagcaactttcccatagaaaagttatgcaaaaaaacataccatttagcagttcgggaagcgtgcaagtggaaaacgagggagtagaggttgggaaaggggagaaacgaacgcaccctaacattctttgcttgaaattgtgtggctccattagggctacaacttggttactttgttttatgtaaccagctaatttctatagtaaatcatctatgcaaagggatttttttttttttgcggggaattgaacaatgaaaaaaagggagaaaggtgggaaagagaagaaaaaagaagaaaggaacgtatggtcctactcctttttcaattaggcatatctcaaatagtgtttttttttttagtcgaacatttcaaaggaaaaacttttaagtggaaaatctagaaaccggacagtctagagtgccatacatctaaataccactttcctggcctaattgggaagccaaaaaatcctggtccatctaacatggcgagtcaggattctgggccttcccaaatgatcctaaaatattgtagcatagtatattgatattgtgacagtgttactaaattatttcagaattacatatggcctttccactgtatattgaggtgggaagcataggtatattctcgtggaatatcccgtaaaaacaccatcacagggcaatccaatcagcctaataattatctgacgggaaaggcagcttttgtacaaaatgtactcatcaaatatctgttgattagttataactcgaagaaaaacaattgatgtctccatgtcaccttaaatatttcaaatttcacaaatacatcccaataagcggaaacaacatgcaacttctacaggtaatccgtaatcaagtagtaaccttgtaggtcaagtttcgtattatctgtgatatgtacatcaaatactacagaaacagttggctataatgttctccatactataatcatcctcagaatatagggaagaaagcagcagggtttacatcttaaaaacaaattggctgcataatcagcacttagagatagtgaaaaaataataatgaatactagttcataaccaaatcatctggttactgtaaatatgatctccaatatttaaaagatagcttgtttgcatgttgtagaagcttatatgacttcaaagcagaactcttaccacttttggaaatgtcttcaatatcacaccagaattttctcttgtaatatgatgaaccttaaaagatacgaaggatgcattcattacatctgccatttccaaagcattgtaactacatgaatctgcatgccctttgaacttgaaatgaggacactttaacattttgaaagtcgatggcacattaaatgcttagaatcagggtgtaggtagctgcgcagtatgcctgatccagtgatccttagctatcattctggaggagaaagtgaaccaaaattttcagttgatggtttgatgccaatctggaaattatgcacagtccccagatacacatcacagaaggtatggacctgaagaactagggagctccctggaaatttaccaagccatcctcatctcaatgggctgacaacccaacctgaaatccgagttggcttacgtattcttactgttcgttgagatctactttccagtcgctcaagtattgagtaagttattgagtcggggattaacccttgttgcttcatagtttcataaagtttatgagcttcttctgtctttccacgtctctccagacaatcaagtaaaatgttgtaagttacaatattaggggtgcatccctctgatatcatctcatcgaataagctgcatgccatctcaaccttattggattttccaaagcactcgattaatatgctataagtaaacacatcaggatcatatcctttctcttgcatctctttgaaaagcatatgggcttcatcaagatcaccatgttttcctagacagtttatcaaagaattgtatgtgacaacatcaggcttacaactgctagcctccatcacttcaaaaagttcagacgctttatcaactaagccaactctaccataacttgaaatcataatattgtaggtaaaaacatcaggaataattccatttgttttcatcttgtcaaagagattgctaatgaaagagacctgcttgagctttccaagagctgaaaagaccatattgtacatgccaacatctgtaacaatccctttttcaggcatcatatgtagcaggtcgatcgcctctaatgttttctctgcattacataacacctcaagcattgatacaaaagcatccctgtcccctttctcatgggagttccacatgcgacagaatacattatgtgcctcacttgcatgaccagatttgcagagtgacttcaccaaatacgaatatattgatctgttcataaatctactacagatatctagaacctcattcagtctgtgcagctgcccttctgttgccaagatatccagtgtaatgctgtatgtgaattgattgggttggcagtcattctcgaccattttggagagtacaaaaattaccttgtccaccattttgttcttgccaagagcctcaataatagtattaaacgcaatcaggttaagaacacatccttttgataccatttcatcaaaaaatgagagaaattttgaggtcctcccagcctttccagacattctgataagtatagtatatgtgtatgcatccggtacacagtgtttttgtttcatatcttcaaagacttggaaagcttggtcaacctaatcaactaacaaaggtcagctgccaagttttgaggaataagcactgaacgatatgcactttcaagatgcatggtatgtcaaatataaaaaaaatatagaacaggatgagatacaagaggcaagattcttgttgaacggcaatggttagaatcagacaaccaaacaattttctgtctgtgctccactaccactcgattcatatttcacaatgtgcaagttatcaagagaaatgcttctccacatgtattcacacatggctacatgtactatactaaacatccaaaaaaagcttcaatatttggcaaggacacctcaatgaattaaagacgagttggttactttgcatttttgaaagtttgcatcaattttgatgtggtgatagtacatttaccagcatgtacatgtggaaaacccattctcggttatcaaacataatcttctatgtaattggaacaatattacacaaaagagatatcagagtctactatttttgtacaacacaaccaatttccagtattacttttaaaatcaaccttgacatgatattcctctatgccaccctaacaaggtactctgcctcttcctcttccattccctccccccggtttgccactgttcaccacccttgtctcctctctcactgcctcaggctacagcgatggcataggagtgtccattttgcatcatcccaatggcaaacgaaaatactgttttgtcaactatgcaaaccaaccatgcttgatcttttagtacgtgaggaactgatgctcaaaacttagcaaatagctatcttaacttagactacattactagcaatatatgctagtatgccaaaaccattggcaatgggagtttttttcttaaaaaaaaatgaacgggctaccatcaatccatcatagagggcaatttcagtttataagcaagggcattatattgttgcaatttcagtttgatcttggtattgatgtcatcttaggtcacataacattaggtatgatgtcatcttcatacctaatgtttgcaaatatgactccaattctaggtcaaacaatcagagagaaacatatcgacagcatgaaacaatgattccacagagacattcctagattagcattcattccacaaacaccaccaatttaaacatatgcaaaagttagccgattatcgtaccattccagccttggcaagcgcgtcgagaagcatgttatacgcaaagatatccagcttgtagcccttcctccgcatttcctcatacacctggaaccccttggacacctccctgctcctcagatgcgcctgcacgatgcacttgtaggtgtacccactgagcctgagcccccacttgctggccagctcaaggcacctctccatctccacgccgccgccgcccatcccaaccagcaggttgatcgtggagatgttgccggcgacgccgtcccgctccatgtcggcgacgaggcgcagcgcctcggacgggccggccctggtgcggaagaggagtgccaggatgcggttgtaggagaaggcgtcgtggcggaagcccgggagcgaggcggcggcgaagcggaagaaggcgagcgcgaggggcgggtccccatagagcgccttgacgacctcgaaggcctcggcggcggtgagggtgaggcggagcccgcggaggtagtcggcgaggtctaggagcggggacggggaggcgtgggagcggaggatgcgcgcggcggcgcagacgaggtggcggcgcgggagcgggtagccgcgcgggtcgagcggcgtcgggggaggggtcggggcgacggtgacggtgagggaggggcccgccggggatggccgcgcggcggcgatgcggccggagtaggtggtcgcgaggcggcggggcattatttttttttcgtcggcgaggggggagacgccggcggagtgggcgccgccgccgtgcttattacgggcttcactgacaggtggggcccttgtatttcggccaagtgaggctcctaaaagggccgttcgtgggcctgtagcaaattactggattgttgttgagtgggccgaatctaacccatccatgtgttgtatgggccctcagtttttttctttaagacaactgttgtttttctttgtttgaattcattttttattttatttatcaaaatatttagaaataaaacagaaaacgaagtagtctattaacacgtgattaattaagtattagcaaaaaatttggaaagtgaatcaatatgatttttaaaagcaactttcatgtataaatttttttaaaaaaaacacacgtttagtagtttgaaaagcacgagaatggaaaatgaagagagtgagttgttaactcaaagaaactaactgagcctaacacccttccagaggaccactatggagcttcatgcctcagcaatcttccgagagctcgggcgtacgataacgttgcaaacgagtgaaatgtggaggtgatgcaacgagggtttctaggaagtcgatgccgcgaggtgaagcgcaagcgagtgaggaatagattgggggtgggggggggggggggtaattaagggccggtttagatcccacccaaaaatttacgccctgttatatcgaacgttggaacacctatataaaatattaaatactataggcttaaaaataactaattacacaggttgtgactactttgcaatacgaatcttttaaaactaattgctccatgatttaacaatgtggtgctacagtaaatatgtgctaatgatagattaattaggcttaataaattcgtctcgcggtttagtgacggatattttaattagttttttctattagtacttgaacaccctatacgacaccttgtataatatctgatgtgacacgtcaaaactttactcccctgaatcaacccccctcagttgggcactgcggatacaattttgtctgtggatctagctcactgcccaagactgaaccatttgaaatgccactggcactgtgagagccgttcgcaaacggttttattttagaacaaacaaacggttctctgggcctatttggcacatgaattaagttcctcgtatgtgtggcgtggcctacacagctacactcacagctacactcatcgcactaaaattccaatcctattttactataaaaaaattatcttccactaactacttaagcttaacataacatataaagatgctacatcatcatccactaacaagatgtcacatcatcctccactaacaatcatcacatttaaacattatgtaaacatgttgtatctttataatttttataatttaagagagcttttcaaatacaaacatgttaaattatcatccaagataattcatataatgtttcaatgtatatctttattatgttttatgatatcctatatatttatatagttcatcctcacttagttagtgcttaaatgattaatctatagtttaaattatctttctccttttttcctctaatgaagtcatatcacatcaattgtttttagtctttagatgattaatctacggtccaaactatctccctactttttttcttccataaaatcatactaccttactttttacgtttgaatcaccattttacatactattcaaatttaaatttttcataaaccatattaatttacttaatctgatattatctagctattttacacgttatttttttattgttatcataataaattcccgcagtaaaacacggggtttcacatagttttcttaatagtgtccgccgtctcacaacattgctgctcgtccaagcagcagtagcatagttacatcttacatgtggactgagccgagtatctctcttgtagcataatccttttggcacaacattgattttctcgtcgccaatacctcctccgcagtactaggcccattcaggccacgggctatatatcaaaaacaaatatctccttcctttagtacttcaattaattttaaacacacttttaacaattaattttattattaaaaagttgtataattatcatttattttgggctgcaaaccgatgtctgcatccaagcccaaaccgccggggccggggttactgcgccctggcggtaagcacggttaccgcgcggtaaccgcggtaacagtgaaaaaccatacaaaaccgtgcaaaattcatcaaaattttaaattattttttaaatttatttaaatttaaggaggttaccacggtatttacattaccgtaccccgcggtaagcccgataaccgcggtaaccgcgcggttaccagcggtatggtgaaccatagtctggactagagtagtagttaagaaccacgaccgcgccaaaaaggagcctggatagttaagaactcagaaggatatgagtagtttgatcagcggtcagccaacagctgcttttgcttggtcattatcaccattcacgctcactcatacgtcgtcacatgctgttcatcttctgcttaattagcttaattaatctcctgttttatcagtcgcgcttttataattcgcagtgccaatggcaacaacaaatgtacttaagctcggtgtgctgcgcactacgcaactaattgacgcatacaacacataacaaatctcatttgatgcttatatgatgaaagtcacaagtggtgtagttattaggagtatagcgtggctctgcccttagtacttcctaagctttagtttactttttttgctttttttttctcttcccttggcataagtcagtctggttgattgcgttgtataacataaacttattttcttctaatatattgacgtgtaattattttacgcgttcgtaaaaaaaataagtggtgtatcagctagtggctacgtgattttactcgtcaggttttaaattatagttatatgattattaaatattgcgatcatgaatttacccatggtttttgtccctttaaacgtgcgttacgtatcggtgggcatgcgagtatagtgtgcgtatgtagtgtgtattgataggaaatgattttttttaatagaggcagtacttcagtggtgcatactcctgcttggtcaagattaactatggtagaagtatttattttatttaaacaaatggagtaaagatcgaatcaataaacaatcacgcggtcaacgatcttgcatcatccttagaagatcattccagtgttaaaaggtctcctctacctgtcacatgtatgtatatatacgtgaaatgattcgttggactccgtgaaatgtgttgactttcctccccttcttcccaagttccaacccgtgcattgcatgcatctccatcacaaaccaaaaaaacacctccaaatctttcttttttgtgattttggactatttagggtcatgtgttcacggctaagtatccaatatcaaaatttaaatgtaccaaaaaaagttgttcctaaattgttggtttgcagtgagtgtggtccaaacataccttacaattgttccctaaccatattttgccacatttataaccaatactttagcttaaaccatccgtggcaaattaatcatgtgttaaaaaaacattctaatatctttaactttttagaggtatcttaaattaaaatcaagaaattgagatcaaggtgtgtcgctagtttccgctttgatttaaaacatgtgtgaagagacatattcgtagggggtgtgagtgcggtgtaaatgtgcgtagtggtgtgtatcaataaatgaaattaaactaaaaaatcaacataatctcacttgaccttttatcatctttctcacaaataaatatattactccgctaaattaaaattttaaacaaccagaagagaaaaaaaaaaccatcaagccgccggcaccagccaacccaagaacccaaccataaaaggcgcgagtcgcctcatctctcattaaaactcaactaatttaaactggagcagtcaatcacctcctcctcctcctccgccgccgccgaggacgacgacgacgacgaggagaagctgatcgtgatcgcgcgcgcatggagccccacatggagagggcgctgcgggaggcggtggcgtcggaggcggagcggcgggagctggagggcgtggtgcgcgcgcaccacacgttcccggcggcggagcgcgcggcggggccggggcggcggccgacgtgcacgtcgctggtggcgcagcgggtggacgcgccgctcgccgccgtgtggcccatcgtgcgcgggttcgccaacccgcagcggtacaagcacttcatcaagtcgtgcgagctcgccgccggggacggcgccaccgtggggagcgtccgggaggtcgccgtcgtgtcgggcctcccggcgtccaccagcaccgagcgcctcgagatcctcgacgacgaccgccacgtcctcagcttccgcgtcgtcggcggcgaccaccggggcgcctccgcaactaccgctccgtcacctccgtcaccgagttctcctccccctcctcgccgccgcggccgtactgcgtcgtcgtcgagtcctacgtcgtcgacgtccccgaggggaacaccgaggaggacacgcgcatgttcaccgacaccgtcgtcaagctcaacctccagaagctcgccgccgtcgccacctcctcctcgccgccggccgccggcaaccaccattagtgattgatcatggtgtagtatatccacatgcatgcgtgcattctgcatagtgttgcttcttctttttttttcttttttgcttcctttttttttctctacctaaaagttgagtaaagagatgaggtgtttataaattataagtttgaaattatttacttatatgtgcaattctgatggggtgatgacatcaaaagaggatgcaatgcaagtttggtgttagttttaaatttgtgtgtgtgtttctatatatatatatatatatatatatatatatatatatatatatatatatatatatatatatatatatatatatatagacacacacacactagtattaattacatcgttatcttgcaatgtcatcatggttattggtacttctctttagtttgttttgtggatctataagatttggtagtgtttactcatacttttgaggaatcccttttctgttatgctttttctaggctcaactaattttcagttggaaaaagatcgatcacaaaggactgaaggaagagcaaacagtgcaagttggtgttcattgctaaaaggattgttttttcttcttggatatattaatgcaatgagcctttcatgtgcttcatttgataactttaccctcattttctagattcaagttagcggacctcacgatcgatatcatcaatcatcgcattgaaaatcttatcccttaatctgcattggttgcacttatggtttataagctgagaaaaaaatggcaaagcaacaaaaataattttagagcgacttagagcctgtttggattagggactttttttttgttcatctcacatcggatgttgggacactaaatataaatattaaacgtagattagtgacaaaacccattccataaccttgtactaattcgcaagacgaatctatttagcctaattaatccatgattagctagcctatgtgatgctacagtaaacatgtgctaattatgaattaattaggcttacaaagtttgtctcgtgaattcgctctcatttatgcaattagttttg

SEQ ID NO: 4904 - DNA, 455 bp, Oryza sativa
cgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgc

SEQ ID NO: 4905 - DNA, 647 bp, Oryza sativa
atccacgaagaaaattaccagaataagattctaatttggttagctcacggtaagaacagttgtgttgcgtgctttaccttctcatgatgtgccgtatgatcgcaaaaatgaacgggttacatttgcacacatctcatgagagtgattctcacgtcaaaggttaaccacgtgaaattcttaaatccattaccattagttatacgatgcttgtcttgtcagcagcaaagctacaaaaaaaaagaatgcattttatatgccgtttccctgataaacccatgtattaccaaacaagaattccacttgtaatgcccgaaagacttgctaccctttcaactttttcttgcaagcttagaacggaggagtcggatagggatggataaagagggaagaacacttcactacacctcgctctcttcattcagtagcctaaaaatcaagcaagcagggaagaaaaaaggcatcactgtgcttttgtatgcagcacaagtgaactggatatgttctaaatttttagtggtagcgtaccacgtacgtcgtctgttcttgcgttacaaagatcagaacctgttttgtgttgtttcaacctgcagaaccaaagaaacagaacagatgcgaccactcctcttgacaccgaagccgggatctat

SEQ ID NO: 4906 - DNA, 901 bp, Oryza sativa
ccctgagcaactaatgtctttaaatgctgtctactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggtacgcccgttgggttatttccggtcgtgacattgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcagtcctgcctacctgtcccggaggtcccggccgtaggtggggttgggtcggtactcttgtctgtggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcataacaactaaaatgtggaatgggtggcctggggtggcttgggacgagctgggac

SEQ ID NO: 4907 - DNA, 4241 bp, Oryza sativa
tttatagccagctgtaacacggacaccaagacgtaatgtgtggatgacaggtaggaccaggtattaatagtatagtaagcaattattgcatgaattggctatgatattggctatagatgatttggagatagtagtgggctatactattaaacttgctcttaagcaactttaatttcctagttttccgtgagtatagtggtgcgttttgtgaaaacattttctacatataagtttctttaaatcaaataaatctttttttaatttttaatggttaattcatccggagttccgcagtaaccaaacatcactgccgaacttgttctaaaagtttggggattgctgattcatgcaagtgtaggccctgtgggcgcactgtttacagggttaggcacagtaatatcttctactcgcagataagaactcgcaaagctacagtagtgggtcacttgtgaaattaaagaagatgtgcaactaactcatggttgatgtacactttgctggatgtgtttgagaggagaagaaaagagaagattgagaatatacgtaaacaagacgagatgatgatccattaactacatggtaaattgagtattgattattttaaacctgaaaaatagagtaatatgacattttaaagtaacttttatatagtgatgtgtgtgtaggagctgagctagcctaggatcgatcaggcattcaggccacttgttcgtggatgtcatattcgctcgtttcggcgtgctatgtgggttgttcataatccagatcgatgattatatgcctcgatgccaagccacgccttctcgatgcataaaaatgaattaggtcgtattagagatagattattgattggattattatcgtaaatctgctttattatagaataattcgaatattttaaaacataggagtaatcatcaagggatacacccgattatactggccaatttttccatgcttaattatttgtctcgatctatatttcatcaatttgagctacttattaaactccgtttgcacaagaggcaccctcacaatgtgtgtacgagttgttgaaatggatggatgtatatcatatcctacttgaaaagaacaataaaaacacaccctacgaattggagcacggtataattgtggggttgcttgacttcatttatcattatttaaatcatcatattttcagcagaaatttgtgtggcatacaaatttgtccttcatatttattaacctgctgtcactggcagagaaaccatctttggtcggtcgacccaaattcacaatagtccttgttccattaaaaactgggactaaaaataatttttagtcccagtttataagaggaagatctttagtcccggttgatgttatcgacatgttgtgtgcatatatttttaatatataatattgtactatactaaaaataaggtggtggttgcccccatcccacctactacttccattgcatattttacaaattactgagcattttttcaaaaataaaaagtaaaatttgttcaaggcttggtttgaaatagattattaagcggattattgctatggattatctagtggattatggagataaatatttttttagtaaataaatttaacaaacaacttaaaacaagtggtccaaacaatttaatagaagaaagctttctgagaaaatgtatttcttttagcaaataattcatttaatagtaaataatctgaaaaaaactagctagtttttgtcaacaactaaactctaatggttattgatgaaattgcgcgtgcgtggtattgagtgctagcatttgcaacccagtaatttctatgtactccctttatcttaaaatataataattttgtgctctatgtatttggacacatttgaatatgttctgatatatagttagaagttgataacttgatatatcactgtatgtcaaatacttagccaacagttattatatttttgaccggagacagtagatttttatgagtgggccctaatatttacttcttgtccgtgaaccactaatcctcttatgtccagtcaaaataatcgtcactaggcaataatttcatgataaaattggtgctgtgcgcatcatgatgtgtatatattggaaagctaccaacatgcatccatagtgtcaaaacacaaatatgtgccggttgagaaacccccttagctactggttttcccaaccagcactatggagacggcactgatatgaaaagaaataggtgctgcctttgaggttccacgaccacgagcatatcatctaatccatcacatatccaatccacagatggattcatccacatatcaatccatttatccacaatacaaattttgaaactcaaattcatcctagatcttggtaataaaaaatccatagatggattcatccacaacacaaattttgacactcaaattcatcccagatcttggcaataataataaaaaagaatccacacctcttccacacctctctgtcgttgtcccgccatcgtcatcgtcgcacggtcgtgtagccgctgccatagtcgtcgtcttcgagccgttgcgtgtgcgccacctcctgtcgtgtcgcctcccgtggttttttttttccgggggtctccccttggtgagcccgtcgccttgttgccgcctacccctggcgagaccgccgccatctccatccgcgagccccgccgcccctgccgccgtcttccctccctccggatctggtggaggggagggctcctccacctgccgccgctgccttccctcggcgagaccaccgccgcctccatctgtgagctccgtcgtgtccgttgccgcctcccctcccgccggatctggtggaggggagggctcctccacctgccgtcgccgcctcctccccgcggctagaccgccgcctcacctcagcaagcgcaccgccgtgtcccctccgcgagcccgccgcagagtcggtgggaggagaagaagagataagggagatagacagtgggagagagccggtgggaggaggagaagagataaggtggggacacagtatcgagagagataaaaagatgcccactcggctggcttgtctccacccggcttggctcggttataaaccgacacctttaataaattaaaggttttgggttttatcaaaaaccggcatctatagtataggtgtcggtttttctttagaatcgatacatatagttatataaagatgcccgtttttttttgtattttcagcccgtagaggccgaaaaaggcctataggtgccggttttagcacttccggcacctgtagtgccagcatctatttgatgttctgtagtagtgtgtattcatcctctttcattttttaggtgccatcaacgatttttttgaaaagttttctttgtattcctgtgcttaatagatactactacagcttggatttatcaacttgtgacttctcccaacataaagtatgatcctcatactactgtaatatataaaagagtaaaaactacacaaccgttccttaaatatggactaagtgtcatctagatatgtgagcttgtagaaatacacatttgggtttttaatcttcgtttaatgtatcacctgaggtttaaagtgcagatgacgcaactcatgcgttgatgtggccatccacggtgatgggaaatttgcattcaaacttctgtgttacattatgctttcaaattttggaacttctggaagtgcagtagatagaagcttccccaaataggacgtactttaaattgaccccccaccatacgatcatggaagtggagatgcagagatggtgattagggtgtcattgattgtcagtaataggaggtcctcggagtcgagatagatgatgtgataggaagagagtaatccgacgaactcagtgtggcacgattgtcgttgtgaagacaagcgatgggccttgcaccgtctaccttggattgcagccaccctaataaccacctcttgacctcctctcccacacacacacacacagtgggaagtaggtttgggagcatggggagttaatatattttggggaatattgtaatggtgggagtttaaatacaaaattctcattactatggatgaccacgttaacactcaagttaagtcttttgcactttggacctaaggtgatacattaaaccaagattatagactaaaatataaatcggccatgtattgtactccatattaaaaaacctttttctttcaaatggtttttgctcacttcacaaat

SEQ ID NO: 4908 - DNA, 11463 bp, Oryza sativa
tacatatatatatatatatatatatatatatatatatatatatacatacatatacatacatatacatacatataatatatatgagtatatagcatatacatacatatatacataaactatacaggagagaggactagaggagggcagctgttcacgtggcgcgcgtgcatacatacagatacatgaattatcctctaaattaaattcttgtaaaatacaggtatcaattttaagtataagatcgacttgaacgcgcgtcaagttcctcctctatgcaataatatttaatactatatctgtctctacaagaagaagttcacttttttcttttacaaaatatacgtgattgagattgttttattatgaaataacggtatcatagatttgattgatgctttgtcgacaaccttgatgttcgagtcgtttggggacgatggatagttcttctgcacccacattctttacacttgtggtacttcgtttttcgccgggccactagtacttcgtaataatctatatggaccgttatgtaccattgggcaatactttttgcagcatcaccttttttctagttattttagtgctttattaatataaaaataggtcaatggtgaccaatgccagttgcccatgctgtacatagaagtagaagtaatgctgtatgtattccaagtagaccctacaataatcaatactctctctgttttaaaatgaacaaacaataattaatactccctctctttaaaatgaacaaacataggctctgttcagattttaacttttttttcttcaaacttctaatttttccgttaaatcgaacttttctacacacataaactttcaacttttctgtcacatcattctaatttttttaaacttttaattttagcgtggaactaaacacagatgtaatacagatgtactgtaacacatattagcctatccaaacttacagtagcatgatgtgttacttttcgtgtttaatttgtttatttacgataaaagtattaagcactaaaataaatccttctagaagtggaatagtctaggtgggccactgcaactacagttacagtgacaatgacaattacattattggtggagaagactttgacttgatgacttctgacaaaccaatcacttgcactgcaggcagctacacacaacttttccgtaaaatcaaggactggtttggtctaaggcctaaatttggcttaccaatatttgacaattttaatagtatttagtgtctatttgatttgaagctaaattttggcatgcctaagaaaataggctatttcaatagttaacttaggctattttggcttcaatccaaacacaactttgccttctcaaaatttttcgtatcaaaacttgccaaaatttggcattgccaaaaattggtaaggccaatttaggtcacaaaccaaagtagccccgaatgtttgaacacatgtattaagtattaaatgtagacaaaaaaatcaattgaacagtttaactgtaaattacgagacgaatcgtttgagcctaattacgccataatttaataatgtgatgttacaataaacatttgctaatgataaattaattaaacttaataaattcatctcgcagtttacaggcggaatctgtaatttattttattattagtctatatttattacttgtattcgtatatttaaaaaaagtttggcacacgaacagcctcacaagcgaaacagccaccacgcatgccagccggtgacagtgaatcagtgatgcacatgccctcaggaagattgctgctgaatgcaccatggttctgacataaagagagatgttctctctttttcggggctgcttagggcctcgtttagtcccaacttttttttttaaacttttcaacttttctattatattaaaattttactacgcacaaacttccaacttctccgtcacattgttctaattcaatcaaacttttaattttggcgtaaactaaggccctgtttagttcacaccaaacttcccccaactctcaatttttcatcacatcacatcacatccaaaacttttctacacacataaactctcaactttccccaaacttttctccaatttcaggaactaaacacagcctaaacacaccttagatcccatcccaaaaattttcaccccatcgcatcgaacgttttttaccctgtcacattgaatgtttgaatacctgcatgaagtattaaatactacctccgtcccatattatttgctgctttgagtttttgtttgtagtgtttgatcattcgtcttattcaaaaaaattttggaattattatttattttgtttgtgacttgttttattatcaaaagtactttaagtttgacttattatttttgtacttgcactaatttttcaaataaaatgaatggtcaaatgttgtaagaaaaaagtcaaagcaacaagtaatatgggatagaggtagtataggctaaaaaataattaattgcacagattgcgactaatttgcgagacgaatcttttaagcctaattgctctagatttgacaatgtagtgctacaataaacatttactaataatagattaattagccttaataaattcgtctcgtggtttactggcggattctgtaattactccctccatattatatgtatgacgccgttgactttttgacaaacgtttgatctttcgtcttattaaaaaaatttatgtaattataatttattttattgtgacttgatttatcattaaatgttctttaagcatgacataagtatttttatatttgcataaaaattatgaataagacgagtggtcaaatcttggttataaagtcaacggtgtcatacattaaaatacggagggagtagtttttttattagtgcccaaacatctcatgcgacatcctacataatacctgatgtgacaatgccaaaactttacacacccgtcccttcgtttgtacaaatggccagatcgacagtgggttataagagcagaaagcttcaagtttccgcactgattatgactggatcgtcggcgttagagaattcttctgcgagttcagccgatgtcgttcactcatcagtcatcaagctctatcatcaatacttcaataggacaagcggacgacggggagtcacggagtcacctctttgtccacaaccagctgaagcagacgtgcgaatatctcgaacttccggttctctgccctactaaaatttgataatgctaaatggctaatattcgtcgcaaagatagcttgcgtatagaaaggatagagattgcaaaactattttaaactcttgacaggattttctctcggtgtttgcatgttacccaattagttatgattttttttaaaaaaattcaacaagatagattaatatatgataaaccacttcataaacatggtcaaatttaacttctgcaataaaaaaattaattacgaatatacgttaactagtcatagtttaatttgttttttctgttggaacttgtagaagttaaattttaacttgtatatttgtagagtgatttatcataataatcagtcttgttaattttttttaaaaaaattttcataactatttagttgacttctaaacaacgagagaatgtcatcttgagagtttaggagatattgtcgtgtgatttgttccgtaatttttgaaacacataagagggttgtgtttgtttttctttagagaagacaaaggtttgttactgttttgtgttggaatttttcgaaatgatagattgtcgtataggtgttatctacaaatctggtaaaagtttttgcattgggggttatgcttgccacttcttaaaaaatgatttttctagacgaacaccccaataggttatagatggaccattagtgtccgtgtctgcaaaaatcgacccttattttctcatacggctctttaagagatctatacgcaaaattcaaatttttcagacggaccacttaaaatatccgcacacaaaaataaggtatgtttacatgcagggctcttaactcacccgcacgcaaaaatagctcactctattttatttattctccactcctctctctcttccatcacccacactctctatgcccggctatctcctctgacctcttctactccttctctcccctcttctctctctaggcggcgggctccggcggcgatatcaatttttacagaccatttggtacgtgatgatcgctttgccgcctgccaaaactaggattggtgtcgaaacatgaattcggcaataataaaaggggtagcgcacgagacctaaaagtggatggatgccgagacaaggatttagagaggtaataccctaatcatgtttggggatttgaatccgccgggtgtagtatagatctgaccatcatatgtgctcatgccccctagagggcctcctgcccaccttatataggatgggggccaggattacaagatagaaaccttaaccaatacggtatcggtttcctaaatctactttataattttatcaaaccaggactttaggctattccataataaacagggaaacgtaatacccaagtcatgatccgttacatattccatagatataagttatcccctataatcagtcggaaaaccatatcgtgtgggtatgggatactcataatctccacaattggacatttggaaaaaccggatttatagtagtatgctactgtggcaaattattgatgttagaacataaaatccatcatgagcgtgagataccttcccttctccatacgtaatatcaataaaaatcgatgacaccactccattggagagagcttagtttttgtcccgattaataacatcttgtgagaattccatgatttacacacgtacgtggcaaaagaaacagtgcacaacgaaacgaaactgaattcagaaacagagtgcggcgaatatacctgaagtcctgaactctctgaacctgcaccaattattcagagtttcagatatgggcgatcgagaatcacacgagtttcttcagctacaagagacggtagtagatacaatctcgcccccccccccccccatttctgccgaaaagacagaacaacatatgtatgtaaagcataaaaaaactttcgacagaacagaataagaacatttcgactaggaaacggcaattccattctcactgcatgtccttgctttcgagtgccgtatcatagtgatatataatcgcatatatatcaaacggaacatattccaagtaattgtcttgtactacaccagaaggtgatcatccttttcatgcttctaatcttaaatacattcaagttggatgaaagaggatagcatagtgctcaactgacaactcacatgtctctatcagagcatctttcaatcactagaggattggtgctaaggaagctataccgaagacttgacctgaggtagtgacgcacttcgatggtggttctctctctgccttaatttctacttaagatcactccgacgccatgtctgaacatccaagaacacaccacactcgcaaaaaatggctgtctacaacatcctcatcctctttctactactattgctcttctctctatcgactgcgcagcccagcgccgacgagcaaaaactactcctagcaatcaagcaagattgggacaacccagctccactcagttcatggagcagcaccggcaactggactggtgttatcagtagcagcacaggtcaggtcactggcctctccttgccaagtctccatatagccagaccaatcccagcctccgtttgtagactcaagaacctaacctacatagacctctctttcaacaatctcaccggtgatttccccacggtgctctacggttgctcagctttggagttccttgacctatccaacaatcaattatccggcaaacttccggaccgcattgacaggctatcgttggggatgcaacacctcaacctgtccagcaatgctttcaccggcgatgtgccgttggctattggaaggttctcgaagctcaagtcattggtacttgacactaacagcttcaatgggaactacccgggtgccgccattggaggccttttggagcttgagacgctgacgctggcgaaaaacccgtttgagccgggtccagtcccaaaagagtttggcaatctcacaaagctgaagttgttgtggttatcatgtatgaacatgactgggaccatccctgatgatctatcgtcactgacagagctcacactgctggacttgtcacaaaataagatgcagggacaaattcccgagtgggtattgaagcaccagaaactcgagaatctatatctctatgcaagcaatttgagtggcgagattggtcctaacatcacagctctcaacctgcaggagcttgatctgtccatgaacaagttctctggatcaataccagaggacattgcaaacctgaagaagttgagattactatttttgtactacaacaatctcactggacccatcccggctggtgttggtatgatgccgaacctcactgacatccgtctcttcaataacaagctctctgggcccctacccgcggagcttggaaagcattcggaattggggaattttgaggtgtccaacaacaacctctctggtgagctaccggatacactttgcttcaataagaagctctttgacattgtggtgttcaacaatagcttctccggcgtgttcccgacgaaccttggggattgcaaaaccatcaacaacatcatggcatacaacaaccactttgttggggactttcccaagaagatatggtcattcgagttgctcaccaatgtcatgatttacaacaacaacttcaccggcactctacccagtgagatatcatttaacatctcgaggattgagatggagaacaatcgcttctccggtgccctcccgtcgaccgccgtcggtctgaagagtttcacggcggagaacaaccagttctccggtgaactgccagctgacatgtctaggcttgccaacctcaccgagttgaacctcgccggcaaccagttatccggctcgattccgccgtctatcaaatcattgacaagtctgacctccctcaaccttagcagaaaccagatttccggtgagatccctgccgcagtcgggtggatgggcctctacattcttgacctctccgacaacgggctcaccggcgacatacctcaagatttcagcaatctccatctcaactttctcaacctttcttctaaccagctctccggcgaggtcccggagacgctgcaaaacggcgcctacgatcgtagcttcctcggcaaccatggcctctgtgccacggtgaacacgaacatgaaccttccggcttgcccccaccaaagccacaacaaatcgtcgacgaacctgatcatcgtcttctcggtgctcaccggcgtcgtgttcatcggcgccgtcgccatctggttgctgatcatccgacaccagaagcgtcagcaagacctcgccgggtggaagatgacgccgttccgtaccctgcacttctccgaatgcgacgtgctcggcaatctccacgaggagaacgtgatcggtagcggcggctccggcaaggtgtaccgcatcaacatcggcggcaagggcagcgacggcatggtggtggcggtgaagcggctatggcggacggcggccaagtcggacgcgaagagcgacaaggagttcgacgccgaggtgaggatcctcggggaggtaagccacatcaacatcatcgacctcctctgctgcatctccggcgacgacaccaagctgctcgtctacgagtacatggagaacggcagcctcgaccggtggctgcaccgccgcgacgacggcggcgcgccgacggcgccgctccagtggccgacgcggctctgcatcgccatcgacgcggcgagggggctcagctacatgcaccacgagtgcgcgcagccgatcatgcaccgcgacgtcaagtccagcaacatcctgctcgacccggccttccgcgccaagatcgccgacttcggcctcgccaggatcctcgccaagtccggcgagccgaattccatctccgccatcggtggcaccttcggctacatggctccaggtgaggttcatcacaagattgttgttcgttaatttgatttgatttgctcgccatcgatcgagctagctcatgagagtcaagtgttcgacgatatgtctgtctcgcggtcgcagagtacgggtgcagagcgaaggtgaacgagaaggtggacgtgtacgcgttcggcgtcgtgctgctggagctgacgacggggcgggtggcgaacgacggcggcgcggactggtgcctggcggagtgggcgtggcggcggtacaaggccggcggcgagctgcacgacgtcgtcgacgaggccatccaggacagggcggcgttcctggaggacgccgtggcggtgttcctgctcggcatgatctgcaccggcgacgacccggcgtcgcggccgacgatgaaggaggtgctcgagcagctggtccagtacgaccgtacgtccagcgtggcggccgcctgccgcgatgactccggcggcgcaccgtcgttatcgaaggggaagaaagacgggaaggggaagagctcgtcggcgggaacgacggccgggaaaatgtggggcgccggcaccggcgacgaggaaagcggcagtttcgtggcgcatccagtttaagctgacgtggcaactacacgagtcgctgtaaattatgtagttggatgtaacgttttctacttctactgtacagcgtagtgaaaaagggggttatgggaggaggttgaggggaaggggaaaaaggaagatcaatgagtttggagtcatggccatgattagagcttatgattaggacaccgtgatcggttgtggacctggtggtggagagccgctggagatggaatagacggcaagacgggggtacttgccgccgctgctttaggctttgttcggataatctccataagggaggaattagaggggatttatttcacacctattgtggtgtgaaattattctccctcaatctctttcaatcctctttaattccctccaaaccaaataaggccttagggaagagaaggggtagggcaaggggaaccaacacaagtcgctgctgccatagcgcatccggtttaaaaccgatgtgacacctcgctgtaaattatgtacttctactgtagagtgtgcagggaacaaacgggttgtgtaagggtaaaagtgtgtccaccatatttgtgtccaattgccgaaggcatagaagtaaaaataaattttgtttcagaacgtgattgttttaagttatgtttacttgtagagatgagtgcttgaaaatttcgaataaattaacatgttcaaaaatatagattttagaacccatttgaaacaaaggaaaaatcatatgattgatgtttctcacaatttttctgcaacattgtacttttgtaaaatcttagtaattgtagtctatttccttgcgtttcttggaacatgagggcccggacacaattgtttgcttcggggaaatcagagttcagacccttacatatatacctttgtgttgtagttcttccaaaatgaaaatgagttcagggtgatcccttggcaagttttttcatcctatcacatcgaatatttggacacatacataaagtattaaatatagataaaaaaattctaattgcacagattgcgtgtaaattacgagataaatcttttaagcctaattaggcttaataaatttgtctcgcagtttacgggtggattctgtaatttgttttgttattagactacgtttaatactttaaatatgtctgtatatccgatgtgacacagcaaaaatttttatccctggacctctaaacacagcctcagtatattcaggagtaacatcagaccattttccatatataaactgtccagcctgagtattctttggcatcgacctgaggatccactagcagaagagtccatttatttttaagaaccaaaagacatgtgggcctaaatagtcccaaatttcatttgaaataagaggcccaagaagattcgccttagttgtcgaagaccttgacctattgcagtcttgagtccttggctctttcctactccctcggtccctccgttccatctaaaatgttttggcttttccagttctcgtctagatctattgatatttatataacttttaaacacatgtattaagtctatacataaattctatgcactaatctattcaaaaacctaacacgtcttataatctaaaacaaaataaagtactacacatgataaggccagtatcacaaatttagtgtcgtgctgctggagctgacgacgggagggtggcgaacgacggcggcgcagactggtgcctggcggagtgggcgtggcggaggtaaaaggtcggcggcgagctgcacgatgttgtcgacgagagcatccaggacagggcggcgttcctggaggacgccgtggcggtgttcctgctcggcatgatctgcaccggcgaagacccggcgtcgcggccgacgatgaaggaggtgctcgagcagttggtccagtacgaccgcacgttcagcgtggccgccgcctgccgcgacgactccggcggcgcgccgtcgttctcgaaggggaagaaagacgggaagtggaagagctcgtcggcgggaatgatggccgggaaaatgtggggcgccggcgccagcgacgaggaaagcggcagcttcgtggcgcatccggtttaaaactgacgtggcacctacacgagtcgctgtaaattacgtgtggttcgatgcgacgttttctactttcacggtagattgtactggaaaaatgatttgtgcgagagtaagtgtgacgtgttcactagtgatgtccaattgccgaaggtatagaaaggacatataagccctgtttagattcaactttttactttcaactttcaacttttccgtcacatcgaacttttttacactcataaatttttaacttttctgtcatatcattttaatttcttcaaacttttaattttaacgtggaaccaaacacaacctaaatttggtctcaaaccagagcttatgcagaagtcctcctctgcagccccatcctagatggccgatcgagctatactgtggtggggcggagccggtgcaggagtgcacggtcgcgtacgcgagcacgtgaaagcaacggcggtaggcgggatgagtaacagaagggagaaaaaaaaacggtttgagcatgtggcatgaatctcaaagcgatccaactgcataattttggaagcttttttctgtcgaaaaagatttagatagtcccttgattaaactgtggaatagcaatgaaactatgatgttttctcccacacaatatatattagttaatctagatcaactgtgccagggcaggtcccactactgtataagcaaacaatttatcata

SEQ ID NO: 4909 - DNA, 12671 bp, Oryza sativa
tcagacccatccattacctatacttcatgaaacgaatttttttgagaattaatattatttttatggaaaattgcaaaagtagtggccaatcggggaaaatcgcgaatttaggtccatgtcgaacggctgtagttcgatagggtagatatcgaacgttggggattcgactgggacctgtcgaaccgctggcgttcgacaagccgacctgtcgaacggagggagttcgacagggcccaccacccagcgccgcgcggcctgtcgaacagcgggcgatcgataggccccgcaaccgaccctgttgaacaatggacgtttgacaggccggtttaaaaccctgtgcgcccagcccgcgatgctgcttcgatttttctgaggaccacatcgccagccgccgccgagtcgccacttcatcgccgtgggcgccggagggagtgaggggaggagctagcaggccggagtggaggccgaggaggcgccggctgggaggagagggttggcaacccctccaccagtgaagttaaggtatacattagtaatccctaagtatgaggcataagaaagtttaataaaaaattggtttgtgatttgttaattgtttcgcattgttcaatgctagtatttattgtttgcacgtatttgtcattgttaaatgttagtagaggtatgtaagtatttgtatggttaaattagttcttagttagtacatgttattaatatgttctgtgttaaaaaatgtacaaagatattatattttatttcgattattaaactagtcatttgttactaatagttgtaagttagtacacggcaatgtagtataagttgtaatagggtaattatcgaaggattaaatgattaacgtcagacaatttgtcatgttttatcaggatgtcaggtgatatgcccattcgtctgtattatggcgatgctcctatacaaatatgcgatagtggggtggatttgactgtatatgccttccatgatactagtctgaatgcaccggagtatatgggtttgaacgacgtgttagggtggttgtataatatgtttggggtagatccagtgcatgataaatttgtcataaatgccgtgtggccagtgaggggtcaacatggatggcagtggagagtagtggaggttgcgtcaaccgggagttggaggaagtttgttagtaaagtaagggagaaaggctatagcctggcaatagtggtgtagaagaaaacatgtgttgatcgatcgggggagtcaagtcataccgtggtggaagaaactccgttggaaggtggacaagttgaaaatgtttggcggactgagcaaggtcgaggggaagaagtaatagagggtaatacacaaggagaggtcattgttcgtggtactaatcgtgaggccaatgactcagacgatgaagaaccggattcgcctatgcgtgttgattcagcggaggagaatgaggcggtagtggattagatggaagtggaaaacgaggaatacattgcgcttgtagtggaaggagaagatacaacactgtgggacaacgaaactaacatacccgatgattggacgaccatatcaatgagtcatatgaaggtaaacgatgatttagatgcccactggtgttatgatagtaagcaggtgaaagttggacagatgtttcatgacaaaggtcacttacaagatgcggtgaagaggtgggcatttgaccagaagcgtgaattcaaggtgaaggtttcaaataggacgacgtatgacgtgaagtgcacacagggtggatgtccttggagagtgcatggttacaagccacaacatgacactttatgggtagcttcgagggttgagcaacatacatgtttgttggagaatacccgtctggtgcacaggaacatgacagcggcatttgtggcacaaatggtatattcaaaggtggttagaaaaacatctttgtcccctttcacaataatgcatgacgtaaataaagagtacggatatgagatatcgtacgacaaggcttggagggcaaaacaaaaattttcagtcttaccgtagtttgtgcgacttcgttgagtgggttgatacgactaatccacaacgtgacagggcacgcctatatccatgcagcgaaccattatcggactacctaaggaggaaggatgaatacgaacgacgaaaaactgccgaatccttaccatggcaagtgaatccactgggactccccaattggcgggagcatccagagtgtaggtgtggagaccgttgccaggtcataaggtccgttcgacaacgaactctaggacagagatgcttcgtgtgtcctaacattgtcgacgatgatttcatcgtaagttgcactaatttttactcactatgattacttctgtcatatacctacatacatccatgtacggtcattaatttctgggcacaggaagaagaccgcaaatgtagttacgtaaactggatcgatacggtgcgaagaacttccatcggatcgatgataactcaacctgagacgaccacacaattcattcaagcatggatggagtacgagcgccatgttcagtccgctagcttaaactggagatcaaatccattaggtatacctaaatggtctgatcgtcccaaatgcggttgtagagaacgctgccaggttgcaacgtccttctcacaagatacatatggcaggtggtacttcgtctgtcccaacatagatgacaacttcgttgtatgtcacatgcttaattactaatttacattttgcttcgcgctcccacaacaattatttcccattatctaatttgattgattgttcaggggaatccaaggatgtgtgcttttacttcatggatcgacatggtcaacccgacgtatgaaagcggaagagtaactgaagctgaaacgcaaacagagtataagagattgaaggatcatgaagttgcattacgtacacaatgacgtagaaggggtcaacagagaagcttaaccctgaatcgctctatttcggcattttgttatgttatgttgttgtatgggtcatgaatggattaggtttatctatttgttagctaatgtttcattctcttttccatctattaagctcattactgcatccgctgcaatgtattcaatacccttctcttctttatccgtccttacttactaaattgcgacaaagccattaaccaaaaaattatacaatcaatgaaactaagtaatccaagtattttacccaacaaataaatagtacaatttccccaccaaacattataaaaaccgtaaaccatatacataaaacattacaaaaatattatcctttcttacatattattaaataaataacttattattaaaaataatttgcgaaattacatattattaaaataaataacttattattattttaataatatgtcgaactgcgggagttcgacaccccagcctatcgaacaggggctattcgacaggccctgtcgaactggaaaaacagccgttcgatctcctttccagtcgcgctccggctcttcgatatctaccctatcgaactacagccgttcgacatggtcccaaattcgcgattttccccggttggccactacttttgcgattttccataaaaataatattaattctcaaaaaaattcacatgaaaccccatgccttgctgttagagttttatataatattaggagtaaagtccatcatcggtccctaaacttgtaccactgtgtcatcccggtccctaaactcacaaatcgaccgtccaggtcctcaaacttgttcgactgtgtcatcccggtccctaaacttgctgatcactcgtttaggtcctccaacttgttcagttgtgtcacctcggtccctaaacttggatttgaatatcatctgggtcaaataggacagtgtaaagactttatatttaaaaataattcataacttttttgtgtgaactctaatgaagacaaactttatatcaaatttgtagccctcgacgtgatctataactttgtagttgattttttttattttaagtcatttttgtcccaaaatgtaattttaaaattaaaatttcaaaatctataaacatgcgacaatattttgggaccctaaacagttttaattcaaaagcttttcaactacaaagttgtagttgcgtcgagggctacaattttgatataaagtttgtcttcattagagttgatatgaaaaagttattaattattttttgatataaagtttttagaccgtcctgtttagggaccggggttacacaaccgaacaagttggaggacctaaacgagtgatctgcaagtttagggaccgggatgacacagtcgaaccagtttgaggacctgaacggtcgatttgtgagtttagggaccgggatgatacagcggtacaagtttagggaccggtgatggactttatctaattttcatctctggtcgactattgaaaaaaaaggctaattataaaccatttgatgatgtggtttataacaatttaaatagcgtgaatagccaaagtgtcatcggaggctcaaattagtccttgatgtttcaatatatacatattagtccttcaagtttttattttagttcaaatttatccttgaacccacttagaagccacatggccaaacataactaacaactctcttgataaatgacactttaaccccctcattcacatatataagagaaaaaaaatcgaatgcaatgaatttttttatagataatgcatcgtaatttatgtagaacgaaaataattatgtacttgcaagtgtatacgatagacattgcttaagtttgatgtgcacatgttaaaataatgggaagtatttctgcaatgttatttattcatcttggttttctcttttctagtgtatagttatatacaaattattggcaaaaaggatattttctaacagaaatattgactagaaatagccatatggcatattaagtgggcctaagaatgattttaagccaaaacaaatacttataggacctacgtggacaaaatgaaacctgaaggacctaattgaccttcggtgaaacttgagggattaaattagctattcacccatttaaatatatatggattaattgtttagaagaaaagactaagatgatgagactcaatgagagaaagagaaaaaggtatataaatcaattatccaaaaacaaaactaagttgatatgattttataagataaaaaaaggaaatgatataatttggacgatatatcaaacatccaagagttagaaataattgagatgatatggcttaatgagagaatagagaaataatattacctatacttaataagatgaattttatagatatataagaggcctgtgtgtctaattgtctatttcttccaatctgaaaataagttcaatataggctgtgtttacttcagcgcaaagtttgaattttagttaaaattaaaggtgacgtgactgaaaagttgcgtgtatatgatagattgatgtgatgaaaaagaactgaagtttggatgtaaactttgatctaaacacagccatattcacgagtaatatcaaagcgcatcaacgatcactttttacgagataaattacaacagctcgatgtgtggtgctctgctatgacatgacgttgacgtactcgttagcgctgtactccctttgtataaaaaaaacttaattcttaagtgtgtgtacaatgtttgaccgtctgttctatatgaaatttttttatgattagtatttttattattgttagatagtaaaatatgaataatactttatacataacttatctttttaaatttttttaaataagacggacggtcaaacaataaaaacagaaacccagaaattaagtgtttttgagacggagggagtagaggtgtaggttgtccgggcaacgcttgattggtgctcggcgatggcggctggctggattggttatgtcccttccttccccttctagcagaacagaggagcttatgtggtggctgcaaggagtgagaaggcgtggcactgtggcagtggttaggagcgcttagctccgttttatcttaagttttgaagcaagcaagaaaagctttaatcccagccttttaagtatttccttttcgcttgtttgttatttatgtcagttatgagattaggaaagtatgtactcgtgtaatctttggttatgtatatccacttgtgaatgttgtatatgctaaattcctatctattatttaaaaatacagtaatatcagagcattttccacataaaaacagtccagccgttgtactctttggaactgaggatccaccggaaaaaagattccatttgatttcttaagaaccaaaagacatgtggccctagtctcaattaaagattagctttcgttgtcgaagaccttgaccacttactttgcagtctcgagtgtttggctctttcctacaaagatgtgcacatgttaagaccattagcccaagtcttcggtcatctatgagctctgagggcatatccaatctcttctttctataaagctaatacctattaaacacataaaacttaacatacaagtataatatttattagcactcctaaaacttacatgcaagcatgtcacatcaacccattaattaatcacacaaaacccaatatgtaagtatatattagttatatttacattttagtctgcttcagtcacttcctctcaaccaatcggaaactcttcctcctctcgcgtcacctttccccgggtgacttgggaggcgacgccgccggcgccttcctccttctcccttctcctcccccgcctcgccaccggctgagcgggcactggcaaagccgtgcggccgcaaggacagcggcgggggggccttctctcaccctccacgcgctgggcggccaggggcgctcctcggagcggcggcggcggcggtgtccatatccgggccgggcgcggtcggatcttgcggaggggtctctggcggcggggagtgaacgtggcgacggcggcacctggtagtggacgtggcggtgcggggtttggcggccacggcggcggaggcccccagatccgccccaactcggcctgatctggatggcgattgccgaatggcggtcagcagcagctggcggcggcggtgttgactgctgtggtggcggatggcgacgaagcagtggctgtgatggcggcggcagcggctagcgacggcggctagtgacggcggtagtggcagacaacggtcaacttgtggcgtccgcggctatggaggccgggggtagcggaggccggcacggcgcgaggtggcgcgaccagtggcggtggaggtcggcttagcacggtgaggcgtggccggcggtgccgtaggcctgttacgacacggcgaggtgctgctggtggtggaggaggcgggcacggtgcgacaaggaggagctgccggtgggtgcggtgcggtctacgacgcacgaaggctggccggcagggggcgctgatgcagtggttccacgtgccagcagaagtttgatggtggtggagcatcggagcgccagctgtggactcgcaggtggtgattggcgggtgaaaacccagcccagtctcgaccaggccggcaacgatgacgttcgacgcgtcattcccctcctgaggacgttatcgtgacgtctcatccctcaagtgtggatgccgagcgaaagccctgtctcggttctctttgagaccttgacggatgggggcggcggtgttttccatcgcttctcttcttgaaaacgtcgtttagacatcccctagcggaaacccccaagcaattgatgcaagctcgctctagatttcatcctcttatggcggcgtcctagacactataagttggtcacatcagagggcctaaggggagaagtgtttcattcttctctctcaccctctctctctaacttctgaagacttggatagagcggggtttgtgttgattgtaagggttgggttttgggcgatctcggctgtgttttgttgttggcctagcggcggtcggtcatgcttagcggcggccggttcggtgctagccttctcctggacctgtgtgttggcgttgccggtgtgtgggtggtggtatactttttttcttttcctggttacgactttccagggttgtaatcttgtaattttttttctgctctatcaataaactttgcaccgtcttttgcgagttgttcaaaaaaaatttacattttatgtcattctaaaactaaacatacatatgctaaattatcaatctcaaatcattttcataatatttcaatccaaatcatttcatcatttttgcaatatctaacatatattctgcagcaaagcgtagagcatcatctagtttatctatatctacatatcctatatagttgtatccaatagctcaatatgtattgagccgcatcatttagaaagaaaagtcatttgatcattttcatacttaatcacaaattcacaatcattcatttagtagttactattcctcgttaattagtatataagtcaacattagtgattcaattagtgtagaatattatcgctataaagaagttaggccatcaccatatttaacaccattgcatacactggtggagaaaccctttgtagtcccggttcgtaacccccctttagtcccggtttccaaaccgggagtaccaatccgggactaaagatagagctgaccttttttttttttgcatgcccctgttgctgcatggtttatatatatatatatataaaccatgcatatatatgttatgcaaatgcatttgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgtaaggcagtggcaatactcgcacacgtaatagccgcacaagttagttccctgcttttgctttgcgccctacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctacaagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttcggtatacacctaggaagccaagaaggttttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggattcgtacggtggtcggccttatgttcgaagtgcttgcctttcttccgtaccgggtggtttgctgcaaggaatcgacgatgacccatgtatacaaccttcctacaatgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttacaaggttgcttggggccttgaataataatcggcatcattatgtacttcctcttcatgcatagccagggggggaggttgtagatacacatcataacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattataggaaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcatcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccgatcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagtcccggttggtattaccaaccgggacacccggatctttactcccggctggtagttaaga

SEQ ID NO: 4910 - DNA, 4314 bp, Oryza sativa
ccaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctacttaaacaaattatagctagccattaaatccttcacatatttagcacatatatataacaccttatgtattatgtataatcgcaattccacatcacctactgtcaaacttaaaatttgccactcacaatttatgacacgtgagttttcatctatatataacatgtgagtccagtgatgaattcttaattgtcacttgtaagagtagcaaatagttaaatatctcctgtaaaaagcattgcaagtttactgcctaccaaaatttggtaacaccaaaaattaatagtgctacaagtggtagtaaagtgaacaaagccctgagtcttattagcacattctgagctcattcgagctcgtctcgttgacagccctaccgttagcccacatctttgttttttttttcattttaataataaaggttataaagacatagctttaaattgaagggtcaatttgatctatgctactgtaaatttggctattcagaaaaatactattataattcgcctattcataaccatgccactggaattttacaaaattaaaaccgtgccactgccgtcacattttccatccattctcttccttttccgtcttcttccttccttctcccatcatcttcccggagtcaagccggagagggagcttgctggcaaggtgaacgaacccaacctagagcgtggcgcggatcctggcgttggtctcctgcagggtgcggtcaagcagctcgacacgctcccgcagctcttcatgggactccctcagccgagccaccttccatagctcgctctatcaggcgcgactggcaaatccagcggtgggcacgaccgacgaatccggtggtggcggtgtcggacgatagtggcgtcgggcggaaccggcggaagcctaggctgcgcgtcgagagtgaccgccggcgtgaccctcttcttccccatcgctgctcgacctcggctcccgctttggcctccaggtcggtgagcacctcacgccggccgctgtccctcacggcggtgttctccctgctctcctcgtccgcaggcctctccaaatgcctcctcgccgcctgccgcgagcgccgcaagcggcaggacacctctccaccgtctttaagtcttcgtcgccaccgtcaggcctgctcgcgccatgccgtgccagatccaccgacgcttgctccaccaccgaagctgtcgaagctcgcggcgccatggatgaatggacgaccgccggtggcatcgccgctaccgctcccgcgcgagatctcgcgtgcttgggtctcgctgctgactactctgagcttgccagcttggctctcggaagaaatgcgagaaagaaggagccgccactgccgtgacgcggttctatttttgtaaaattccagtggcacagttacgaatagacgaattgtaatgatatttttctgaatagccaaatttgcaatggcatggatcaaagtaaccctaaattgaaagccatccagattttgcattttgctgcgtttaccagctgaacatgatagcaccatatatttaggggatgataatctagctacacggttacaccctagctaggtaggtaaaattcaactaacatgtccgatatatgaaagctaaattggctatgcacatgagcacatccactctgtggatgtagaggatgggctattatagtttcatgaatagtgatgctattgtcatttgaagatcagtaatgctattgtcgtagggatgagcatccgtaattagtgccctaaagatataggctaactctcttataaaatattatgccttaatatcgtatcaagtttggatattctatggcattctttcgtgtttagctaccactatattgattttgtaacccgttttatttttttagataatggattaaataaaacctggcctctatatcctgaaggatgtacacaaccatagtattacatcatcaagcacttaggcttacaaacaggttcaaaagcaaacgatgccgtaggaggcgaatggacgacaaagacatccagaacaagtctcacaacaaaagattttatctaacacaattcaatcttcctcttcaattccacctagattttgagtagaattccataatgataactttcaattttaggcacccaatctttaaagctttctcatcaccttctttaagaagcaaagaccactggcgagcccgatgcgttaccctgaaaataacctgcaagagagagttaatacttgagccatttaagactacatcattactagcaagccaaagtgaccaatagatattgaatatcggtttaccgccctattgtttttttatactttctgtgcgccaggaccacacaaaaagatagtaatactcacagcatctatactacgttctttatatatgcagcacaccttgaaccacttaattcctactccggtatatacggagtacatataaataattggtgtcaatgtgtcatgcaccagcgcctgaaatcacggagaatagacatcgatgcttcctgacaaaacttcactccatttgttcactgaaccatacacatatagacacctagttgtataaaaatatatctcacgcgttactaatttatgtgtataaatacaaggcatatatacagccctgacgatcgaagcacgtacactactcgatccagcacatcatcatcatatcgatgaattttctgccaattgatcaaagcggagccgataatcaggggcggaaatggcacccccttattgccgtcgtcctcgtcgtcttggcctccgcggccgcttcactacctctgtaagcacctctgagacacttggcagatatatcttgagattgtcaaagtcgtcagggacgtcttgttgtcacccgtatatactgtctataaccgaaagaataattagccatgagaaaaattaaaatccaatcccatcatactaggaattaatagcatatgcacgcgaggatgagagcaagtataatagtgatctataagcttactataagcttatgtggaggaaagagataaacaaaagagaatggtgttggctctcatgcaagagctaacttaacacaagctccaagacaaatagattaaatgtatgagtgagagatagagatagaagaagaaaattataggtaaccttatagctaatctattatatgtgttgactttagtataggttaggggcgcgggcgccgcctcccgccggctgcgccggcttggctgccctcgggcgtgccgagtggctgctgcgtggggcccggccgtcagccgcccacgcccttaggtgcggctgacgcgtgggacccacggcgctggccggtgcgagcccgggtgcgcccggtccaccgtggaccgtgaggctgccgcgtgggccccactcccgtggacccggtccgcgcgccccctcccctcggctcacgcaataaaccctttttaaattaaaatttaaatgaagaaattcgcaaatattcatttaaagagcatataaacttcaaatagccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgatttaacttattgcattatcgctttatttaaattcccgcgtcatcactgttttacttagccatgcctatttacctttgacatgaccttattattataggaattgggattatttccttgtacaccctagaataaacaaaaccccaactagtggacactctactcatggtatcactagtatgattttaggtagatgcttcgcttttaattaggtaacattaaggcggtttacaactctagactttgggaatattcatatacctggacaccatggaatggtttggttattgtggaattggcttcacaccgctccttctattaaaaatcccc

SEQ ID NO: 4911 - DNA, 9296 bp, Oryza sativa
  unsure (1)..(9296): unsure at all n locations
ccacgtacattatttagggtatacactacacggcctacatgccattgccacgcgtgcgcagaaatcgacgcacacgatcgtaagcaagcactaaatttttctcttcagatgattccaaaaaaataaaagaaatcccctctagatgagggatggataatctactccctttgtttaaaatatattttcattatttaataattataaagctaatcatatgtttggaaaagaaatataagtacttaaaatttaacaattcaaatgattataaaggaatattttgactttaccttcatatttttctaaacaacctatagaatccttatattttcccacggggagggagtagcttgtggaagccacagccaaatacaatatgaaaattccaacgatatgtgaaatacattagttaatttcaaatgatagctatctgataacttattaaagtattagaaaaaagagcatctacgttcgctctcacagcttaaaagttctcatgcttatcggagaaacagtaaaaaaaatccaatccatatataaatacaatttaaaattagctaaaattcagaataaaaaaaaggaaatattggaagagaagaatagagtccatacaggtacacagtatagagctaattgaaattcggagttgaaaataagaaaattaaaagtagatgttagaaaccatatagaaatacaattcataaataactaaaattcgaaattaaaaaataaggaatattggaaaagagtatagaatccatatatgaatacgatttagaaataactaaaattcgaatttaaaaatttatgctccaaagaataaattgtttggtcaatttcatacataatttgaaattatgtttgtgtgtgtgtaagaaagtatattgatgctaagtgtgtaatctgaacggttcaccatgctagtttagactaaaagaatagtccatataatttggaagaattcttcccataagacttttatgattaaataagcaattccaatgtcatcagtaaatataaatttttctcttcttttcagaatatgcattatcattttacgatggtttaataactctgaggttcaaaattattattaataccttaataattttatgtttttcattaacatttaccaagttgtactttataccaactcattgtacttataacggttattatttagtcctaaaatcaaaattacaaatattattggatacaaatatcagtcccttggatgaaaaacctaaccaccacttttaccagctgcattcatatattaacttattaaagtaataaagaaaggagcctgcacgtttgctctaacggcctagaaattctcatgttggaataggagactagagtccatacaagtatacaattttgagcaaattgatattcaggattaaaaaataagaaaattaaaagttagcgtccatatagaaataaaatttagaaataactaaaattctaaattaaaaataagcaatattgaaataagagtctacagtccatatagaaatataatttagaaattaccaaaattcagaattaaaaataagaaatattgaaagaaacatctagagtccatataggaatttagaactaattgaaagttggaattaaaaaaataagaaaactaaagtagagcttacagtgcatatagaaatacaatttagaaagaatcaaaattaaaaagaaagaaagattaggataagagtctagcgtccatacagtaatataatttagaaataattgaaattcgaaggtaaaaaaaagaatattagaagaagagtctatagtccatataggaatacaagttagaaatacctaaaatttggaatttaaaaataaaaaatattgaatgaagaggtagaatccatatataaatacaatttacaaataacagaaatttggaattaaaaacaaggaatatggaagagaagactagagctcatacagaattacaatttagaaataactgaaattcagggtttaaaaataaggaatattgaaagaagggtttagagtccatatatgaataaaaaatataaattgtgaaacttaaaaattttaaaataaggaatttatattagaagaggtgtctagagtccaaattggaatacaagaatccagaaataaaaataataatgaaccactatcacgtatatatataatacattatacattggttagtttggtcaagttcatacataatttaatattttgttgccattttaatatattttaataataaagtgtgaatatatatgctattatgtgaaaaaatgtaacgatgctaaccacacaatctgcgcgggtcaccatatatggtagtttacatgatgtgattacaatttttagataatacacgatgtgattacatgatcatgatgtgatatatattgtggttaattagatgagaaataagttatttattttccttccaagtgataatcataatatattccaagtgattgtcttccactactctaagaaaatgattatgatttgcatgatgcttattatcactactagagaaaatgacaattttggaaccggcactgatgtgttccccccgagttaaaaaaaaaaggaggccaccttgaagcatcggctcgaatcgagctgatgcttcgagtgcccccattcccaaccccatnngcnatntnnccccccctcccccccccccctctctctttttttttttgaggagaacgacggcaggagatctgtcggaatttaattagaaaggggaaaacaatacaaagccagttcagtccagaagaaattaaaagaaaaacagtacaacaatacacggcacgaaacaataaaatttaatgggcctaaaagccgaggtacggagatcaagatcttgttttacgatatatgccactgctctctctctctgagattgaaatattgttgaaaactcttctgtttctttctaaccaaacgttccaccaagtggtaagcagagctcctctcgacgtcttcttttgctccttcgatcccacgcaatcaatttgagcccaccaatctgaggttccgacagaagggccatgcaaaatcaacaagagcacacgagcatatgcacatgtcaaagaagcacatcacatactatgaagacaagaacaagctaatcacatcatatatcagaacaattcataacatagatcaaaatcttgcactatggctgaccattgcatgttcaacatatcggactcaccatcccagaggatctgtcatcgtcgttgtagattcccttgctgctcatctcctttgagtcgccgctgtcgccatcaactccttccggtcagaccgccagcccccaagcacgtgcgaggtgatccatggcggtgaggtcagaggcggttggattcggcaagccctggcctcaagaagaacaaatccggtggtcccggcctccaggtgactggatccggcgcagctacggagaaaaagcccgaaggcgacgaggaaatggcgaggaggagagtgcaccgccagggagagagctcggaggtagcaaggaggagcgggcaccgttatggacaaagcgtggaggagcagcgatgtctccgggggagaccttggaggagagatctgaggaacagtgagaagatgttgggatggcattcgcaaaaaaaggagatggggagggcgaggagataggatgaggctagaagacttgggctctgtttgtcggggagacaggggagattgagtctcgttttccacgcgcacgcttttcaaactactaaacggtgcgttttttgcaaaaaaaatttctataggaaagttgttttaaaaaatcatattaatccatttttaaaatttaaaatagttaatactcaattaatcatgagctaatggctcacctcgttttgcgtatctttccaatctcctcaatcatcttctcctcaaacacacccttggggattgacgaaaaaaggagtaggccggagttaatttttttctcgccgccacctattgatgccggtttttctctccatttagtccatcggtgccaagtttttttaaaaaccagcactgatgtgatcagggtcgggttttttagaatgcacacgagtttggagggtacgaaataatctttatcagtgccgggtttaattaaaccgggaatgatagagacaacactgataggatgttctatagtagtgttatctcatgaaaactagatagcgtagtgctgaattcacatgtttccatcagatcgagcatcttttttccttttgccttggcaagttggcatcagagtatcattcactggagtatcggagaaaaaattgggttcgtcttcctcggcagtgcctatttaagctcaccccaccccaccccatgtcttgagcatccaagaatgaacatacttcacacaaaaattggctatctacaacattctcgccatcttactactactgtttctccccttaaagtccagctcccaatcgacggtgcagcccaacaccgactgttgaagtgtataaaatgaattgcccgtctttccctatcagcttaggcttttaggtgcaactggctggtgcatgcaacttaatatggtatcagagccagaggtctcgagttcgaatcctagctgacgcgcaattaaataaaataattgtagcccactctaatattccacgcttgagacttgagggggtctcacctcttcctcccaagtttccacatagccaaaccaattccagcctccatttacagcctcaagaacctgacttccatagacctctcttacaacaatctcaccggtgatttccccactgtgctatacgcttgctcagctttagagttacttgacctatccaacaatcaattatccggcagactccctgacgacatcgacaagctgtcctcagatatgcagcatctcaacctgtccaacagcatcgtgcccatctccgtaatcgctggtggcgtggtcatctttgccgtaggatgtgttgtcgcatcctgcagatgcagggctcgcaatgacgacatgactcctatagttttaagtgataaaatggaggatcatctagtccacaacgctgtggacgtaaacaggatcagtagcacaggcacaacgacaggagacccactgtaccgtttgggggttattaacgacagcagcgacacctacaggagattaactgtgaagaagatgcagaacgagaccaggagtgtggacgccgaactcgagaaccggcgccaaacggaggagaccacgctcggcatgatcgtccaccccaacatcattatcctgttaggctacattcggaggaacgaaatgatcttgattctgtacgaggacatggagaacggcagcctggacaagtggatacaccacaacacgcaggccggcgagaggcgcctgcgcccgccgctgggctggcgaaagcggctggccatcgtcattgacgtcgccggagcaatcctctacatgcatcacggttgtcgaaggccgatcattcacggcgacatcaagccggccaacatcctacttgacggcaacttcaaggccaagatctctggcttcagttatgcccggatcaatcttgccggccgcaacacgctgttgggaaacgtccgtcttcatgcaggggccttcgggtattttgctccaggtgaggcagcataattaattaatgcgtacgttcccaattcagaaatcgttaaactagttaacgatcatgttacttcaggattgactggctgccatttaattttgctgcagagtatgcggacaccgaagtgagcgagaaggtcgacgtgtacagctttggcgtcgtcctgctggagatcgtcacgggaaaagtagtcaacgatcagcacggccatctgacgacatgggcaaaagcctacttgaatacatgggcacggcaaggctacgacgataagttattcaccgacgatgtccttgacaacgatatcgcctctgacgcggcacggtacttgaaggagatgaaggccgtgttcaagctcggcgtggagtgcaccatgatggacccgcagcgcaggccgtccatgcagactgttcttcgacgcctccgccagtgtgcccgctggtggagacgattcccctgtttcgtctgatcgatcacttccatatcaaatcgtcttgtttattacccctccgtctaaaaaaatcaatcctacctacgaacatgtacacacgtgttcactagttgcatcattttctttctgttacaagcaaacattctcgtgcattgaggaggacgggtaaaatgttcccctccatgctttagcgtattcagatttctagtgtcagctaaactagatgttacctcgtatgttgctgtgagactttgtgtgaacaaaatattatatgatttgtgaaacgtgaaaacaaaaaggtgaaaaagaagccattcaataaagagttctacatattggtgggaacataatatgcaactctgagttgtttgtgcttgcgtggttagcgtgtagtgcttggacatgtactggtgtactgtcgtattttttcttgtaactttttctctttcttaatgtatccggatgggcggtcttcctgccgaaaaaacttaagcaatctcttagggttgccaatatgcataaaggtaaactgtactgttgaatttaaatcagagattgaatagaaatacatcatgctaatttggtaaacagcgaatggtaaagtggcaatcacttaaaattttattgaatgaacggatgtcaatccatatcatgactcatgagtgaaactagcagggtgccctgcgcaattacgtggctagtatccatataaaattatctattttttaatatatgatattacttaaaatttgttaaatagccttcacgttgtcttagaaccttaaaagattgaaccttatcatcctttaatttttaattttattgtttttagaagtcatattagccgctacctcttactcttgtatcatccttctattttgtttgcctgatctaccacagcttctacttatccttcttgaaatcttttaaaaattgggttaattaattggaccttctagtttctagagtccattgtctcatcgggttctgttattataatttttagaagtgtcatcaaacgtcgccattgtactcctccataacacgtccgttgtctcccctatttactgttattgggattttaaaaattaaacataattatcgttgggattcatttttttactttatagaagtcccgccaaccgccgctacctccggcactatactcctgtatccatatggcccgcgcattgccttccctatttattatcattgagatttaaaaatcgaataagattgtcattgcaatttattttttactttctagaagtcccgccaaccgtcgtgaccttgctacctaccggtctatttatcgttgctccagttaatcgtcattgggattctatttgtggttttgcttatagtttttagatgttccatcaaccgccgccattttacttttttgagaaaatcccttgtgtacccctaaaattttagctaatcccttctatgcccctgaatttttcttacttccttatatacccccataatttgattttgatcccttccatgcccctcccgtcagttgaccgtctaatttctataaaaatgatcattttaccctttggatgaacatacaaatttatgaattacattattggaaatgtaaaagtttgtcgcactagactattatagtcatgagtttgatgtgtgatacattatttatgacaaaatttacttttagataatgaaataaaatatatgtatttattttatttttaaaaaattcataaaaatgaggagcattcatacaaagataggactacgagtgctcaccatattctttttatgaatgctcccggtaaaaaaatatattgtcctattgaatttcaaataaaaattctttttttattttcaaaacttttgtcaaaattttccgcactaattatttagtttcattttctacctaaaatgcacatattgtgcactcaactgaaattttcaatcgttttcaagcttatattcaaacctaaatcatcaagggcattaaagatatttgccaccaacttaacggtgaattgaaggaaaatgtgattgtaggggcatggaagggatcaatttaaattttcaggggtatagaaggaatcaggtaaatttgagaagtataaaaagggattgagtgagttttcaaggatatacagaaaatttactctactcttttacgagtatattgcttctctcctttttatagttatttgtcattgttgagttttagatgaactactttttttatgaaaatttcttatttttcattgcaatatttttttattacttataaagtttattcctacttgaactcctataattatttttatattttttaaaaaaaattattttttatttcaaattttaattaatctcgtattccgttctatataaactcttcttccaacgttacttatttttagtccgaatttcagctattttaaaattgtatttctacttgaactcttataattattttttctatttttgaaatttattttattttttattctgtattttgatttatctcctattcgattctatatgaaatcttcttgccgcctctcaccccgctgctaccggtgggtaaagaagagaaaagtagacagaacaaaaatgaaaagagagaatagaagaaaaaagagatgctgactaggatgtgggtcccacatacttcttttttctttttgctatctagcatgccacgtcaacgaaaccgggcatccaaactgtcttggaacctttttttgaacggttttacatagttgaggggtactcattttttgaacggttttacatagttgaggggtacacatttctggtattacggttaggggatcccacagactcctcgtacaattgagggacgtcagataaacttattcctcttacaaaacacttcttttttttgagaaacacagtacaaacgcaggcgcacactcacccctatgaacacacacatgcacaccctacccctatgagcacctccggaagactgggccggcatatcttgagattgtttttttagaaacacagtacaaacgcaggcgcacactcacccctatgaacgcacacatgcacaccctacccctatgagcacctccggaagactgggccctatgagcacctccggaagactgggccggcatatcttgagattgtttttttagaaacacagtacaaacgcaggcgcacactcacccctatgaacgcacacatgc

SEQ ID NO: 4912 - DNA, 7753 bp, Oryza sativa
  unsure (1)..(7753): unsure at all n locations
atgctcttctttagaaggatttaatggtggtaacagtgaattttctacccaaacactcctattgtaaattttacaaaacacttcttaaactttttaatactaaaaaaataaatctaaatggatagccacatataaaatcaaaataaggtgaatacttcccttatcaaatacataggtagcacacttcaaaaagatattttattagtagtaaagcacggatatttagctagttgaaactgaaaaaagaaaagagacatggtagaatccaggatgaaaacaaccttcattcaaaattagatatcactttttcccatcaatctttcacaaaccctgtgaagtaccaccagtacttcatcaacgaatctgaaacaagtataggaaagtggacacagtgaaaatggatagccaagaataatggcattctatttctttttcttttaaaactaccaaatatactgacctagacctaactagcagccaaggaaaggcactaccttaactgatacactggtgctcgctcagtctcctcagtcctcccacaaccacaagtccataactccagagcctagcctaagaacttcatatttgagcttccatggtttctcaatcccagagcttctcttatcctgaaagcaaccgaaaggcatccttttttttctttcagcgtatgatttgatgaagatttgggcgccatctgttcaagtctccgtctcctgacaaaatctgtgacaaagtattcggtgtgtcaagggtggttgttctcttcaactcctcgccaattgctcagttcatgacagacgagctcttccatggcagagaaggtgccaaacaacaccggatagacaaaaagaacattttaaatgttaaatttgaagggtgagagtacaagacatgcctcaagaatgctttcaaacctgggatgcatccggttccacacctgaaaagatctttgcaaaccaatccaacaccatattcatatttataggtcagtcaatttaagcagaacgaaatgaaaggataagcacagtacagagtgagtgcacagaaagcaaaacctccatctggaaggccaattcagatcacttcatgtccacttaagcgtatatcaccattctcagtaaggatcgtcccagcgaccacttctgcaacctccatgaattcagtacagttgctacttgccaagctttcaattccttctagttttctttcatccttctcaaccacactttctgaaggcgcctgctctaaaattgtttgaattggatcattttcaacattgggcatcaagcagccaggtcagctagtttcatcaaccaaaccaatagtgccaactgctgcacagctgttgcctgatacagtggacccctcagatccatgtggtgaagtggagcaattagtcagtccaaaatttgcatcatcatgcaactgaattgatgcttcctcacaagccgggctaactgaagcccttctaacagatttgaatgagtcaacgtcagcacctccaacagaatgatactttcgcttgagctgacccaccagagatgctgtcgttgtgcaaacttcagagtcatttttatcagactggtcttgctgctctgcacatattggcgttggtggacgagttttctggcagccctgttcaaatacataaagggggatctccttcttacggacatgagtgacagctagatccatcccggatttccactgtgtatacattccaatttcatgcataaactcgtctactgttccacggatatcaaatttttgaccacgtattttcattccctctttccttgataagcccatgtagaaggcacagtgagcacactgtattgaaggatctgcatattcacatgggttaggatggcattgcagcatccctttagtgtcccgctcaatctgcatgttagaaagacaaacttgcataagtttctaagtatggaatattcatagacctcattttaatgttcacttcaaataatataaaaattgtagtttatccatatataggagtaataagaaactactgctactacaatacagcaacctttagagtcagctgtctcaatcgagattcaatccatcccttccaaagccgaagatcatcatcatcatctgcaacaatgtcaaccactagatatcttgtatatgcctcgaaaaattggaaaggctcaaacaaagaactccagctagccttgttaagctcaatttcctgcatcaaagataggcaatgagaccatatgcagaatttagtgctctgaggcataaagttgaggcatagataatgcacctgacaaatcttattaccaaactgaaattgctccataataaccctcaatgtgctagttgaaacattgtaactagagttcatgcatggatatgctggcgtgatgataggcataacatgtgatctatcacgaggattcttacgtggatcccacacagcaaagccaaggttatcatcgttctcaatggcacaaagcatcacaggatttggccactgccactgggtgaaaactctgaagaatcttgaaaccagcatacttggcacagcattgggataaagttggcagacacgagcaaccaatagggcccagctgacaccccccagcaaaccagtaacctaacaaggaaaccatttggcgtcataacgattcagcaccttttgatgctaatggttttgatccaagcacaaacacatttaagtgtatcatagatgataaaaccaggcttacattagaataaactcctcttctctgtgcccagtacttcaaacatctgagtgttttccggaagatctacatagcatatatttattacaatgacatggtttggactgtataataagagaaatggtgatatcataattaaattacctccgcatttggaacaagtcgaagaatctggtctgccaccctgcacccattgagacttcgaacagttgcttcatcaacatcacaaagtacagatccttgagagatgtcaaaatcctgcaatggtacattaaaaaataataaatatacaatttaacaagttaaaactccctcatgaagtaaaccatacagattaatgtaaacattgtataagctggcaaattaacttttgcctttggcgtcacctataggctatagctgctaatgctattaaagttagcttagacattatatatgtccttcaacaacacttccaaatagcagccttacatagtcaacacattggttgataaaaagtttcaacatagcagatccatccatagttgcagaaactaatgggataggcaaccaatgaagagaatggaaatgggcaaactaacagatgttggattaggcaatcataaaacaccatctcaagcgtgtgttattatgcatagcatgcatttcagttcatgtacgaaatcctaggaaatgaaaacttactggtggtattactggaagagatacactggcatagagaaggtcaattggtagcccacgaaacttgaatttcataactggtacatgagcatcaggtacaggttgcagttcagtcacttcttccatttctgataatgcgccatatagcatgacaaaaaattcctcctggagaaataatactgttaatgtccatcatgaagacctaagtaatccatagacagcatgcaacaaaaagaagacttcacctctcgtttcacatatgagggtccaatacatagtgcatcaatgtctgctccaggcccatgaacctaacaaaagaggccactattcataaagtacacaaaggaaaattgatctactaggaaagtacttacagcaaccaaaaaatattattaaatacacactcttgttaccgtgagttcccgctgataaacagaaacaccacttttcaattttggcggtttaataatctttaataggtatctatgattttatttgtgccaaacatgaccaggaatgattctcagcaatttgtgagattattattgcactaaacagtatattaggaatgtattgttagagaaaaggatgaaaaactttaaactgcataaatatagcaaattttattcctgttttggcatgttaggcttttagacctatccagtgaaggacaagagagatttctagttattaatcagttatagaaaccataggaagagcttccaaaatacattagtacgtgatggagctagtttcgtttgtggggttttttctgttttggtgcaaaaggtctttctctacccttgggtggttgtgtcgaaataagaatcgtatttcttcttatccactgaagattacttttttattctttctttctttattttttatgggtgttatttgttctttgatgtcagcctcttggacatcttttgcttaggttcagctaagtagtggacaaacggaaggaaatgaatatatggatctttcccaaaaaacaggagttgtccacactatcaggtttccttacaggaaaaaagctaccatcaaccaagcagcatctactacctatgcaatagattgtgaaccacaaatgaacagactctaaattctttctacacagctcttgtctcaaataataattatcagatattgttctactccagtctatcatcaatccagtaaaagctgcacaatttgaaaatagttgctagctccaaagaaccaagctagggtatgttattctgcttgaacaaatcaagaaaccaagtatcagcaacaacagtacttccatagttatattcaagttgtatatatatctaaatggaagctaaaaagactgacaatttcaggtgataacgaattggttgtgcttgactcactctagaaagaaacatcaacatgatcatttaactgtggtagaaggaaaaaggaacaaaaagaagcatttacccccagtctgtaagatccaaaagtgaaaaggactgcatttgcctctttaaccatttgctcactatatcctttctgaatagtgaccttcttcacccattccttgactatctgcaatatcacagacgcagagaagacctcataaaacaacaagaaagggctaattcttatacaaagaaaacaacatgtgagcatatacaaagttaatctgcattaccatgcgcaggtaatggcaagctccaaatcaagaatattttgttcatatattggtagttaggacttttgtgccccagaggaagcactagcaattggtatatcgtactcacgcaggcatcaacacattcatgcacagtaaatcattttggttagaataatataaaaccgaaacaacacaagcgcatgaaagcaatgctgcctaagcaaagtccggcaacaaagtgcatgaatttaagcgataattacatatccccttttgcgcccaccgcctaactcgtataatattcagagatatcaagttacattgggttaacaaataactagcactagccattgatagcaagtaagagtggaagcaacttaattacctgatcaatctcccgaagaacctcctcccgtttcgcggactcctcctccccttcataaaaggccggcttcaaccaagaactgaaaagcaaagttttcttagtgacacaaaagcaacatctatcactagtaaataacatatgcatacacctacgccgcaacacataatcaattactaacagtggatagataaataaccttctccaactcagccgtcttgtggagatcggcgacggtcggcatggccagagacaagggcggatccgcgccgccgccgccgccgctccgcttcggggacgaccgaggcttccccctgaccgcgacgaaagatcccgccattgaaaccaccacggaacccacccaaacaaacacacaaacaaaccctagacgcgcgagattaatggagtctccccccctcccacgcgcagcagctacctacctacctacctacctacctaccactctaccagtgcctcagagaccacgaatccccgccgggatcacggcgaggccgtggattttcctctcacgaaaaaccgaagccacgcgcctcaagcacacccctcccccacccccttggatggcggaatcctaacccggccgggttatccctaccgcgagcgagcgagcgagcactccggtatgacgagtgtgcaaaatcgcgccggcgagcaacggtggtggggtggtggcggcggcggaggaagaaaaaggtttcggttgcgttgcgggcggaggagaagagcatgaacagtggcggctggattaggacacgaggattgcacgtgacaaattttcatttttcctgttaagagtaagacccaatcgcttatatacaaagctgccgagaattgagcctcgaatcagcgtttgccgctggcgtggcccttgccggggcgtgacacgtcgtccggcccttctccggagctgaatttggaggctgcgcgttgcttgcttcctccgtcgttggatgcccatcgtgcgtccatgcctgcccgacgctgatcattttgcaaaaaagcccttaaactaattgataatttggttttagatctctggtatacagtttctacgttctacgttattacgtataggacctctaaaaatgaaatgttctaatcaaagaagcaaaaaacagaaaataggactgcgctcgaaaacatagaaactaaggggcttttctgcaacaacttgcatccctatcccggtccctcaccccacgaaaccctagccgccgccgttccgtcacctctctcttctcgctcgctctccctagaccacaccgncgnatncgcctncggctacgaccactcttnttgcacccagccaaatcgccgcacctcccccttgccaccgcgaggccagttccggcggagggtagaccgtgctcgccggattcgggtagccacgacctccttgccggcggatccggtcacccggaggcaagggcagggctagcacatgaggctcatcggcagtgtcgcggtaagctccatggggaaatctctgctccccaccctcatctttcttgttgctctccttnctaccccctccccctccctctctctctctctctttgatctagagacggcgatagatccagagccactggatctgttgatcttggcggcggcgatgtggcaccaatctcagacatttcgtgtcatcggtgttgctggcttgagctcaatggtgacacgctcagtcagcgaccgacgagtaccttgattcggcggttgcgctggagctccatgaccaggtgctctatccggtgccgcacagctcgatttggcgtgttgggcggtcaatgatgagttcgtcgatccagcgacggttctctctgtctggttgcacgctactctgagtattccaacaccgtgctagatttggcgaaatgagtaatacggtgctgcacggaagcttgaagccgctccgaccggcggcggcggcatcaagcaagagtagcattgtatgcggccaaaaaaggtcgtctccatgtgcctctccactgccaaagccatacaggattcatgtgtatctgagtcccttgctgtcgttgccgccgttatgaagtcgttctcatatgtgacggtgaccagtgggcagcggcacagacaatgtttcagatggctgcctgcttgcctcttaccaccactcctttccttttttgtcatgctttctctttctccctttgtatgtgtgttgcagccttgcaggttctcacaatcatgtatttctgaatttgtgcaggttcttagcaaataactcagatttccttgagcatatcgtttcagaataaaaagcataag

SEQ ID NO: 4913 - DNA, 6847 bp, Oryza sativa
ggatgggttggaaactatgtcacgtctttcgtctgtataccgtgctggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggcgttgggttaaggcaggttcgtgtgggttcacggccttgataaaaaaatattgtatagtactagaatcgtgtttgcaaaatagccctaagcaactaatgtctttaaatgctgtctactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtatgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagaacccccttgaccctaggacgagccgtagatcccaagccttagcagtattttcgaaataaaaatcctctgttatttgtgaaaaccctctagtctttctctgtcttgctgcttcatttatcgccaaaatctgccctttttaaatgttgcttttctttttgtttgtagatggccggcaacgtcacccgtcgtggtttggacatgactggtttcgtcttggagctgcgaggcatgtgcgttgtcctggggtatccacatggagtggactaccagggcaggccgcttccggagcaggagggtgacgatgcagagccccacgctgcttgggaggtcactgcagtgatcctcgctggctctcccgagcggacttcgctggccgtcaccgcgggtggagattctttccccgccgcttgccagagcgccgctctcctcgccatcggcactcttcaccagcactacccggacgagttgcagcactcgccctaccgctaccaccctcgccgcggaggagcccgcgactacgccaccttccgggatgctagctcggaggatgacgcgaccatcctgcacctggcgcgcatggtggaggcgtacgacgcggctcgtatcgacttccatcagatggtgcgccgtgggatggccgagaacaacatgaagatcctggagctgcgtcaagagaacctgcagctcaagaaggacctagacgcggtggaggcgcagctgcatcagctcaagatcgctcagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccaagcctgcgcccgtggttccccaggagggggaagcctccggcgttggtagcacggaggatgcgctgttgctcaccttccgtcctggcccgtcgcagcggtagatgagcagttagtaggcttgcgcgtgtgttctttctcgtttgtcttcttgttggagttgtgtggggcatggttatgccggtgtgtggtataactgtgtcggagcctgtctttattttatttgcctaagcaacttgaactttaatgaaccaatttaatagcagtaataaattcaagaattatggtagtcgtggatggttagctttaattgtcagctctctctgtttgctggttctgtgtggggtttccagatggtgacgaccaggagaagtgctgccaccggtgatggcaaccaacctgaaggcagcaaccaccaccaccagggcagcccacctccacctactcctccgcctccaccaccaccaccagacaccaacgccattctcacccaaatcctcgcccagcaggccaacatgatgactgctttcctccaccacctccaaaatccgccacaacataatgctccaccaccacctccccaacactctaaactcgccgagttcctccgcatccgcccacctaccttctctagctccaacaaccccgtggatgcgttggattggttgcatgccgtggggaaaaagctagacactgtgcagtgcagcgatgaggagaaagttatcttcgccgcccaccagctgcaggggcccgcatctctatggtgggaccatttccaggctacgcagccagaggggcaacctattacttgggcccgtttcaccgccgctttccggagaacccatgtgcccgccggagtcgtggcccttaagaaaagagaattccgagagttgaagcaaggcaaccgctccgtgacggagtatttgcatgagttcaacaacctggcccgttacgccccggaggatgtgcgggaagatgaggagaagcaagagaagttcttggcaggaatggaccctgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatcagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacaccaactgtgcagcctggtcaaggccgcaaggacgctcaaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccacgtgacggccgaggacgtgctgacaactccagacgtcatcgttggtacgttcctcattcattccatccctgccaccattctgttcgactctggagcttcccactcgtttatatctgtgccattcgtggggagaaatcagttgggggtagaaaggcttaggaaccctctgctcatcaccacccctggaggggttatgacagcaaagtattatagccctgccgtccccatagaaattcaggggattccttttccctcggatctgattctgctagacaccaagaacttggatgtgatccttgggatgaattggttggctcaattccaaggagtagtggattgtgcgagacgcactgtcactctgtaccgagggccggaacaaccggttgttttctttgcacccccaacctctgtcagtagttcagaactccatcagataggactgttagaaatccccatcgtcagagagttcggagacgtgtttccgaaagaactacccggcatgccgcccaaacgagagattgagttccggatagatcttgctccaggaaccactcctctgtacaagcgaccctaccgtatggcagcaaatgaactggccgaagtcaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgatgaagatattccgaagaccgcattcaccacgcgatacggactgtatgaattcacggtgatgtcattcggtttaaccaatgctcctgccttcttcatgaacttaatgaacaaagtgttcatggaatacttggataagtttgttgtggttttcattgatgacattctgatatactcacaatccgaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaagtccgcagtttcttaggtttggcaggatactgccggaggttcatcgagaacttctccaaaatcgctcgacccatgacacagttgttgaagaaagaagagaaatttgtgtggagcccgcaatgcgagaaggcgttcaaaactctcaaagaaaagctggttgtctcgccagtgttaatcttgccggatactcgcaaggatttcatggtgtattgtgacgcttcgcgccaaggattggggtgcgtgctcatgcaggatggtcatgtggtggcctatgcctcacgccagctacggcctcatgaaggcaactaccctacccatgatttggagttagctgcggtggttcatgctctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactgtcatcctggtaaggccaacgtggtcgccgacgctctaagtcgaaaaagccattgcaacactcttaacgtccgtggcattccacccgaacttagtcaacagatggaagccctgaacctaagcatagttggtcgcggattcttggctgcattggaagccaagcctaccttactcgatcaaatccgcgaggctcagaagaacgatccggacatacatggactcctcaagaatatgaaacagggtaaaaccgctggtttcacagaggatgaacacggaaccctatggaacggaaatcgagtatgcgttccagataacagagaacttaaacagctgatacttcaggaagcccacgaaagtccttattccatccaccctggcagtacgaagatgtacttagacttgaaggagaaatactggtgggttagtatgaaacgggaaattgcagagttcgtggccctttgtgatgtgtgccagcgtgtcaaggcagagcaccaacgaccggtcggacttctccaacctctccaagtacatgaatggaaatgggatgaaattgggatggatttcatcaccggacttccaaagacccaaggtggatatgattctatatgggtagtggtggatcgattaaccaaggtagctcgattcattcctgtgaagaccacctatggagggaacaaactagccgagctctacttcgctaggatcgtgagtctccatggcgttcccaagaaaatcgtatctgataggggaagccaattcacctctcacttttggaagaagctccaagaggagctgggtacccgactaaacttcagcactgcataccacccgcagacagatgggcagaccgagcgtctaaatcagatcctagaagatatgcttcgcgcatgtgtcctggatttcgggaagacctgggataagagtctcccctatgccgagttctcctacaataacagctatcaagccagcctcaaatggcaccttatgaagcgttgtatgggcgcaaatgccggacaccgcttttgtgggatcaagttggggaaagccaagtgttcgggactgatatcttgagagaagctgaagctaaagtcagaaccattcgggataatctaaaggtggcacagtcccggcagaaaagttatgcagataaccgtcgccgtaacctggaattcgcagtggacgattttgtgtatcttcgggtcacgccattgcggggtgtacacaggtttcagacaaaagggaagctcgcacctcggtatgtgggtcctttccgtatcgttgcccgacgcgaagaagtcgcttaccaattggagttgcccgcctccttgggcaacgtgcatgatgtgttccatgtgtcgcaactcaagaaatgccttcgagtgccatccgagcaggccgactcagagcaaattgaagttcgcgaagacttgacctacgtggagaggccagtgaaaatcctggacaccatggagcgcaggaccaggaaccgggtaatccgttttagcaaggtccagtggagcaaccacgccgaagaagaagctacctgggagcgtgaagacgagctgaaggcagcccatcctcatctcttcgccagttcttccgaatctcggggtcgagattccgtttaaggggggtaggtttgtcgcgtcccaaaacgactctaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccctaaaaagtccttcttcccccccttcccctcttgggcc

SEQ ID NO: 4914 - DNA, 12035 bp, Oryza sativa
tccgccgtgcctatggccgccgccggcgaccataggggcgcgggcgcgtcgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgagaggctgccgcgtgggccccactcccgtggaaccggtccgcgcgctcctttctcccggctgacgcaataaatatgtttttaaattaaaatttaaatgaagaaattcgtaaatatccatttaaagagcatataaacttcaaatggccataacttggccatttgaactcggaattggaccgatcaagtctctaatttttccttaagaagccaagaacccatttttgtgctttgtttctgcttgttatatggagtttagtagagtaaaagccgtttcttttccgttgtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaaacttattgcattatcgctttatttaaattcccgcgtcatcactgttttacttagccatgcctatttacctttgttatgacctaataataattgttattgttattattccctggttaaccctagaataaacaaaaccccaactagtgaacaatctactcatggtaccactagtatgattttaggtagatgcttcgctggttaattatgcaacattaggtggttttacaactctagactttgggaatattcatatcacctggacactatggaatggttggattattgtggaattggattcacacctccccctctattcaaaaccctcaaaatggttttaggctgggctcggggtgcatggttttgacagtagcacctcggccatataaggaccggtcatcgggcctctgttgcaaagcactaccgtacttccacatgtctagtgggtaaggcttagtttgtgtgtcgcgtcccaaaacgactctaaaatacatcctcaaaattatgcatagaataagtaaaatccatgtgaaagcctccaacaattaaaatgtgcaaagttaaaagtcaaataaggtttggaggatttttgtatatttcctaaaagcctaaaatgcgtaaataaattttagtggaattttcagagcacaaataataattattaagaaataaacaaagttaaaaaggttttataaaaagaaaaaccctaaaaagtccttttcccccccttcccctcttgggccggctcggcccacctccctccctctctctcctcttccccccgcggcccaatcggcctcctccccgcgcgcgtgccgctgacgggcgggcccgcccgccaccctcgctgacgggtagggcccacccgtcatcccctacctcccgccgctcccgccgcctcgcccgtgccctagcgccgccgccgccgcggattccgccgcatcccgccgcccccgcgtgcaataaagtgaggggaatcattccccgtgattccctctccctttccccccatttttccctctctctctcgcattcaaacgggcggatttgcccccgcaaatctcgccggcgccattgatggagcccgagagcgccgcgccggtttccttctcccccggccgccctctctcactcccaacactatataaacgctccccgtgcctccctccaccgtttccgccactcgccgctctctctctccgccggaatcaagctcgcgccgtcgctctctctctccgccgtcaccgccgagctccggtccgccgccgtcgtcgcctcggaccttctcccgcctcggcgtcgcctccttcggctccgccgcgtcctcgccgacctcgtccacccctccgtttcgcccgccgaccgccggaacgccgccgtccccgtcgacccgtgccgcgccgccgccttcttccgctccggtcgccgttcccgtcgtcgtcgtcgacccggggtgagccgtggaccgcccatttcgtttcccccttccctcccctctctcggccgccgctccgccgtgcctatggccgccgccggcgaccataggggcgcgggcgcgtcgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgagaggctgccgcgtgggccccactcccgtggaaccggtccgcgcgctcctctctcccggctgacgcaataaatatgtttttaaattaaaatttaaatgaagaaattcgtaaatatccatttaaagagcatataaacttcaaatggccataacttggccatttgaactcggaattggaccgttcaagtctctaatttttccttaagaagccaagaacccatttttgtgctttgtttctgcttgttatatggagtttagtagagtaaaagccgtttcttttccgttgtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaacttattgcattatcgctttatttaaattcccgcgtcatcactgttttacttagccatgcctatttacctttgttatgaccttattattattgttattgttattatttccttgttcaccctagaataaacaaaaccccaactagtggacactctactcatggtatcactagtatgattttaggtagatgcttcgcttttaattaggtaacattaggcggttttacaactctagactttgggaatattcatatcacctggacaccatggaatggtttggttattgtggaattggcttcacaccgctccttctattcaaaatccccaaaaatggttttaggctgggctcggggtgcatggttttgacagtagcacctcggccatataaggaccggtcttcgggcctctgttgcaaagcactaccgtacttccacatgtctagtgggtaaggcttagtttgtggctcagtctagtcataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcataacaactaaaatgtggaatggttggcctgggttggcttgggacgagctgggacccagggtcgggtttccagttcggtctgaatcatcgtaggccttgggttaaggcaggttcgtgtgggttcacggccttatttaataatattgtatagctctaggagcgtatttacaaaatagctttcagcaactacgtgtcttttaatgctgtttactgcaaaccctaaccctttatattatgactcccttgtactcccttgcatttattctgcacttgtgggtgtgtcttgttgagtatggtggttgtactcagtcttgctcaatttttcccaaacccagaagaggagcccctgtatgatgaaggctttggtgtctagctcgtgcctgccgtcaagcgcctgtggtcgtcgccctagtcttccgctgttttccgttcgtctttgtgtgtgctgggccttcgccgcccatataataaattatctatttactcttccgcttgttaaactctgaactgtatcaacttttggtgtaccttgccttctgggacaaggaataatgcacgcacgtaaggaacgcccgttgggttatttccggtcgtgacattagggcacccacaatggttatctataggctctctacaagagatccatgtcagcatattttcctacttggaagagattaaatgaagagaaagagagcaaagctatctactaacctggaaatagtctatagagaaaaacgaggtaatggattagagagctatagatacccatgtagacataccattgaagtggtttactattaatctagtctattgctgagatgtacatgttttatagatagcatcttactttaccattgcgggtgctctaatagtaggaagtgggctatattattatccttgctctgagaatgtttttcaatcaacgtttgaccattcattttattcaaaattttccgttagctgcgccagcatccagcgcagaccggagaagccgacggcgagtatgagccttgctggcggcgaggtatccggcgccgtcctcctcacacaattgtgtagcgcagctgccatctgcgtggcgggatggttggtgccattgccggcagccggccaggtggcgaggtcgggaacatggaagcaatgctgctccatcgatttattcctcagatcagcagcatcgtcgcagcaaatgcgtcgacagatgagctgcaggttgatcagtgatcagcaaaagcagcaggaggaggaggacgtggtggtcgtcgatcgacgacaatctttgttgtcgctgcggccgcgaagacgtgatatcggctgaactgctgatgatcaagaacctgcagtgccggttggaggagaccatgctcggcatcatccgtcacgacaacatcgtcgtcctccggggttccatccagagtgacgacgacgacggcacggtccagctcgtgtacgaggacatggagaacggctgctgcctccacgaatggctgcacggcaaccgccgatcccagctggaggccggcgagaggcagcggcggcggcggctgagatggcgggcgcggcggtccatcgccgtcgacgtggccagagcaatctgctacctgcaccacgattgcaaaagccccatcatccaccgcgacatcaagccgaccaacattttgctcgacggcaacctcaaagccaagatagctggtttcggtcttgcacggatcaatgttgctgggctcaaccaaccgttactcaacgtagaaattcctagcgaggcctttgggtatactgctccaggtgaggtgatctttaatgcacgatcaattccgatattttttaaaaaaaaacagaaatagattctactttatcataaacataattaaaggcaccatgattaaatcattatttaggtctggtacaactcaaaatccaaggtttcttatagctaaatattcatagctacataaatttgttgatttagtccatgcatgattacgttgataacattagataaatcgttttatttttattttagataaaatttgtaattttaaaccactataatttactatggatttgggatttgaagttgtgctaaacatgactttaccatttatttgtaattcactacatatatattgacatgtttttttccctacagagtatgcaaccgcgcaggtaaatgagaaggtggacgtgtacagctttggtgtggtgcttctgagctcgtcacgggaagattgggtaacgagccaggcgtaaataatgggcacttggctatgtgggcgcatagagggtacggtcgacatctcagcaaggacgtcgttgataaggagatcgtccctgatatggcacgatacttgaaggagatgaaggccatgttcaagctcggtgtggagtgcaccgctatggacccacgggagaggccgtccatgctgacggttcttcgtcgcctcaccaagcttggttccgtatatgtcagttgtttcaattcatgtgataattaactatagtggggatggcttgtatgtagtgcttccttcagtcattaatatataacattttttttctatttgtaagtactactcactttgcccaaaatataagaacctattatgatgagatattttctagtagatttatagtattagaaaatgtcttatatttattctatttttttatattataggatagagcgagtatatgactccgcacttcgtctaggttaattaaatagcgcgactcatagccctaccccgtttgccactgtgctagcgtaattatttcaccatcaagtacacaatgaagaacgatctcaaaatggccggcgtattaagttttcaagtctatctgtaatctgtcgatgaactttctcaatgcacgagtcatggaatgagtacggagcgccagtcggtcaatgaccgaattgttatacattctgtcattatgatattattatatttgtaagagctccaacggttagcctaataagtcaaagcaaaagttaaaatttaaaattttaaacttgattttgaagttggttttaaaatattttcaacgtaatttctttttagcgttaggtttttagtcgctacgaacaaatatacaaaagttttatctataaattaatttgtattctctaataagtcgttttagcttataagggagtatgtgccaccggtgaggctctaatattgtagtcttagtctttagacctatcttctatctttgtcggctctagctagtttctgcttgttctttacatttacgtttctttgggaagtttcattcatggatacaccaatatatgcttgggtattatcgatctacctaacgaacaaatcaaggtttgcaatctcgaagtttggtttttttcgcgtgggggtgggggggggaagaaatttcttagccgaaattatttgaaaatttgacgaatgttgaatgattttgaaggaactttaaccaaattcgaaaaaaaaatggataacaaccgaaaattttagacgagatttgtgcttgccgttgatcggtggagggcgaaatttcgtttcgaaattgcaaatcactggaacaaacacttggttcttgttcgtcggagtataaccctctggacgtgctttctagtctgttgtgtcagtatcagattgcaaatcgtaaaatgatatcattgaagagcatcagccagaagatcaatacaaactgatcaattatttaagtggaaatatctgtcaagctgtactgtccttgcgtagttgtgtattatcgaagaccttgaccaatatagcccctaaacacacggtaaagactagacaccaagcttcaagtctgcagtagcgtactgcatacgtacactgattaattagtgatcatcaactgagagattctcactcactctccaagtcacagcctcactgagtactcattaaacaagcaatcaccactcgtaaaggctaacgaaaaatgtccaataataatactagtaatattttattactactgctcctcttcttcttggggtccggtgctgagctcgatgacggcggcgagctccaaacacttctaaccatcaagagagattggggtagccctgctgcactcagctcatggaagtgagaaactccagttctttcagtcactgtaattgggcaggaattggttgtagaaatggccaggttacatccctctccttccacaacttccaaatagccaatctaatcccagcttctatttgtagcctcaagaacctgaagtacttagacctctctttcaacaatctcaccggtgagttccctacggcgctctacagttgctcagctttgcagttccttgacctgtccaacaatgagttcactggcaaacttccggaacatgttgacaagctgtccttggggatgcagcacctcaacctgtcaagaaattctttcatcggcgacctgccatcggctattggtcggttttccaagctcaagtcgctggtgcttgacagtaacaatttcaatgggacctatcagggtgctgccattggaggtctcgtggagcttgagatgctaacattggcatataatccgttcaaggctagtctaattccaaacgagtttggcaagctgactaagctgacatatctgtggctatcatggatgaacctgattggtaacatccctaatgttctgtcagcattgacagagctcgagctattggacatatcaataaataagttggaaggaaaaaatcccaaagtggatatggaagcttcagaagctcgagatgttgttcctctccggaaacaatttcattggtgagattggttctgacatctcagctctcaaattgcaggagcttgatttgtccatcaacaagctcaccggatcaataccagaagatattgtgaacttgaagaacttgaaaattctatacttgtactacaacaacctcgttggacaaatcccaagtggtgttggaatgctgccgaatcttaccgaccttcggctattcacgtgccatggagtgtttccggtgagcctcggggactgcgacaccatccacattatcaaggcatccaacaaccactttgttggggacttcccagagaaaatatggtcgtgtgcgatgcttaccatagttatgattggaggaaacaacttcaccggtactctgccaagttagatatcatccaacatctcgtagatttagataggaaacaataggttctctggtgcaattccaacatcttctgcaactggactccatagatttttagcgaaaaataatttgttctctggcatgctacctccagacatgtccaagctcgccaaccttgtcaggctggatctttctaggaaccaactatctggattgattccaacatattgttaaacacaaaaccacctgagtattttatatgttactctgtattttgcatgttagttcaaggccagagaggcagagatgcacacacacattcatatcaagctccatctactttattcgtcgtagccttgtaggagctatggtgtgtgggcaatggtattgagtggctaatgtgcatcgtggcctacgtctatgttttttttcttttaagaataaaggtaataaagacctagctttttattgaaagccatctagattttgctggggttacctgcttaacatgatcacatgtttaggggatgataatctgactactcgcttacaccctaaacaggtatgcaaaactcaaataacatgttccatatatgaaagcaaaattggctgtgtacaactgtacaaccgctctatggatgtagagtctggtttcaatccatctcatcataaaaaaaaatgaaagctaattaagaggtagaaacaacagagctagctataagcaggagtgcaggagcctcccctgtgaggtatgtactggagtacctagcaaaaagaacacctaccagaactactttgataaatgcaaacagtgatgctattgtcgtttgaacatgactgataagtgtctctaggacagggttttcaattttgatttcggctaaaatttcggccatttttatagaaccgaaatttaggttttattggctgaaattttctaaaattttgattaaattcacaaaaaaattgagaaaacccgaaaatatcgaccgagatattgacttgccgagagggttttcgaaagagagaatccattatatgccactgactttatcacaggtctatgatataccattgattttgttacgttttacaatatatcatcgacttttgcttaacttctacgatttaccatcgccatcgacttttgcttaacttttatgttcactgagttagtctccgttagtactgtacaaatttatcgaaatgaccaaaatacccctgggacagaaactttcaaaaattttgaaatatcggattttaagtttttgccaaattttggatatttacaatcttatgtttataatatgatattttagaatttttattcaaatttcggaagtttttttctaggagtattttggtcatttgggcaaaattgtacggtgctaatggaggataaccggacggcgatggtaaatcgtagaatttaagcaaaaatcggtggcatattgtagaatgtgataaagtcagtggcaactcatagatctgtaataaactcagtggcatataatagattctctctttccgaaattaccagaatttcggaaattttgaaactaaaattacaatccctgctccagggctgcattgttcataaggatgtagtacgtcgtagcatcttccactgcaagagtaaagacatgattcgaaagacaacaattagcgacgtgtccattttgcagctttatcggtctataaaattattaagggtgagtaatgctgtgaaaatcaaaattttatagtataaatgtatggacggattaactggtatgaacacgtcctcggccccaaggcccaacagcccaaggctaacattctgtcttggcccattacgcctactttccattgctgtcaagatattcttatggaacttgtcgagaaaacagaaagaaatcagtccagcaaacgcaacaggcagcattatatatcagccttgctaataataaacggcatcaattgtctctaattacagaaataccggctcgggttacaattatctatttatagccagcatcaattacgataattaacattatctaaaaaaattgcgataattaacactattcacgaggcctctatataaatagatcatctactcgtccagtacgagagcctgcagattatattcttctctaaaagatcatcgagccctgcaaaaatcagaccacaaataatggagatgaagaacgtcgattctcggttgctgtttctgctgctgctgatcatcggatgcgctgctgttcctgcagtgcaatgtaagggcaatcctaattagaaattatcgactctgggctacggcgggagccaaacgcctagtgcagatattgccttagtgtctattcgatctttgtaaatattaccttttctccttacatgtaaatattgctccctgctttattcaatgaatggcaagcattgccgtcgttcaaaaaaaaaactatatactcagcgggtgtggttggttcaacataaactctcatccaatcacctctcttatctctcctttttttttatctattgttttcattcttgatttatgtgtagaggtagtttcttactaatgatttcttcatcttttttcatctctcctcattaactttttagatacctcggtttttgttttacatgaaaatgcatttaacactataaaaattagatgagatggaacgttgagtgcccttagtttatctccacatatattgttaattgactttgtttcttttggtggaggtgaacttaatgattcgaaaaggatctcttagcatgaacacctaataaatcttatgcaaaatagggtagaacaaagggtggattattgaccagaattgttgatgccattaattgttcgtggttcaaaagcctctgttgatgtaggtgttagtgtagtgcagattcacctgcagcagaaaactcaacgccaaaatggattagcactggtgcatgtggaccttaattaagatcgatggcgtatgtatatggttttgggggtggcttaaatcaaagtccaaacatctttttaattagtctcgagaatactgatcaatatatatacagaaaattccttaggttcctcggagttttcaattaaatttttcccctaaattttgtttcgttccttacgtgtctgagttcttgattattttggattccaatttccaatccgtgcattctaaacccttgaagcccagacaccttaaagcaccatatgaccgtcctatatacatctagctagtcgactgcgagttaaccgttagactctttt

SEQ ID NO: 4915 - DNA, 18376 bp, Oryza sativa
ccgttagactcttttagaaataataattagcatacttcctctgttttatattataagactttctagcattgtctacattcatatagatgtttgctataaaagtcttataacctgatgaaacggagggagtagcttcaaggtgaaaaagattcgtttatgaaaagaaaaaaacaaatggagcagaccaaaaatttaatatttgtaaatatttttaaatgtttccactgaaatttaaacccaactgaaaaaaactttgccttttcagtttcttggtgaatcttttgtatgtgtttcatcaaattcgtaaaaaaaaactattttctatatttggggtcataattatgtccagtttgattttatcacaattctttttagattatgtttacaaagtagaaagcataagtacgtatgacatataagtcattttgaaaaaatctaacagtcaactaatagaatagatataaaggagataaaaaaaacgcaaggacatgtaaagataagataaaattcatgaatatagaagggattctttgagcaatttgtttctatattctttgtgcaagttccatttaaccatcattttcaccatagcatacatatgtgtctgtgctaatgatttaattattgttttgacgttgtaattaattaattaatatttaataggccggagcaatggtgacatgttgggagagaagatcaacataccacctgggccgctatgtgcaaagcgaccagacctctgcaagaactgctggtgttgtgaggtcagcgacgggcaatgctaccagagtctcgaggcctgccaggtcaactgcccattaccatcgccaccggccatttgatcagatctcgatcgatgcatcatatcgtttgtgtgataataagctgatcaatcaaccaataaagaaggcattaattaagtatcgtactctgttcgttttggaaataaaatgctgatgccatcaatggatgcatcatgcatgcatgaattaatgttctggaaaatatgtgataatcacatgtcgtgaaaacttgaaaacaaccttggataaaataaaaggacacctgatatttatccacgttatttagagtaaaaattttacttgcggatttaatcatgagtaaaaattttactattgatgacgtggataaatctcatacgttcatttttaaatccaacggtagctttcaggtttgtacgtgatatattttccttcttaataacgtttatagtgccagatatgggacaattgatcttttgtccatattttaaagtctaactataactatacacatttgaccctacatttttaactttgcttatttgatcttattttttttaaatcgaagttgttatttggccctattgtataggaatagatttagaagaaaataaaaaatgaatttagagagggaagaagacttaactgccccctgtgatttaccaaagcacatacgcgcggctagagttacatgggcgcggaggagaccaatctcatgagcacagagccaatctcggtcagcaaccaaattgttacacattctgatatgcaatacttatattattatagtctttagacttatctttgtcggctttagtttctgcttgttccttggatttacattcttcggaagtttcaataacggatccaccaatatctgatttagacagattattgtgtgctttggtgaagaattagtacttaactggcccccgcgtcatcctcccttacgggcgatacgggaggcagaaaccaccgccatcgtccgctccccctctttcctcctccgcctcgccgccgcccgagcggccgcaaggacggcggcggcagggcttcgtttctctcactcgccaacggtgggggaccgtgcgggatggtgaaggccgcccagatccgggccgtcgcagtcggatcttgcagggacacagccggcggcagggtagtgtgatgaggcggcggcggttggcagtggtggcggtggagtatgaaggtggtggcgatgaaggagaagagaggggatccgtcggcggcggggatgaagatggcggcgaggatggcgacagcgggcaggactcggtcacgccgaaagcggatccggccccctgaggacggatctggtgcagggcgaggttgcagcggtagcggcgcggcggagcttcggcgacggtgtcggtcgcaacggcgcagacttcgtggtgacggtgacggtggcaacggcgtggagcttgtggcgatggtggcggcagcggttggacgacgccgacagcacggtggctggtcgacggaaacggcggctgccggcggctgtggcaacggggtgcactcacggtggtgatagcggcgcggagctcgtggcgacggtcgcggctggacggcggcgagggggctacggctagtcggcggcgaggtgtccgttggcagcagcggctgcggtggtggtgaccgtatctacggttggaggaggcatggcagtctcggacagctaaccgggggtgtggcagacggccgcacctggccggcgtggtagcgattggaggggtcggaggccagcttggtgcagagaggcgcagccgatggcagtggaggccagtaaggcgcaagaggcgtggccggcggcgaggaggcccgcttggagcgagaggcgttaccgatggcgggaggccgaactggcgcgagaggcgcgtccggtggtggaggccggcgcagcacgatgaggtgcggccggcagtaaaggaggcaaccacggtgcgatatggagctgcccggggtgtggcgcggtcttgggtacacgaaggctggctggagggggcaccggtgcagtggtcccacatgtcagcagaggttgagtggtggtaaagcattggtgcgacaaccatggacttgcaggtgatgagcggcgggtgaaaacccagcccggcctttgccggaccgacaacaatggttcattccccctcctaagggcgttgtcgtgccgtctcatcccttaagggtgtttgccgggcgaaagcccagtcttgactcttttgagtccttgacggacggcggcagtggttttccatcgcttctctccttggagacatcgtttaggcatctccttgtcgaaaccactcgaacgattggtgcaagcacactctagatagagttaggctttgtgttggttgtaagggcgtttttgggcattttcgtctgtgttcctttgttggcctagcggcggtcggtcacgcttagcggcaaccggttcggtgctagtcttctctcggacctgtgtgttggtggtggtatattttttctctttttcctggttacgaccttctaggaatgtaatcttgtaatttttttttctgctttatcaatagaacttcgcatcgtctcgtgcgagtcgctcaaaaaaatatctactttagagaatcaggttcttaggccctgtttagtttgcgagacgaaaagttttggtgtgtcacatcggatatacgggaacacatttgaagtaataaacgtagactaattacaaaacatattacagattccgcttgtaaactgcatgacgaaattattaagcctaattaattcaccattagcaaatgtttattgtagcatcacattgtcaaatcatggagcaatgaggcttaaaagattcgtctcgcaatttatacgcaatctatgtaattagttttttatctatatttaataatccatgtatgcgtccaaacattcaatgtgatagagtgaaaagtttttgtttgggaactaaacagggccttattcatctgaaagcctgaaacttatgtcattatcagattgcaaatcataaaatggtactcacaccgtcccaaaatataagcatttttgaccttaaaacaatctttgagacgctactctgaccaataatatctataaaattaagtcgttttaaataaaaagatatatatattatgatattttgtttaatgataaatctagtagcatcaatttaaaatgatcttttttatttttttcactattaatggtcaaaattaaaattgtttgacttagcattattttaaaaatgcttatattttaggatgaagggagtagtattcttgaataccattatcaaatatcaattatttatgtggaaaaatatgtcgagctcaaactgtccttttgcattatcgatgaccttgaccaacatagccccagcacacacggtaaagactagagacggccagctgcaagtctgcactagcgtactgcatacgtactgaaattggtagcttctcactctccaagtcagtctcacaagtccacattaaacaagcatcaccactcgtaactagtaacaaaaaatgaccaatagtaccgataatcttttgttactactgctcctcttcttctccggctccagtgcggagcttgatgacggcggcgagctccaaacgcttctgaccatcaagcggcattggggtagacctgctgcattcagctcatgggaggtgagaagttctaattcttttggttactgtgattgggtaggagttgcttgtacagatggccaggttacgtccctctccttccagagcttccaaatagccaatccaatcccagcttctatttgtagccttaagaacctgaagtacttagacctctcttacaacaacctcaccggtgatttccccacagtgctctacaattgctcagctttgcaattccttgacctgtcaaacaatgaattgaccggaagccttcctagcaacatcgacaagttgtccttggggatgcagcacctcaacttgtcaagcaattattttattggtgatgttccctcggctattgccaggttcttgaagctcaagtcactggtccttgacactaacagctttaatgggagctatccaggtgcttccattggaggccttgtggagcttgagatactgacgttggcatccaacccgttcatgccgggtccaattccgaatgagtttagcaagcttacaaagctgacatatctgtggttatcctggatgaatctgactggtgacatccctgatgctctgtcagcattgaaggagctcatactattggatttgtcaaagaataagatgcaaggaaagatcccgaagtggatatggaagcttcagaagctcgagatgttgtacctctttgcaagcaatttcagtggcgagattggtccttacatctcaacactcaatatgcaggagcttgatctatccatgaacaagctcaccggatcaataccagaggacattgcgaacttgaagaacttgagactgctatacttgtactacaacaacctcactggatccattccaaaaggtgtcagtatgcttccaaaccttaccgacattcggctcttcaataataagctctccgggcccttaccccctgagcttgggaaatattcagaattgggaaattttgaggtgtccaacaacaacctgtctggtgagttgcctgatacgctctgcttcaacaaaaagctctacgaccttgtggtgttcaacaatagcttctccggcgtgttcccaatgaaccttggggactgcgacaccatcaacaacatcatggcatacaacaaccactttgtcggggacttccctgagaatatatggtcattcgcaaagctcatcaacatcatgatttacaacaacaacttcaccggcaatctaccgagtgagatatcattcaacatcactagaattgagatagggaacaatatgttctccggtgccctcccatccgccgccatcgccctgaagaacttcatggcggagaacaaccagttctctggagcactaccagatgacatgtcaaggttcgctaatctcaccgagctggaccttgctgggaataggttgtccggcttgattccaccatctatgcaatctttgacaaagctgacctccctcaaccttagcagcaaccagatttccggagagatccctgcagtacttgggttaatggatctaaacattcttgacctttcgaacaacaagctcactggtcacatacctcaggaattcaatgatctacatgtcaactttctcaacctctcatccaaccagctctccggtgaggtcccagcagcattgcaaacgctagcatacgaggacagcttcttggataaccctagtctctgttgtcaatcagaatccggcatgcacatcaggacatgtccctggagtcaaagcatgagccatgatcaccttgcactgagcataagagccatattggtcattcttccttgcattactcttgctagtgtcgccatcaccggatggcttctcctcctcaggcgcaagaaaggtccacaagatgtcacgtcgtggaagatgacacaattcagaacgatagatttcaccgagcatgacatcgtcagcaatatcagcgagtgcaatgtgattggtaggggtggctcagggaaagtgtaccgtatccaccttggcggcgacatcaaggcgggacgacatggcggtggctgtaccccaaggacggtggccgtgaagaggatcggcaacaccagcaagctggacacgaacctcgacaaggagtttgagtcggaggtgaggacgttgggtgacctccggcatagcaacatcgtcgacctgctctgctgcatctctagccaggagacgaagctgctcgtctacgagcacatggagaacgggagcctggatcaatggctgcaacgctacaagcgagccggcaaaagcgggccgttggactggccgacaagggtggccatcgccattgatgttgctagaggcctcagctacatgcatgaggattttgtgcagccggtcatccaccgcgatgtcaagtgtagcaacattcttctcgaccgcgagttcagggccaagatcgctgattttgggcttgctcgtatccttgccaagtctggtgagtcggaatcggcctccgccgtctgtggcacctttggctacattgctccaggtatctactatatttatataacttttatcatgctctctactgtagtagaaatgatttcaacttatatgtattttaagcgaagtcttcatatctttatcaccttaattaattattggaagtagaagcgatagggtatagttgaccaatttcggctaaaaaattcctactactatttctatttgtattagaacacttccagcaaagggtttattaaagtactcatttatttttgtcgcaatctacactagagggcacatagacaatatcataatgttccattataatctgtctgaatttgaggtgtgcatacatttggtgtattaatttgcttattgcagagtacgcatacaggtcaaaggtaagcgttaaggtggacgtatacagcttcggtgtggtgctgctagagctggccaccggccgagggccgcaagatggtggcacggagtctggcagctgcttggccaaatgggcatcgaagcggtacaacaatggtggcccggtcgccgacttggtcgacggcgagattcaggatccttcctacctggatgacatggtggccgtgttcgagctcggcgtggtttgcaccagtgaggagccggcgtcgaggcctccgatgagtgatgttctccaccggctcatgcagtttgatcatagcggaacacatagcgatggcgtagtagctaaaggcgtgtttgacatcgatgattcttcggattgtattgtttaatttggatattgagatgatcaaccatgggtcaaacagtcccagtacgagtgaattgtccgttcttctcaacaaaccaaagattttaagatgaactgactactctgtgtgcaattcaacaagatgcatggttgtgcaaacagttggattagcttgagtcatcgttagattcatactatgaccagtagaggacaccgtcaaagtgttttcgtataggatattaatcctgcctaggtctggccttccactttcactcaactccgaatcctctacaaatagagctgcaaatagaggaagaattaatgatcaggtgttgtggaagctcatagactaaagttgctttctctgtgtctacagcaaggtgagagatcaagcctgcgcaagctagctaatatggaagataagcgcactgtcaaatgtcaaattcttcatctggttggggaaaaaatgcctcatagccgataatctcctcaaaagaaattggccacatcaacggagttgccatctatgtgcttcagctcacaaagattgaagcatttgttcgtctcttgcgtttttatatatatatatatatatatatatatatatatataccaacagaatttggagtgttgaaagcctgggtgggtatatcccttttcaacttacacgacatgggtgagtggtggtggcggtgcttttcggatgaactacaggaaatccttcaacacgttcttcatgttggtctgctggtcgatttagaaaggagagaaatgccagcgtgtttgaggggtaccgtcttgcacgcttgggcagtcatttggtgaaacggttttgctatgtccctttgtgttagatttttgggctcctgtcttagatgaaaaaaaaaatccttagcagttacacttatacacttagttatagcgcacttacactctgttacaatgtacttacattttttagctacagtgcatctaaattagattttttttttcaacagtgttttttctctaaatttatgattttttggcatatttgtcttttttgttattttatttaaaatgggttgtatagattggttgaaatttctgtaagatttgaagctccaaatctatcaaaaaatcaataggttttcaaatccttggtgaaatcaaagatgaagtattactttcaaagagagcaagagttttcaaatccttttctaagtagctccggtaatgtaagtgttaagtttctctagtgattcatcactagcctcaacagtgttatgtcgatgtcaagtacttcgtcgtaagaaaacccttcctaaccttaatcaaaatggttgcccttcttcagccaacccatctaaaaacatatgactagggctgctgctctttccaattcattttttatgttttggacaacgacacgtcctccaaaacacatctttaattatattttttattgtgataagaaatttgccacagaaattatatagggataaacaaactaaaaaaatgtgtctttacaaacacttttctttgttaaattttctataggagattgggaaaatcctcaagtactccatccgtatgagcttttggaaattcaataggcccaacctctcgagctactctatttatcctccaccttatctcttggcgctaataggtgtttagtagcctctctagtcatattcaaaccaagcctctctagtcatattcaaaccacctgtcgtcgatttgatagtgcattggatttactactagttgattattaagggtggacttctttttctcacaagtataaaattaagtttaaggcgatttcaatttcgaattatcatagtcgtttcataactggttaggaaggatatgacacaaaatagttatactttaataacgtaatatttaactgaaacaaataaattcacaaggtaaatatagcataaatataggcacatataagattatatattctatcctctcctgtcattaatatgcgttatttttaataataacgtcatatgttaaaagaccggagagagtatatatatacaaagttcaagtattgctagaacctgttttatctaccttatccccagtaccccactcctcccctctctctctatatatatatatacaaccgcatatgctatgcaaaagcatccagcaatcagattatcatttacatattaaatatccaaagagtacgtaagggtagtagtaaaatctagcatggtgaagtgcggtaatggacatgtctatgcagtactaatgctgctgcttcttgggtgctttgctatccatgcacaatgtaagtgtttcaatttgtttgtttttcaacaaaatttgaaatcctattttgcctatactgattttaccctttcatatactaatcctttttttaaaaaaaattcttttgacaaataggctgtgccatggatgacatgttcggggagaaaattaatttgccaccgtcgctgccgtgcacacaaggatcgaacacagagaaatgcagagactgctggtgttgtatgctcgttgaaaacgatatctgctatccgtctttggacctttgcaaagcaagctgcggaaagataataaattgataagtgctaatgtactgtgatgagacaatttagcaacaactaattcggaataatatggagatgtatgttgtgttggaattcttgcatgctggtaatagttgctaattagtttttgtggttgaaatgctgctaaactagctaatcgtgtagtatagggctgttcattttgatgctattttcaaccttattaaattttggtaaagttataaaaaaaagtggctacatttagtttgctgtcaaattttgatacctatataagaaatcctgccaaattttggcaactatgccaaaattttggcctttttttggcatcaaatgatttgatgtgaaaaaaaataagataaaggaacatgtgaagcatggaagtttagccgccttgttgggcccaccgattatgggctgaactgcatgacatggggccgaatataggcctacgttatcgtggcctttgggacccatgagatgagtcgatcataatagttttgataattgttttggaacgaatgaattgttaattggaatgcacatgtaaaataataagggattaaaaatcataagaaaatacagaaatagtcgttcgattaggccgtgaacaaaatgcaggaatcaaataaaagagatatactcaaagtaaatattccaagaggttgaaattcttgctaacttttcgctagaatttctatagtactgtccattctgtaagaaatttaaaacaaaggatgtaattgaatattttattttaaagacctttacatgatttcttttatatgattaaaattatccaaattcatcttttcctaaagggggcctaaatattgttgccgtcatctgaataggatcactacgatagaaaaagggatcggtgccggatttcctaatcggcacctagcatgcagcacctttgaggatgactctaagatattggtttaggaaccgacacctttgagattctaggaataaaaaaagcaaaaaaagaaggcaaaattggttatatagcatcgaaagttcacgtttttggttttataacaccgaaaattactagttcactttaatagcatctaaagttcaccctgttcccatttttagcacttccgtcaattttccgtccgtcttgatcgttattgatccagccacacacatgatatgacatttctacccctcattgacatgcattatacttgtacttgtgaggggtagaaacgtcatatcgtatgtgtggctggatcaagacggacagaaaacgatcgagaattgacgaaagtgttaaaaatgggaacatggtgaactttgagtgctattaaagtgaaccggtaacttttggtgctataaaaccaaaaacgtgaactttcgatgctatataaccaattttgccaaaaaagaaagttggctcgatgcatcagcttgaattgagccaatgaatcgaggagctctctatcatcaatgagatcaatatcatccccatcaaccaaacacaattaaaatcatcactgaaatcaacatcatcccatcaaccaaactcaatcacaaaatcaacaaaattgcaaacacaagcacacgccgccgccactgccgtcgatacggccttcccccattgtcgattctgccaccctcgtcatcgcattgtcgatcgatctgcccccccgccctcacgcgcggcagcagatccggtacctatgagctgtcacctattaaggtttttgtagtagtggatgactatattttagcaatgcaaatttaaccagcgatagcagtacatgtagcaataaaagtgatgcatctataataagggaacatattttgtgcacacaaccttctcgtgcacagtccgtacacaccaactaatatatgtcaccaaaaaatctaaaaaaaattgtgcatattactttcaataatattacacctatgtgtaaaataatcttaacctcaaattcattatattttagaaaaaaaaatatctgacagttgtaagactataaattataattttgtcttttgctctctatatatgatgaatttaaagatgaaattttatatgtagttataaaatattgaaaatacatgtataaaaatgtttctagaatttttttgacatttgttagttggtgtcagctgaaactaatgccatttgttctagtacatgtacatgtgtgaattttacagcaagtaacactagtacgctagaccttgtgacaccagtggattgctttgggcgttggccagtaaaaaagttaattagtgacaacaggagcgcagcagcaggtcctgcttcaagctctccttccgcaagacggccaactggagttgtagcgttgagcagcatttgtaagattttgtttgttgttatacctgccaaaaatggccaattattgatctgatttcaatttaattagttccgttctaacctactcaccaagctgacaagccaattaggccctgtttctttcagctttggattattataatctagtttattgagtcagattactataagctagattgttataatctgtagtagaataagcggttagttgtttctttcctagattattagagcctagattattgggtttgccagtctaaagagggagtggggtggcatggtgggtaatttttcacccaataatctggaaaaagctaaactaaatgagcttatcagattataataagctacttcaataaattgtctgtttctttcagcttacttccaataatccggattataataatcccaagctaaaagaaacaggcctgagtagttggattgaagttaatcaaggttagttaagagcaggtaatcagggttagttaagcaaatggggctatgttaattaagcaaatgaggaggttatataggggtgggtagggcactggccaggcctccctggcttcgcccctagtttcaagttatttttttatggatataacaggttgcattagataaaatataaatacagtgacatccaaaatccttgtaatgttttaacagctgcagatgctcattttctagacaagtttatttttttaccatttttatatatcacagttttaagttatattttgatggctataacaggttggattaaacaaaatataaatgtagtgacattcaaaaccacaagcatagtgtctaatttttaaataaaaataaaacatgcaaatgttgtgtttggtttaccgattgaaataccaagtctgataactgtttcacaagattcgccaccacctctcttttctccggccagcatcgcactcacccttattttcctccgtcctttatggagaaatcgccgagcgttacgtaagacatgtggcagggagctaaaaggtcggattaggtaatccgcgttgtgacgctttcttgaatgaattaggaatctcatcagtgtctttcaatctcacgcaagttgtttaaattcttagctggcgcagctaattggtgatgcttttaaggtggatactgttatttttttttaagtttgtttttagcatggccaatttcgttgcaatcggccgttatcgcaatgggcaaaacccattttcccttgtgactgtaaaccaatctcttttacatttgacttactaacaatcttattacttggtagagtgctggcgaagttgttaatataaatcttgacagtggtgagcaactggttgccggcgaggttcaacatggtgaggttggcgagcctagacatgtcagttggcagttcaccggagaactggttgttctccgccgtgaaactcttcagaccgacggcggccgacgggagggcaccggacaagcgattgttccccatctcaatccttaagatgttaaatgatatctcactaggtagagtgccggtgaagttgttgtaaatcatgacattggtgagcaactcgaatgaccatatcttcttgggaaagtccccaacaaagtggttgttgtatgccatgatgttgttgatggttttgcaatccccaaggttcgtcgggaacacgccggagaagctattgttgaacaccacaatgtcaaagagcttcttattgaagcaaagtgtatccggcagctcaccagagaggttgttgttggacacctcaaaattccccaattctgaatgttttccagctccgcgggtaggggcccagagagcttgttattgaagagacggatgtcggtgaggtccggcatcataccaacaccagccgggatgggtccagtgagattgttgtagtacaaatatagtaatctcaacttcttcaagtttgcaatgtcctctggtattgatccagagaacttgttcatggacaggtcaagctcctgcaggttgagagctgtgatgttaggaccaatctcgccactcaaattgcttgcatagagatatagattctcgagcttctggtgcttcaatacccactcggggatttgtccctgcatcttattttgtgacaagtccaacaatgtgagctccatcaatgacgacagatcatcagggatggtcccagtaaggttcatccatgacagccacagcattttcagctttgtcagcttgccaaactcctttgggactggacccggctcgaatgggttggatgccaacgtcagcgtctcaagctccacaaggcctccaatggcggcacccgggtaattcccattgaatctattagtgtcaaggaccaatgacttgagcttcgagaaccttgcaatagccgacggcacatcgccggtgaaagcattgctggacaggttgaggtgttgcatccccaacgatagcctgtcaatgcggtccggaagtttgccggataattgattgttggataggtcaaggaactccaaagctgagcaaccgtagagcaccgtggggaaatcaccggtgagattgttgaaagagaggtctatgtaggttaggttcttgagtctacaaacggagggtgggtttggtctggctatatggaaacttggcaaggagaggccagtgacctgacctgtgatattgttgtagataacaccagtccagttgccggtgctgctccatgaactgagtggagctgggttgtcccaatcttgcttgattgctaggagtagtgtttgctcgtcggcgctgggctgcgccgccgattgggagttggagatggagaagatcaatagtagtagaaagaggatgaggatgctgtagacaaccatttttgcgagtgtggtgtgttcttggatgttacatggcgtccacttaaataaggttggcggagagaacgacaaaaaagtggtcactacctcactggtcaagtcttcggcgtggtagcttcaatcctccagtgagcgaaagtcgaaagataacctggtagaaacatgtgagttgtcggttgagcactatgctatcctctttggtccaacttgaatgtatttaagattagaagaatgaaaaagatgatcaccttctggtgtggtacaagacaattacttggaaggagggacatgaattgccttttcctagtcgaaatgttcttattctgttctatcgaaagtctttttatgctttacataatatgtgttctgtcacgagaacggggcttgcgcacgtctgtgtcagcaggttgtggacaaagaggtgacttcgcccgcttatcctattgacagggcttgatgactgatgagtgaacggtacggtatgggcccttcagcgattagtttgccccctctcccccctatactcctccctcttttcccccttccccctccccttcttgtctttctactacagtacaccacacaattttttttaaaaaaaacaaaagttagaaaaatttatgtatagaaatactatatatagaaaatttgaattcaaattcaaatttgaatcgggtatgtaaacttttgacttctaaactttgggtctataaactttagatgtatagaaatactatatatagaaaatatttgaattcaaattcaaatttaaatcgggtatgtaaacttttgacttataaactttaggtctataaactttaggtgtataaactttagatatatagaaatactatatatagaaaatatttgaattcaaattcaaatttgaatcagatataattcaaattcaaatttgaaacgggtatataaactttaggtctataaactttagatgtatagaaatactatataaaaaaatatttgaattcaaattcaaatttgaattggatatataaacttttgacttataaagttttggtctctaaactatagatgtgtaaacttgaggtgtataaactttaggtgcataaatttactaaaatatgaaaataatgtggtgccaaaaaaggaaacaggtggagggagggagggggaggtggggagcgaatctgatcgctaccccatccctagggcgatcgatcgccgaacagcattttcggaacggcatcggttgaactcgcagaagaattctctaacgccgacgatccagtcatagtaacagtggaaacttgaagcattctgctattataaattgggccggagggagtatttcagagggtattactgcaagtaaagtgaaaccatttattggatttcacaaattccatacacctaaaatccaataattaataccctcttgagaattattacatcatgccatgcctgtaaccaaattattgcgatttttttattgttattgtaattctaaaaatcgaacataactatcgttggaattcatttttcattttctagaagtcccgtcaaccgtcggcggctttgcaactatactcttatacacccccgcatgctgggtctcctttctattgttggaattcattttttattttctagaagtcccgtcaaccgttgacggctctataactatactcttatacacccgcccgctgcttctcctttttatcgccattgagattttaaaaattgaatatgattatcaatggggtttgtttttttttttcactttctagaagtccctgcaaccgccttacatgtttgcttcacgggctgcctgacgttcctccttttaatcatcattagaattatatttggtgttttattaataatttttatatctcgtactcctttataggcatgttacttaatttatctcgtcatgggttttaaatggactttcaataatctttatttttatcacaaattttagttatttataaattgtattcctaattgaaatcttatttttctttttctaatttcagaatttttttaaaaaaattatttaatatcgtattgtgttattttaatgtttttattttttattttcaatttcatttgtttcaaaattttattcctacttgaactctcttttagtttttctaattttagatattattttatttttattctaaattttaattaatctcgtattgggttcttatatggattcttctttcaatattgcttatttttaattccgaattttagctgattttaaattgtattcctacttaaactcttattttattttcttttgctaattttgaatttatttatttttattccgaattttaattaatctcgtattgggttcttatatgtactcttcttttaatatttcttatttttaatttcgaatttcagttatttttaaattgtattcctacttggactctcatttccttttctaattttggattttattttatttttatttcatttttgattaatctcgtattgggtacttatatgaaaacttatttcaatattctttatttttatttccgaatttcagctatttttaaattgtatttctacttgtactctccttttctttttaaattttggattttattttatttttatttcgaattttaattaatcttgtattgggatcttatatggactcttcttttaatatttcttatttttaatttcgaatttcaattatttttaaattgtattcctacttggactctcatttccttttctaattttagattttattttatttttatttcatttttgattaatctcgtattgggtacttatatggaaacttatttcaatattctttatttttaattccgaattttagctatttttaaattgtatttctacttggactctccttttcttttttaattttggattttattttatttttatttcgaattttaattaatcttgtattgggttcttat

SEQ ID NO: 4916 - DNA, 1253 bp, Oryza sativa
atctcgtattgggtacttatatggaaacttatttcaatattctttatttttaattccgaattttagctatttttaaattgtatttctacttggactctccttttcttttttaattttggattttattttatttttatttcgaattttaattaatcttgtattgggttcttatatggaaacttctctcaatattgcttatttttaattccgaatttcagctatttttaaattatacttgtactttgactctcctttttcttttttttttctttttctccgattaatatgggaattatttgtattccaaattttaattaatctcgtattgggttcttatatggagtcttcttttaatattccttatttttaatttcgaattttatctatttttaaattgtatttctattttgactctcctttccttttctaattttggattttattttatttttatttcgaattttgattaatctcgtattgggttcttatatggaaacttctttcaatattgcttatttttaattcagaatttcagctatttttaaattgtacttctacttggactctcctttttctttttctttttttctttttctccgattaatgtcggaatttctagcccccacagcgaacgtaatgtctcctttcaaaaagttattttaataatataatagatagatacttccaccgtttcacaatgtaagtcattctagcatttcacacattcattttgatgttaataaatatagatagatatataaatgtctatattcattaacatcattatgaatgtgggaaatgctagaatgacttacattgtgaaacggagggagtagatagatattaatgtagtgacatccaaaaccacaagcatagtgtctaattgttaaataaaaataaaacatgcaaatgttgtgtttagtttaccgattgaaatcacaagactactaccaagtgtccaagtctgatcactgtttcacgagatatgcaaagcaacgtttatttagctgcttagcttcgacttgggcttttggaaggtcaaacgagtgacggaggatcacacgtcgcatacgccgtgatcgtatgacagtcgaacgtagtagtcgtttgtctagcattttcaaaagcaacccgcggcgccggctcctccagagattcagaatattcgccaggtcacttcgctaccaccgttcttttttttcgtacagaagcttcttttcctccgtccttttggagaaatcgccgagtaaaag

SEQ ID NO: 4917 - DNA, 802 bp, Oryza sativa
tgttgggcgcctacatcttcaccgaccggcttgccttcgtcgccgccggctggtgtccttgcctgcacggctggcctattatgccgccgttgttgggcgcctacgtcttcaccaaccggctcgccttcgtcgccgccgactggtgtcctcgcctgcacggctggcctattatgccgccgttgttgggcgcctacgtcttcaccgaccggcttgccttcgccgccgccgactggtgtcctcgcctgcacggctggcctattatgccgccgttgttgggcgcctacgtcttcaccgaccggcttgccttcgctgccgccgactggtgtcctcgcctgcacggctggcttattatgccgccgctgttgggcgcctacgtattcaccgaccggctcgcctttgccgccgccgactggtgtttccgcctgcacggctggcctttatgccgccgttgttgggcgtctacgtcttcaccgaccggctcgccttcgccgccgccgactggtgtccacgcctgcacggctggcctattatgccgccgttgttgggcgcctacgtcttcaccgaccggctcgccttcgtcgcacgccgactggtgtcctcgcctgcacggctggcctattatgccgccgttgttgggcgcctacgtcttcaccgaccggcttgccttcgccgccgccgactggtgtcctcgcctgcacggctggcctattatgccgccgttgttgggcacctacgttttcaccgaccggttggctttcgccgcggcgactggtgtttccgcctgcacggctggcctattatg

SEQ ID NO: 4918 - DNA, 4834 bp, Oryza sativa
aacatgaatatagtaaaaccaggttttgccgaactctgtcttttaaactagggatttgtcattcgtctctttaaccgtctgttagacaagtagctaagtttgtgcgttaatcgagaaaaaagactaataaatttattactgatctatgtctctttagcatgtgttacacacttgcgtgctataatggaaaaaaaaaactagcatgtcggagtaggattagaaacatataagtatcagtttacttcgttgttcagatacaattgagacttgggacatggggcagatttaggatgtgttcgggagagaaggttgacaactactcttctgtgcaagtaaaacagggtgtctcattagcacacgattaattaagtcttagctgtagaagccttaaatgaattaatgtcatttttaaaagcaacttattatcatagaatttttttttaaaaaaatacaatatttagcagtttgagaagcatgtgaattaatgtcatttttaaaagcaacttattatcttagatttttttttaaaaatacaatatttaccagtttgagaaaaatgtgcatagaaaactagattgtaaaagttggtaacatgtagggtctcttttgtttagacttagacttttaagttgtttttttttttttgcctgtatgatttataattcgatgaatttatagtctcaagtttaatgatggaattatacctctacctcatatatgaggaaaaaaacgtttttaacttaacttttggattatcagtgtaatagtacttatctctaatacttaaaaaataagaggtgcttccatcatccgtcaaaaaaaccggacgaaaaaaaccaagtttgtccgataaaaaaaccgggcgaaaaaagtgcgaaaaaaaaagaaaaaccaaatatgtctgatctagaaaaaaggggaaaaaaccgggcggaaaaaaaccaaaattgtccgatacaaaaaaaaccgggcgaaaaaaaacgtgtgaaaaaaagaaaataaaaaacaaaatagcgataaaaaaaagtccgactcggtcccctaaaaaatagagataaaaattaaaaaaaatgtccgactccttattgcgattccctcttagaaaaaaaaagtctgactctagatccgagtcccactcatctcggtttgagtccggcatactaggcatcacttctctcggtttcaatctataccgtgatattccatacatcttggtgaaaaaaaaattgatgtgccatattaaagatctgtttgcaaaaacggaacctacatgtcgagagcattccatttttatatgattttaaattttgggtttgtacatttgcatttgagtccctgtaatttttatatttacatttgagtccctataatcttgcaataaggtgcttttggtcttttttttaaaaaaaacaataaataaaagggatagaacaaatgcagaaaggtgcatgaaaagaaaaagaaaagccacacaaaaaagaaaataaataaaaaacaacaacaacaaaaatctatttcccctaagtagcccaaaaaaaactgtagatgcaaacgaaaaaaatccaattcctataaaaggcaaaaaaaaaaaaaagtggtgaaaaaaaaacgctagatccaattcctttaaaaacgggaaaaaagtctgattcctgtaaaggcaaaaaaaaatccgaaaaaacatctaaaaaagttcatccgattctttaagaaagtggcaaaaaaatggttcgtataaaataaaaaatgcacgtgagaaaaaaaattggaaagggcgaaacaaagtccaatttctaatcagtaaatctcttctctatctctaatctaatataactatttaaaaataaaaaatgcacgagaaaataaaaatggtaaagaaaacgtgtgaggaaaaaatcagaaaaaagcgcaaaaaacacgctgaaaaggtttttccatcttcttaaaaaaataaaaaacgcgtgagaaaaattatttccattgtcggcaaaattttttttaaaaaaaatgcgaggaaaagactatcagaaaaaatgcgccatttctaaaaaaaatggttcgaaaaaaccacgcaagaaaaaaacactatctatataaaaaaaatcgctctgaaaaaactgtcagaaaaaagctaaattgatggacgcttaagtcggataggatccatcgattttttaccatctactacacggcttttattttgccgtatattctcatgtattggaaaaaagcaaaaaataacattcagaaaaaacaggcaaaaaaaaccacatgagaacgtaattgtcagaaaaaataggcaaaaaacacgcgagaaaagaaaaacaaaaaaggggagaaaaatatgattttcgtcatcagtaaaaaaaaaggaaaaaacatgctaggaaaaaactgttagaaagaaatgcgctatttctgaaaaatggtttgagaaaatcgcgcaagaaaaaaaacaccgtttataaaaaaacaagccgctcattaaaatcaaacattgtcattgacatgattatgtatgaaaaacgtatattatcattagaattttttcacccgttgcaacgcacgagcatttttgctagtgatttgaaaaagacaaatgaaaaaaactgattgttgtttagacttagactttttaatttactagaaaaaaatgcccatgcgttgtaacaggtgaagtctattttaatcttattattgttatatgatttagctaagataaaattcactgtgtgagtttgcttggatatatatatttttagaaaattatgagctgcagttaggaatacgatcgtctcaagttagcatgcgagttttttaaaacatattgcttatgtgattccttgtatattaccaaaagtgaacaatcttaaaaaccgactcaaatacggatatatatttccaaaagcaaacgaacttaaaaaccgactcatacacggatgacgtaccaaaatactggcaaaaacatttttgatttttataataatagagataagctgacttagagcatcaccaaaagatatccaaaaatatatcccttaaatctccttttgtgattctctaacaaaaaattaaggcatcaaaatacccttctttccaagagactttctaaatatgaatctctaaatagaaagtgggccaccttgaaaaactaccaacaaaatcaatctatcctgtccttgtcgtgtgcatgttgcaaccagggtttacattaccggttgagcactaaatttcgagccccatcggtatcacggttttcgataaatttcgatcggttttcgataaaaattgactgaattttgaccaaatataatgtttaaccttcgaaattccaattgaaacttaatttcgagccgtgtcgaaatttcacagaattcgaccggttttcgtcagaactgtgaaccctggttacgacccctcccaagtggccgcgcaatagattcttatgatgcacccttctcctgcgtgcaaaggaattgcagctacgattgggagccaaatctcgctcgtatatccggattccggagaaccaaaaaaaaaagggtttgggatttcctagtattgggcgtgtaagtagggactctgtttttgaacgaaaatgagtttcatttatacatacctactatataaaataaatttttgtagtttacttgtttgatgtggcagatgttttttaaggggatttgtggtagatgttaatactcttatctataaacttaattagtcaaaggagtaatttgaattaagataaaactggaaatgtttatatttggggaccaagggagtatatgaatctatttgaaaaagcaaaacaaacaaactttggttatctgtttttatcaaaccatatagatgtggcctgatattatatgaaaatatcatatatacaatagtcgtcaaagcattattcatgctctataaagcgcgatgggggttatttagcataaaatgatttgggctgattaaaacaagatttactttgttcatgctaaaaaaaatgcgacgagaaatattcagcaaaaaaaatgatttgggctgttatttaaacaagatacacattttctttctgattgtattgaaaatgcacatatacatgcatgagagaccaaagataactatgaaaaacatctgaatttggatcaggatgaatcaaatcatcgtcattcagtcaaaacaacacatcagagactactagtaatacaaatcagacgggagtggattctaatccctcgaggagatatcccctcgtatacctttttcttacaaattcgatacaaatagttgtgaaaaattctgaaaaaaattaacaatgtagaatgtagagtataatgatatctattagttcaccaaaaatcatgttcatattcaatctacacatcgagaaaaaaaaaagacaaatttagatataaacagtatgctactattcatacgctgaatttgtcttttttatatctcgatgtgtgagttgagttggagttgaatatatgtgttgtatgaatgttgtcaaattttttcagaatttttcataaccgtttagatgatttttaagcaaacgaggaaacatcccatcgagggattagaatagtttccccaaatcaaacaaagggaaactattagattcaacaacttcataccaagtactgtaaagcacggtaacaactcaattatttccaagcaattagaggaaattaaccacaaatctaatgagaggtaatgccaggtcataattcaagcagaaccccaaattaaggacaaactcaaaccctcaaaccgtcaactcaattaaccactagacctcaaaccaaagtttaaaatttaatataaaaaaaaggga

SEQ ID NO: 4919 - DNA, 1209 bp, Oryza sativa
gctcgccggcggtggacttcagacggtgtagtggtgctggacgttgtccatgtcgaggcccttgagcctgacggtggactccatctggcccttgagcgtgctgagctcgcgcagccgggccacctcggcgcggcgcttggcctgctcggcgatctccgagagctccctgtagctgctccgctcgccgccgccgacgccgccgaggtggtcccccatctccggcgtctgcagcccgtgcagcgtcctctgcgccgtcgcccactgcgcctccctctcccctctcccgtaatccttcttgctcgtgaaggcaatctgcacgcgcacgcacgcaaggtgtttgtagttattccgcgaggagaaaaacacatgcaggcaaggtgtttgttgttatggcaaggttaccttgtgctcgatgagggtgtcccaggcgcggccgctgagggcgtagcggacggcgaacttgaagatgtcgagggggaggaaggtgacgatgctgtagagccagatgacgccggcccacccccagccgatgcccttgatgtgggcgaaccccaaggtggcgtacaccgtcaccagcgtcgcgatctgcaccaaatcagtccatcaatggcggcaatggcattggcatttgcagcaccaaatcagtccatcaatggcggcaatggcattggcatttgcagttgcagcagctaagaacaagaagatggagatcgagatgcttacgatctgcgcggcgacgaaggcgccgcagagcagcatgccggggcgctcgacgaagcaccagctgcgggagcgcgtcacgaagatgagcgcctggctgatgatgctcacctgcaggtacagtgccgacatcatctcgtccttctccatcagtggcttcacatggaacgtgctctgcgcacacaaccaaattcaatttgaattcgatcagagcagtggaatcaaaaggtttttgaggattctttggatctgtttgtttgattgtttgcttacggtgaagaaatcggtgctcctcatggcccagaagaagaggacggtcatgacggcgaggtaggtgccgtagacgatgccggtgatgaagatctccggcaacttccagctgtccgggtgcggcgacggcttcaccctgtccttggatattgtcatgatcgttcctgcatcatcaatcaggtacatcagctaaaattgtgtgtgtgtgtgtggatcaga

SEQ ID NO: 4920 - DNA, 10189 bp, Oryza sativa
ttttagagttttgttttgtaatgttcaaatatcatttttgagattttgcttgtgtactttaacttttgctattgcatatgttcaccttttccattaatatacatccttgaaaatcctggattcaccatcacaccacaaaaatgtaaggccaaaaacaatctacaaatggagggaataaaacaacaaattcctcaattttctacatgtaaatatcaatagatttgcttcaagatccccaaacttttcctcggaataaagagttctactccgaccattttcaaattgttgtcattctgattttattctaagtcaaatatttctacctttgaccagcaatccataaaaaaaaaatatagttgaacaacatccgaattatatatcatgaaagtaattctcacggtgaatttagaaaaataaatcttatgaccgttaaactatatgattttctataaactgatggccaaatatatatttgacatatgacaaaactagaacgacaagtaacttaaaattgagggagtaaaagcgaggcattttctgatatagttttcttcttccaagaaaatagatatatagtttttttttccttccaagaaaatagatttagtcctggcaattaacacgcaccactcctagctgttgttgctttcgattccaaaagtctccacagcaagtagtggtggtgtgagttgtgacgagataagagaagtaacctaagctctctttacatctaccgatgttttacatctaccgatgttttttaggtgtcacatcggatgtttgactggatgtcgaaaggggttttcagacacgaatgaaaaaactaatttcataacttggctggaaaccgcgagacgaatcctttgagcctaattaatccgttattagcacatatgggttactgtagcacttatggctaatcatggactaattaggctcaaaagattcgtctcgcgatttccccctaactgtgcaggtagtttttcttttaatctatatttcatgctatatgtatgtgtctaaagattcgatacgatgtttttggaaaaaaaactctttaaactcttttggggaactaaaccaggcctgaatatattggtcttgtggtcctgtgttctagtgtgtgtggctccccagcacaagccttggatcctactcttctcgacctcagtgtcaggtctcattcatttgtgatgaaacaccatcccttctggactctactgtcagtgccgccgtccttccatctattctgattcgatggccgtggataagcttgatttctctgtccttttttttccttgtttatttatctatctgtcaactctcatccccctttcggaaagatgattttcacatgaacacgagtttgtgtgttcaacgctatagatggataatatatataccattgtggttttattcgtggtcgtgtgtgttttatcgtgtactgatcgaagcacggtaatatagcgtacgtgtaaagtgtaatgtaaagtgtaatgtgtgtgttagctttcgctttactgtatgaagaagtattctatgccattgatgtttttttcacacgcagaaatattttcttccaagtggaggggttctttcagtttttattatttatttttgtgaatgaaaattttgactccaacaaaatccttttatttatataaatctggggcgaagttgactcctgtttattcagagagagagatagaacggatcaaaaggttagtctggaatcatgtttctgtcattactaattcttaattcctcattaattcctagaaggacacatttgcaacatcatactacttaattcagttttatgcattcctagaaacttctttaccatctatattacaccctttgtcccaaattataatgcttatatttttttcacagtcttcagtgatatattttgactattattttattttatgttacgttcccaatgagtatgaaattagcatcatatgaaaataatttgaaatgaatataaaactaatgatataacatgtataatacttaacatatatatagttagtatggttattagttaaaagttatcaaattagatttttcagaagatcacgccctgtaatttagaacggagggagtaatagtcgaaaatgcgcatcaacaacttatatgattggtgtgagtccaaaagtaggccaagacatattggggtatttttaccattgcctttctgttatttctgttaggttagcatgtccatgatgcaatccatgggattggcattgcttgcaagttaactaggaacccataatttgttcacaaagttggggatgaatcggtggcaccgaaccatcaccaatgcctacaacgaatttcccggtaaatcctagctagctagataggaacagagtgattactagagtagactgtcaacctctctagtctctaccaaataataaagaaaaaaaaatgaggagatagtgatggtgtagtgggtatataattcgactcaccaagtttcaattcccgatgttgtgtgcaaatagaggtgggaaggtaatacttccgttatataaaagtaataaggcatggtcattaaaagaacataataacactacactggacaaggtcacctgtgacgggcccaaaccctcacctttgacggctttgagcttggtcagtgatcagtggtcactggtgagtccaatcacctttgacgggtgaaggaccgtgactgatgacagtcacctctgacgggctagaactcttccgcccgtcagaggtaagtgtctgcgctaacccatgccattttgtaacccgtcactggtatggttacctgtgacggctttttcaatatgaaccgtcagtgatgaggtacatccagacaaaaaaaatttctaaatattggctagcaaatcgctagccaatatttagaaattatatttcagcagcagtaaacagaagcatcacaaaatatatccatcacaaattagccaaaatataacctaaatttctcatcaacaatatatccatcacccataacagtaagggacaaatccatcacacacatgcacaaatccatcacacacattcacaaatccatcacacattcacaaaatccgtgccactgccgctccaagaatcaccgaatctagaaattagagaagggggaggaggatggggatggatgcggcgccgctgccactcacctcctcctcgccaccgcacgtcgtcgagccctcctcaccgctgcgtcgagccgctgcaccgccgcgcgccgttgagccctcctcgccgctgccgctgcaagaacaaccggcggcggcgggcgggcggattcgtgtcccccaacctcgtggaggctagatccgacacccagcagtcgggggacggcggccgtggcgcccggcggtcggggaggggggcgaaggaggcggcgacctggatctggcgtggtggaggcaggaaggaggaggctacccggatctggcgtggtgcaggcgggaaggaggcggcgacccggaggcggtgggcgaaggagctgacgacggggcggcggagagacggcggcggcgaccatgaggctgagggcgaaggaggcggcgaccttcggaggtgggcgaaggaggccgccgcctccgcctctggtccccgccgatggacgatggacggcgccgcgccgctgctccccgagacaagccccaagagccggagagggcgaagaggcggacgtcggtcaccacgacgcggcccccgcacccgccggcgccggtgccgtctccgcctccgacacaggtcgatgaagagagaaagggttgagagggagagagagatggggggagtggttgagatggataaggatgagccggtagtagaggataaggatgagccgggatgagaggggagggttatgagaaagatttttttttatcatctttgacgggcacataaaatttgacccgtcacaggtgactttatctcacctttgacgagttttgtttttggaccgtcacaggtgactagttacctgtgacgggctaaatatttttggcccgtcacatgtaattttacctcacctttgacgggtttcatttttgaaccgtcacctcctgatggctcaccgatgacggcatcctgtaggacccgtcaaaggtgaccctcatcactgaccagcacttatgcccgtcacagatatgccgtcacaggtgcaaggatctggcgtagtgtaagaaaataaacctcgttgataacttcatttgggtggaccgggtcaatatctcaaattgaaaatatgcaaaaattcagcagcgccatatcgtcactagtcttgagcccgtacatctgcgttgaaactgaactatttcacgtggaattttctgctttgtaaattaagaatgggtctcaatttttgaacttcttatgtcaggattatgactatctttataaagaaaaccaagagccgtgaattgcagcacaaccaaatcattgcaaagcatgcgctatttctagcatcagggctgctatctagtcaacaagccagccaattaacctgtagaatatccaaccaaagataggcgcctaccatttcttgcgaagttcagaagatacttcataaagtatattacaacaccgactttccaatatgaaaataaacacaattatcctcgtacattcaggcgtctactcagcgctatcagcttttgacgtgagcctaccaatgcagtcatgtctccttgtgctgcctttttcaattcaacgtggcctaattttatgggcctacaagctcacaagcaacgttcctttgtatgaagtatgcatcattgatcattggaaagggagaaaatttgttttatattatctatcttattattcattttctttattttctttttacatggaatgcgtgcactgttggaaatttggtcataattcggcatattttaatccaaaataacaagataataaacatgatatttacaataggatttgatccagtgatagtggtgaatgtaatcaacatgagcatgcttaacgttgaataagaatcaacaatcacataatgacacaatgttgacattgcgattaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttcttcttctcgcgggagatcaaatccattctcattttataagaggaatggaagatgaagagtaagagtcatgaaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctagaaaaggagctacacctgaccacaactgaacaatgtactatgccttgaattgtcagtcttgtgcagttaggtttcactcaattccataactgatactaggcaaccattagtattccctcgggttggagcttataagtcatactccaggcctttcatgagtatctagagatcacccaaatctcatagactgtgactagcagtcgaactcatataggtttgttccttctaagatgttctgcaggtcaacatctctgcttggaaaagccactcggatcacattaagacataagccatcctaccatgcaggaaagaagagaagcacatcatgaaaatgagcccttttcaagggtctcttctctcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagtgccacctccaagtgtgaacacatatccacttgtggcttttatctcatcagcatcagatatccagtttgagtcactatacccttcttgtacttttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcaccccttctcccccaccatagcgatagtatacacatttgtcagcttcgttcacaacaaagcctgcagatgtaagcgtggtgtcaaacttctcatgccattgcttaggtgcttgcttgaggccatacaaggatttcaatagtttacacaccattccctcctgaccttctagtacatacccgtctggttgatccatatagatctcctcctccagctctccgttcaggaaagctgtcttaacgtccatctgatggacgagaagaccatgagaggctgccagagcaagtagtactcgaatcgtagtcaagcaagcaactggtgagtatgtgtcgaagaagtcctcgccttcctttcgggtataacccttggccacaagccttgccttgtacttttcgattgtaccatcaagcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatgtagcatctctggactcaagaattgtaccaacatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttatttccttatgcttcattggaattttattcaggacatgacacgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagaaatgcaatgcctcatcctttgttttcaataaatacacatagcaaaatctagtgcaatcatctatcagtgtcatgaaatatttctttccccctttagtcaacacgccgttcatttcacacaaatcggaatgaacaagttctagaggtgccaaattcctcgcctcagatgccttgtgaggcttgcgaggttgtttcgattgaacacaagtatggcacttggaaccttttaccaaagtgaattttagaattaaactcatgttagctaagcgcgtcatacaactgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttactgtaccccgatgttcctccgccctcgctaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttgactttcttgtagttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggcggtagtttggcaataatgccacctgccacaaacttgtccggcaactcacagttgttgttctcaagttccttagccggcatctgaatctcatgagcttgttcaactacagaacggtcatcgaccatcttgtagtcatagaactgctccataccatacagctcactgccggcgtcagaaactccgaacttggcctcaagtgcatcccacatttccttcccaaaaggcatgtgcatgtacacgtccactatgttgtcagcgagtacactgatcaatgctccacggaacaggcaatccgaagcctcgaagttagcctcttcctcaggagaaagaggtggttcacttcgtttgccccgtgaaacatagaagca

SEQ ID NO: 4921 - DNA, 1131 bp, Oryza sativa
ttataagaggaatggaagatgaagagtaagagtcatggaatatgaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttagaatttatttgatttaattgatttaaatggattaattacccaattaaatctaacatgcacaaccaccgtattgcaattttttatgtttatcttttttttttatatcggttacatacaaaacaaaccttgtttttctttttttttcccgattgcgtggaaaacaaaaaagcaaacacactacacgtctgcacataccagtgagtggcttttttttaacaccataatagctaaaggtgtggattagtcggcctaggttcgagctttatcactctcttaataaatttcgatactttcctatcattcatatctggcattattttaacaataggcattttgtttgttcttttgctcgtacaaatgcaggtgacgtgcatttgctactatagttatgagatgattatattttgataatgactacaattttaagagaagacctgcatgtataaaaagatgtaaacaaaacttatttgcagtctatcattaagaggataatgggctaagagtattcatttttgcaagtacgcagacacacagtgcaagtatagttgagatgctgtgacatgaatacactgttttcactgtttgatttcttgataataatactgacagtatcactaaaattatctttaatctaatccataaagttcgcttgctcccatggcatttttccactgatcaaatcctaatcggaacaaaaaaaaattcctcaataaaccaagccaaaatattgcaaactttagtactacccaacacctattcagattgggtgacata

SEQ ID NO: 4922 - DNA, 5035 bp, Oryza sativa
acagacagatatcctctccactccctgcaagcggggcccatggtcagacgactggtactgtgaagtgggccccacgaccccagcttggtgcgggccaccgtccaccgtccatctttcctggcccggctaccatccaagcgtttgcagtggattcttcccctgcttacctttttctcatccttccaaaattccatgggatccaccttgggaatccaaggccataaaaggccacatgaccaaccacacacagctaaattctactctcattttttttcctggagtttgtaggcacaacaaattaagattttatgccaagagaatatttttgataaaaatactaataaaacaaggctgcatatatgtgtttttttactactactagatttttttgtgcttgaaaaaggtgaggaaatgttgccaaggtcattgccttatcttccaggggaatagcttaaaaccgtgtgaacgcctatatctttatggttgagaagttctcaaagaatctgcccgcgtatatagaaataaaagtacaagactcgtcattttcacgctattttgttccaaatctatttgatgttgaaccactccttgggttctatatcttgtgagctagcgatggatactttttcttcatttcctttttataaaattgtattcattatctagtactataagatatatgtatcttttaagtaagtacacatttgcatgcatttattaatttgaactacttctatttttaaagataaatccaagtctaaaacaattaaaatatgatggaatattacctacatccctaaagactcttccttttccctttaatatgagatgttaatagctagatgagacttaagtcatattcctctaaacctgcctaccgaatcttgatattgtagagtagggcagccaggaatatatggcaactatccacaatagtgttgctgatggtgatggagattgtaaaatcttaccttacctacagagatcatgatttttttagacttggaaagaagaagagaaaaagttaatggtgtataaaaacaagctatacaaattgaaagaaaaaagtgcatatatctatatctaactggtctaatttactcgagaaagatgtgaggattcgaatgaacatctttacaaagagaatgctccaattgtgatcacatcaaatgcaatgtgaaataactttagtttcggcataaatgagaaaaggggttcgataacgaagaatgatatatgtattcagagcgcatttacactctcatggaaacaccaatgtggcaacctatgatgaatattataatcatgtgaataagcttaacatagttttaaaaaattaaattataagagaaaaaaatgccacattggtgtttactgttactattgttaccatggatccaccaccataggatgcgtgggctcgtcagtggatcatcaaaatgagaccctcactttacattttttttctcttataatttatttttttcaaactatgttaagcttatttacataattattctaatgaattatacacatttttttttcatattttggaaaatacatatttctaaaaaatatattactagagcaacttgttttaagatagtactccaagttgttaagcttattccaaaaccatgtaaataatccgcgacaataataatccgtttggcaatctaaatcaaacggcgcatataggggttgtttggttgatggctaagtttactatacctcactttgccacaagtgtgttatgccacacaaagtgaggctagcaatttgttagccacaagtgtggctaagtttggtaagaatttgagtctataacgcataggcccaatgactagtaaagtgaggcatgacacaagtgtgacaaccaaccaaacaatatactaacaaattgtgacatgtctaaggtttggcatggcaacctttgagagccaaccaaacagccccataatacatcgcagcaaatcaaatgaaaatacaactcactttttgcagcaaaccccctcacgatcacctaaatttcgaaaagatcctcaaagccccaacccttcttctccatcgcgtcgcctataaatacccccctcgccttcctctcacttcttccgccattcccctctcctcctcttcttcttctccaccgaataaacccccgcaaaaaggtggtgagttcgagagagagagagagagagagtggaaggctagggttagggttagggtttcctcctcgccgccgtcgcgtggcgcgatggccgccccgccgccttcctccccgtcgccgccgccggcggcggcggctgcggcgacgcagcagacgcagccgcacccgcagacgccgttctacgagctcgtcaagggaaactccggcatcgagaaggtccttctccgcggcacgcgcggcttctccgctgaggtatccgatccgttctcccccgccaatcccaacccaaccctcgcctctgtgcctctgtctctccttccgtttgtggtgtgtgtgtgtgtgggggggggggcgattcgtgcggattcgggcgccattaccgcagatccggcgggaattcggctgatccgcgtccgggggcttggggcgaattcgtaagagggctcgtagttttccggcgcgcgatttcgtctcggtggggatggtttggtggcgcatttgcacgatccgccgctcgcggacttgtaatctagctggttgagatgttaactgcttagttttgcgtaatctcaatgggatgatggcgcgatgtgcgatcgcagtagggacggccttcatgatgtgtccggtcgccattgatgtttcttggaaattcgttaggcgtgcgtttgcaatgtgtgaaatgctgcaatcttattctgaagattgtatgaaggtggtattgtggggattgttaagcgacggatgccctgtttacaaacctgcgtgccgaaataggaatttgcttatcatcgatataatttgacaaggacaagggattcttgtgttaccctgttctttttctaggtcaccttgtacagggatcggatttgtggtccatgtatgttttttagcccttgtatgtagaaatcatattctagatggaagacattctttctgacaaatttggatgtatcctctgttttggtactgttttgtacattattgcttatgtttcttatggttgtcatttcgatgtagctattttttagtagaagctaatgccaaatagttcatcaaattgtataatgctcagtagaggagcctcttgtgctgttcagccatttaagcttttggtttaggtttttggtacaaggagtggatggaattgttaatctccctttatatgtcatagtgtcatacagagtctagtccatcatttcaatatattcagataattttcatcttctgaaccctgtaaaatcatcattatgtaccagttttgtatctctctttttacatatgtaactctgcagttgtgttgatctccgaattgctgtagtagtgcctcatctctgtgtacacaagcgaagtgaaacacatgttgaaatttttgtctttgctgtcatgctcccctggatgggtccacattgcccatatcaaagtgaacttcattctgtgatttttcttatcttatttgttcttacctgttccactattttcaaaacagaaaatttatgccctgtttatgccctgaatttacatgagaatatactataatagccaaaaataaaatattttgccatgatgagtaatgactagttctccattttctcaggtctatctttatggagctcaagtaacctcatggaagaatgaccatgcggaggagttgctttttgtcagcagtaaggtgcacagtcattttctaaaggatcttatcgccaacagttgtatgaccaaattatgtcaatgaatgatctctgtatttcatagctcacccttgttttgcctctcccctgtaaggctgaaatgtctgcattattttttttagcaaaatatttttacctcattgctgcacgccattagtttttttcttctgttgtcacctcttatggactattggaagattaattaaacaaatcgatccctttttttcctgaaatattactagttgcctgtttctagttctctgatgttgctttgctggccatatgttcgaatcatcatatcttttgaaagtaatatattcttttgtaggctattttcaaacctccaaaagccattcgtggtgggatacccatttgcttcccccaagtaaggcaacctttacctataatgacttcatgataaaattttgtctgctcaaatcaccaaaacacaacttacaaatgcagtttggaacacatggaaatcttgaacaacatggatttgcaaggaaccgattatggactattgatgataatccaccacctttaccagtaaaccctgctattaaatcttttgttgatctgattctgaggccttctgacgaggatttaaagatctggcctcacaggtttgtgttataatatttaaattgacaattgattgtttattttattccgtttagtcatgcaatgtgttgaaggtacctgattctgttcttggcctattcattgtttacagttttgagttccgcttgagagttgctcttggtcctaatggggatttgagtctcacttctcgaattaggaataccaacactgatggaagatctttctcttacacatttgcatatcacacatacttctctgtctctgacatcaggtatgtgtttcatgatgttttatcttctccactttatttttgtagtgttttgacctctgtaatgatctgttccaattgttgatatagtacttgatgtgctggaaacctaaatacttttgtaccatggatgggttttactgtgttatgtatgtcagtcaaacagtgatctcattgtggatttttttcatctgtatttggtatcctttttgtgagaagcatagaaaaaaaatcttagttccttgttgatatcacacattggaaatgccacacatggaacattatagtagaaagtaatcattg

SEQ ID NO: 4923 - DNA, 40731 bp, Oryza sativa
gtagattgctgatttgggtctatccaatggctccaagtgcatgattgtttttccttttcttttgggttagaaacatttgcatgcaagtattcgctatcatgttccttacttgacttggcctttttatcaatgaagtgcgtgttgaagggctggaaacaatggactaccttgacaatttgaagggaaaggagcgttttacagagcaaggggatgctattgtatttgaatcagaggtaagtctattactgttaaatgtccacatttcgtgttaaataactaatatttcaagcttcttacctataattttctatgttaagattgataaggtataccttgctgcaccttcaaaaattgcaattattgatcatgaaaagaaaaggacatttgtcttgacaaaagaaggacttccagatgctggtaagcttgatctgatggcaaatcttttatgttgacctaactatttttcgctatttgtgttatttcatctagttattgctgctgtttctgctgtagttgtttggaacccttgggacaagaaggcaaaagctatgcaagattttggagatggagaatacaaacacatgctttgtgtggagcctgcagctgttgagaagcctattactctgaagccaggtgaagagtggaaaggaagacttgcactctcagctgttccttccagttactgtagtgggcagttagatccattgaaggtccttcaaggttgagaattctcatttctgcgtcttgtacaggtgatgttttgctctagtttgcaacgttacctggatgagtcctaaggctaattttgctcttgtggatccattgcattacttgtgaaattttgttgttggttagatgctatataccttggttgagttcccgtaaaagaattagtggctgatgaaaaagttgaactttccggtactactatttgagatgcctatgataggtgctcgctccggtactttctaatgggtgtttgaaaattctgataggaaaggtttggttgttaatgccgaaagtgtgtttggttaggagcaattggttgagttgactgcttcctgaaagctttgtttagatgaaggggacagctccttttgtgattggggatttgtggtggttcttgtttgcctactcaatggataaataatgttttcttgtgtttggctgctttggcattagcataatagagattgaactaagtataaaaaaatctacgcttctaaattgtaagctttactaaatatggtatgcaattaaaacgtacactcttcgttttttgtctaataaccacctagctccactcgtaccgtcaccgttactgctacatgttgtgtttggaaaattttatctgtatgaggtggcaatgcttttaatgtttggttgctttggcattagcatgaaagggattgaactaaatgtaaaaaaaaaaatctacgcttctaaattgtaagcattactaaatatggtatgcaattaaaacgtacgttgcttgtctaataactgcctactcggccgtcaccatctgctatggctgttgtgattggcaaattttatctgtatgaggtggcaatgcttttaatttgcttagtttttttgagtgctcccccttatggtcaacacttaacacatgcccattaatacgatgttttgaaccgatttctcttcattactaataattaatatgatgttttgaaccgatttctcttcattactaataaatgaatggtttggttttctgcaggagcacctcattgcccttaatatttgatgctgggctggcgcgcgaccttttctttctttgccattttaaatcccccgtgcttcgttctttttttgtacctagaagtgagtagtagggtacctccgaaataacagactgtgccacctgcttcgaccctagagcggatcatctccttggtgaatgaattcgaccagtggacacaagccattcgtgccctggtgatatgattcatcgtccatattccaggaaatattcgccatgctgcataaggtccgtagcattctcagttaatctgtagttatgatcattgggagcatttgagttacactggcttgctactgtgcttcaaagcctagttctttgcctccttgtgcaaacgcctctaaagaatgatgtcaggtgcagctagtagtaatatgttgtcaatacatgagaattgagtatcgactgttttgagtcgccttgggtaaggcccagtttggatcaaagcatattttgcatgagttcatgagattgttgcgttccaaacgggttcgtccaactggctggaggaggaagcatgtgccatctgtcatttgaaagttattctcaatggaaccaaggtttttttagtggaaaaaatgaattcatacgcttctgttgagtgggtaattaattagcctatgaaatttcaacccattcgtcaactccaagcttcttgggttgacatctcagttcgtccagtgaaaagaggcgtcagtggatgtcacggagaaagagagcttcaggccagctggcacgttcatatgctgcccaggaaagagcaaaaccgtgaaagctgaagatcatcacataaatcttctaagcacttcacatgaaaggaaaaattgataaaagatgttatggtgccaaacttctgtggaagtcaaattcaacccttaacttcagaaatataaaatattgattctagcctttcgaaatacagaacatcatgttatcgccaatttaaaaattgaattagatctataatttcaacaataaaatgactccaattggggaacattacatcataaaataattacttgctatatgctactcccttcgtacttgtaaagtaagttgtttaggacaatgtttgagtcaaaccttgggaatataaatcataaataactcttaagttgttgagtttgaaaatataaaaattatatgaatagatttgtcttgaaaaatattttcataaaagtatacatatatcacttttcaataaatatttttatagaaacaagaagtcaaagttgtgttttggagaccgtgtcgctttcctaaacgacttcctttatgagtacggatggagtatattttaaaatagtgacatgttggggaagcgcgtggtagtagagttatggttatatgacttcactcataagagagtttaaattctggtgcttatgaatataaattatgtacacacaaatgggattttagtgcagtcaaataggattttaatgcaaattcagtgatcatggatgtaatgatggttgcaaaatagaaatttagtgagattagggttgtactactctttttccatctctttgagcgtacatgcactccatcctactctgcccatacgaggaaaacctcttgtgtgaattctatgttacactcattcctatgtattagttgatacctacggtttgctgcaggatatatatgtttaaataatgcaaaaataatatagagataatgatttaacattgcttgcatattgagttctaaaaatgcaataaaattgtaaatgatatgtcatatttgtatgatatttaaaatattctagataataattgctagtgtgtgatgacgtgacacacttgcatgtgatttaagatacaaccagttgcttcatcctccttccttcaccaactttacaccagtcagcacatcttcctccctctcctcaactcctcgactatcatccctaacaccgacgatatccactatcctcttttcgcacttcatacaccggatctaaagcatatcctcatcctccctcccttcatacaccggatctaaagcatatcctcctccctccctctcttcaactccttgaccatcatccctaacaccgacgacatcccctatcctcttttctcacttcacacactaaatctaaagcatgagagagtcctcttttctcacttcatacactggatctaaagcatgagagattcgctggagagggcatgtatgttgtgatgtgtgaggagaaggaaagggaggcgtcaaggctgaaggggacttggaagagtgtgcccctcatcgcctggctgactggcaagccacctatcgttgccttatctcttctcccttactctcctcaatgcctccatactcctattattgctatgatcggtgggggcaacgagctgagggttgccgctgcttcgttcccttgcagcgtgggagatcaaacatgggggaggcaggaagtggggatcggattcatgaagtatccatcggaacagaattccgtgctctcgcaatccttatatttttagccattagtttttgggaaaagtccattttacaccctcgaactcttatacttgtctaaaatacacccccgaactacaaaaccgggtataatacaccctcgaattgtcaataccggacacttaaccccccgggctgtttttatcgtggtttttgccacgtcagcacacaaagtaatatgggccaagccgcctagcccatactatgttcgttcttctctccctcccctgttcgttcttctcttcctcacgactgttggcggcggcagcgacagcgacggctgcggtggcggcgcggagctgcgagggcggtgactgctgcgagggcagagctacggcggcggctccccgttccgcacttggccgccaccagctcgcgaccggctgaggcgttgagtctcctccgtgcgaggggcctgtgcggctccctcctccacccgcgccgcctctgctcctctgttgcgccggtagcagccgcaaagcccggggccgccggtaagcctccaggccccgctcctccttcccctcgcatgcatggtgctgaaccgctgatatgtgcgatgatatttgcagggacgaccggggaggccggaggcagctgcggcgccggtggaagagctagcgaaatctctgcagggggtggaggtgttcgatctgagaggaaaggcggttcccgttgttgatctgtggaaggacatgaattttttgtcgtgctttggaagattgattgtgtatgagacaattgatgctggttgtttgcaggtgtgtgatgtgccgtaagagggccgatcttcttgtggctaagaaggttagtttactgctaagcaggttagtttagtggccgattcctctatgcgaatttcgaggaacaaaggaaatacatcaaatgctcaaagtgatgcattcttctactctctttttttcaatctaccaggttccatttacaaaaacataaaatgttttcattttcaaacttcgcagctccgctccgccgccgccaacggttgtgaggaagagaagaacgaacagggtgttggtatttcttaatgatattactagaaatataattcccagcaatggcgcagaaatactcatggtatattatggttacagagttcatccgcaagcgcacggatataccattgtagcatttcacccgagagtattccaagggtatcgtatttattttatcccgtgggaagatcatgtagagagaactcaactaataatttatatattacttgtgataatcatattctaagcaggggttaagataatccaaaggtagagtgacacacaagcattactactcattctcataatatattatctgagctaagtggaaagaaaagagaaagaaaatctattcatatacttctaatatacatagtatacatattctcataatatattatctgagctaagtggaaagaaaagagaaagaaaatctattcctatacttctaatatacatagtatacatatacattctagttaactgatatactagctaataccctctatctgatgccctcctggtacttcgagaagccacccctaactgccgagttccttacgacatcccgtcatgaccatacaactggggctaaatacggaggaataccctccccagggaattaacttaggattatataccggcgcagaggaatactcgtactgagctgtcaccatcagcggcccacctctcatccgcaatatataaccccaaataatgatatcccgtaatctagacacaacgtctaaactaccagatactactctaatatcatcgtcatgacatagagtaattgcataagcaaacattatacccgcaccaaagcatctcccagataagctagccgtatattcagtataacatgaacataatgtaaagtaggtattcatatacttggaaagtatttcaataccataaatatatttagaagagtattctaataaaagtacaaaacttacaaaagagaagagaaaagctactagagccatacctgaactcttccgaaggcttccggactcctgatttctactctattcctattccaccagctagatattgctagactaaacttgagagaaatgagagagctattgcttgaggtgtgtgagtgaagtgaggatgagagctcctttatagcctcccaatgacggttgtgacggttggaatggtcggtaataccctccaaccgtcattggggagcaatctcagccgtccaggggaaccctggatcaaacggagctgctgggggttcggccgaacctggggccggcccaatcctgcccaatttcggctagcggcctcctctgttgcttctcttcgcagacttgtgaattttggcccgattcgttgtgtcaattctgagttcttggcccattcatacataagtctggttctcgacatcgtccgattgatttatcgtctaagttgatgtcgattctcctccactttattgtcattctctgcaaaaggttagtatacctaatactagtggaatattattattctaacagatatatgcattgcaagcatcactagttctcctctattttggtaatattgacggtcgaaactgatcgataacgaccgtcaacacagggaagggagagaagaacgaacagagtatgggcttggcccatattactttgtgtgctgacgtggcgagggctgacgtggcgtccgacgtggcaaaaaccacggtaaaacacagtccgagggggttaagtgttcggtattgacagtttgagggtgtattatacccggtttttgtagttcgggggtgtattttagagaagcataagagttcaagggtgtaaaatgaacttttcccttagttttttccccatgcacatctgttctagacttaaaattttgttagatggtggctgcttatcacaacattgttgtatttttcttttcagagattgtatattaattttactggtatttgaggattgagaagcaagggatgcgtacatacacttgaatttgaactctgactcaatagagatcgccatatcaataacgaataatgtggacttcaaattgctgtatagaatgggttgtctgttcaataacaaaaaatttttctaccttgatttatttcctgctacttttctttgcccacgctgcattgtgtggagtgagagcaagaacagttctggacatttgagcaacaagttgaatctaaacaaagaatataatgaaaatctatgtaaacaaaatgaatctgcatcttgttcaattctctcaagtacactaatgtttcgtagcagaaccgacggatttgcagatggggcaccaattcttttgccgaagccattgttggatgcaagcaagatgatagtaatgcttgcacgccatctcggccacctcctcggcaggtaaatattcctcctgaaaagataagcaggagaaggaacatgtccacatgtcatcaccagattatcttttcaagtactaagaagtttcttcagcaaatccagtgcctgaatttatgtttgattgattggtacatcatatttttcagtacagtatattagtcattcatctcgaaattaaataacagaaatgttcttggcccaaattttcatgatattttagactagtttactatatagtagtattatatcatctgattgacttataatggtttgtatgttaaaatatatttagcatcgacagtaaggatataaaactcattattccttttcttttgctgcatgtcttggaagaagtgttgacagtaaggaattaaggatatcataaataaccagagcaactcacatatcatcaaactatagatcattctaatgatgcaatgctagtaaatgaacatacctggcatattatgcatttgatatcaccatcttcatgacttgttgaagctgagggcacatagtggattctcttcagacaatttgacagttcatcctctggaaggccagtgctcacggtaccaattgtttcccctagagcaagcaattcctagaatgccacacaaccaacatcaaacaaacggaaaggaataaattccaaacaaaaggttcttggggctaaaatgtttacatgaataaatatggactttagtaccagctctcttagaactgaataatagatatacctcataagacatgtcgtcgatgtccattctcattcctctatgcctatcactggaagcatcctgcaagacaataaagaattaaactctatgtttcaaagtggtcagcaacaaaatgcaagaggattgcatttcctctgcatcggtacattcttttcttgacataataatcaatacattctcagaacatctacagggtggatactgcaaatccattatggaagtaacaatggaaaggcgtacctcatcactttcatccacaccgaagcgccagtattcagtggagtcattcaaactgttttccaaatgagatactggttcttcttgatttctgcttctatgtctcaacaagctttgagaaacaaacctaccggtaggtccttgcaaatcagctctcctatgcacatttgctccagaatttccaccactatcactacgcattctggcattgcttccatttgtgcctccatccttccttgtctttggaactgatcgatgcaattgtcttgaaattgatctactactactactcaaggaacctgcactagatgtgtttgatgatgatgggctactccctccactcaatgagcgcttcctcgacgaatttactctttctttcaaatggtccagaagatcctgtccagcagtttctcttctaggtctgttgccggtttcgctacaggtgccggctgcattcctcctgctgccataagccattcttccttgaggtaacagcctgttggatccactgacaagtagtgatctctgaggaatcactgcttctttggttggcctgcgcattttcttctctttgtcacggaaaagcttactgctacagccagtgcgcgtacagcaagcggtcgctttgtggcgcgggctatcttccctatatacaaggattgagccccctttggtcaatagaaggccaccaactgttctcctccccatggtttcgtccatattcaactgaaaaaaaaagggagcaagctcaagtttgagagatgaataagtcatcatcaactaggtcaacagaatatcacaattggaccgagggcataattaacatgttaaaatcaaacaaagctttaggtgatacaaaacaatgaagtgctcccttataattcgcaaacaactaaagtgggaagagatctccgcaaataatttgcagaataagtatttttctactgtccaaaactttgcagcatcagcaggtcagaacaagataatggatgaaaccaagaatttgccaccaatcaaaatcaagtataatgcagaccacatatggtgacaatcatgaaaacaacggttcttgaaattaagaatcaacaaaaaaaacacacacatataaaccgataaaaccagacctgctcatcatgaaagcacaaccaaagacgacatcgacatctgtgcagatacagttatgggcaatgtgaccaaaacaaacagcattgtcagaagacaacttcagttaggtgatcctacatacttacaaattaactctacatatagattaggtcttgaggtgcttcttacaaccataaggcttatgcaaggatgaaaagccttttatcattctaccggacaaaaaaaaataaaaagaaaggaaaagttactggtagtctagtactgccccctttctagctgagatcattgccttttgctgaaaggtgaatccactcatacccacactaccacgccaagccaccattgaatcaagacatgaaacatgatccttaaaagtatacgccactattagcctagaatcaaatggcattcatcatcttgcaattgcaaatgaaaaaaacgtgacagacagtactacttggagtaattactgaatatcgaagatttaaagacagtattaattaatcgaggaaaactaaaatgatggtcaaacagagtagtaagtgatgctcgcagtaacagaagataaaaactaatcaagccaaaaaaaaaaaaagcgggggaaaaaagcagaagtgccaagatggtaaagtattctaggatacgaaccaaaacagattaaacggttttcccttaactcctacgatttgcagaagccaagaacaatcaaagatttggtaggcaagcaatttcataattgtgcatcgcgatcgtacggtcgtagtactgcgtggtggatgaacaaatacgcaagaaacgaagagagagagaggaatcaattgattgatcgatcgatcgaaacgcccgccctaatcgggcatcttttctcacgccccaagaatcgcccgcacgataccaacaaacctcaaaagaggcagagccaaaaacaatgtttcttgtcgtttaactccctaaaccattatccaagatacaaacaaaaagaaatcgttcgtacgtacgtataatctgacttgttctcgcaagaaaattacaattaaattggttccgcaatctcgtcctccgatgaacaagaacaacctatctatctatctatatctgcctgatcaatcacctccgtatcgaaacaaacacggacagggattaattgattcggaaaggcagtcacagccaggaggagaaccaaatcaaaatcaatcaatcaaacccaccaagaaaccacaagaaccatcaaaacggcagacaaagattcattcaaacaaggagatagagcagaaatcggagagataatctgagagaaaaataccctcccaatcttcttcttcctcttcctctgctgcgtgctccagctagaagggtagagagagagagagagagagccgaacaactcaactcgatgagagaggaggtctcaaaccctcaacaatgtctcgtgcgcttggcttcctcgtctcctcctcctccctccgccatggccaagaagaagaaataaaagaagagatcgagagagagagagagagagagagagagagagagagagagagagaaaacaaacgcagtcggagtcgatgatgaggtggcggtgggcccgacgtggcatatcatcctggccgtccgatgggccgcggcggatgggatccgacggcccgggacgaggtccggcacgtgggcccggtccacgtaggcggtcgagtcggacgcgcgtggcgctgagctcgtatcgggatacctgagacggggctagcgggagaggctgacgggtgggccccataggttgggcccccaccctccgggcccacttccgatgtggataccgtaagcggggctagcgggagaggctgacgtgtgggcccgaatggtgggcctcccgccctccggccccactttctggtttgcatggtggggtagttggaaggtgcacgcggcgcggccgccacgtcctcgcgtggaaaattcgttcgccaaattctttgcgaattatttttctcctcccgtgaattttttgcgaaaaatcattccgcaaaaaatttgacgactcctataatcaaatttcatgttagtatatactgcatatagatgctattttcgatcatttaaaagaaaacacgacgatagttttctttttccccttcaataattatagtgcattagtgtgccacatgactgttaatttctttgatattccctatgagataaagatatagcttttaatatcgaatggagaaaatatattctataccactgaatttgtttgagttcaacaatttgctatcgacattgtaatataccgacaactttatcaattgttttacaatacaccattggatcaccattggattggtccttcattttaaaaatgcctaaactactcttagaaacatactccatccgtttcaaaatatttgacaccgttgactttttagtacatatttgaccgctcgtcttattaaaaaaaaatttgtgaaatatgtaaaactatatgtgtacatgaaaatatatttaacaatgaatcaaaagatatgaaaaaaataaataattacttaaattttttgaataagacgaatggtcaaatacgtactaaaaagtcaacggtgtcaaacattttgaaacggagggagtacaagattaacaattgatttatctcattagaagtttcaaaatagtatgaaaacttttatgtggcctggccttcttatacaacatggaaatttgtatagaagtttcaagatttttacatttctattttttgtaaaaaaaaatataacttatctgtattacgctacataagatatttttgtgctatgatatcttgtataagcaaattctctctcatataacacataaaaatatattttttttctaaaaactaaacataccaaaaaaaacttaaaaattgtataaaaacttccatgttgtgtaaggaggccacgtaaaaaatttcatatttttttgaaacttctaatgagataaatcaattgttaatcttgtatgcctataaggatattttgggtatttttgaaaagaagacccaacccagtgggatattgtgaaacaattgataaagtcgccggtatattatataaagagacaatgtcgatggcaaatcgttgaactcaaataaacttattggtatggaatagattctctccgaatagatactaaccaaccgtgcttttcttatagttgtgaacgaatgtactagtacattatcaagggttttttttagacaaatgaactcattgttttttgacaggttgtataaattcatttgtggaaaaaaaagagagctggttttacacatcttagggccacttattttattcccacaatacctgtgtgaactgggctacatgccggtcatgtctcgtgtttttttcttgacatgcaggacattttttttcatcctgaagacgactgcatagcacggtagttttgttctttatatcgttaatgcaaaaaatatatatacagttaatattggtaaaggcccaaacaattagcttctcttttctctacagatcattaccgctttgtggttgagtcaaaacatacatacatatagtagataacactttctatcgggttaatcacattcacatcattactggtgttagcaaaaactattgtatttaaatatataacacggttgattttaattttttaaaactttgacaaataataaactatcaaatatttggtccgaaaacataaaaaatatattggcatctttttctttataagtacttttataatataatatttctgttagatattaaaagagtatgttataatatgttttagagtaaagtgtacggacggtccttaaatttgtaggggtgcgtcatttaggtccctaaactctcaaaatgcatatccaatgcatatccaagtctcagaacttgtcatattgtgttatctaggtcccaaatcgccacagccccttcagaatcctatgtggcgttgatgtggcatgccacacggacatgacgtggcattattttggctgacaaatggtacccatttaatttttttccttttcttttcttttctcctctttcttctcctttctctatgacccgtgcagaagaaaggaaaaaaacagaataagaaaaataagaatgagaagaaaacgaaaaagaaaaagaaaagaagaagaaaaaaaaagaaaaggacatgtcacgtgcatgtggcattgccacatcagtgccacgtaggatcttaaaggggatgtgtcaatttgggacctagatgatacactttgacaagttctaggatctggatatgcattttaagagtttaggaacctatatgacacaaccctacaagtttaaggaccgccaatgcttactctatgttttacttaacgccgaattaattccgttatgaaatctgagtaaagccctgtgaaaaaatgagccgaatcatttgtactttgtaaggtttcttgttgtattctgctgtcaagcgaaacttattttggtatgtcatgatacaaaagtgaaagtacgcgttgatcttactgtgaagggaatcaaagaccattttacttgatggagaaaataatttacttataatacattatgtgaattgtgatggatggcacaaaacaaaagtgttgataggttgctgcttttcaatcagaacataatccttaggagataagaggaccaagtagaagaatcaagaaccaacttttccttgaccatagacctaattggacctctcaaatttctcatcaccttttctttgaccggtcagttcccatttcaacaattaatcaacaagctaggtgatatcatgtgatgttgagtgccttgtcaactgcaactactactggagttgggtatgaatccacacaagccaagaagctgatctcaaatcaatgccacttgtgatgcacgaggaatgcttttgttttcctcccttctttattttttcttttggtcaatgagtcagttatggccgtttgtgaaactttccattggctccatttgggcctcctgcaaatttccatgctctgaaactaattaataattgcttttgtaagactaaacataattaattaacatagatgagggtcataccgtagtactgatggtgatttgggagtagaccagatagcaaagatgaacatggctacaagcacccgtagtttctgacctgaactttgaaattcagttggattagttaatacagtatttgggtaggtttctttctcttgtatatctctattctattggagtatatatgagtgatatttctctgttttctctttcttccttttccattttaatttatttgtgttctgttcttttcctttggtggcactactaattaataaagacaaaggtactttgaaaagatacggagtgtatatttttttttcaaggagtggttataggttattttattttattacaattaaaagtgtcacgccagtaaaattggaacaattttgaaacatgaagtgtatctattttttaaaggagttcttattggtccatttattttattacaattgaaaatgccatgtctgcaaagttggaacaaatttgagcatcttgcatggttacacacacaggacacatatgtataaccaaagaagaatagtactagattgactacatgtctaagaatatgtcaatctcacatgggatgttttcatggtgcttgctgcttggtgaaggcaatagtggtaccttcactttaaagaaattgtggccgtaattagctgcacagtaactatcacttgccttagcaacagtttggtcaggacacaaatgatggcaaaaactgcagcagaatcaattaaactacagcatgacaagtggagcttctactatgtatgtcatgaaaaagacaagggaaagtttctgctgctatgatcatcttcaaatgccctgctctgagaagggacaagcacagaagggacttacatagagtttttaacccttcttcagagctgtcatggaagattttgcattttgagaagataaaagaaatccctcttgaaatttaaaacactgctaaactgtttattttgaatgaaaaactctgttaaactttgttctgggatatccttatgaggatgaaattacaaaacaatttttttatctgggcccaactaggagtattatgggcctgtaaatactagacaaagttttcggaatgcatatagtacttacttttcggaatgctaaaattaagttcaagcacaaaaccctctcaagaagaaattaacaatgtacaaatgcatttttagattaatccatgtagctgacaaaatatctaacttgattttttttctatgcctttttcttctaatgttttgtaagaaaaattgtcaggaaagatgtttgtaggaaacactaatgtccaattaaacaaacaagtaattaagcccctgttgctcaaatatggatatgattattctcttgaaacagaagctgatttcatccactgtgtcatgaggaaactgaagatcactgcctcctcaagaacacatgcagaaacagacaggcagacataaaagaaatgtacaccctgaggcataaattttgccaaacagataacaggagatgaacccctcttgctccctcttcactcccaacatgcgagaaaaaaaaaatcagcagcagctgtatttacacacacacacgcaaaagaggctcatatggcaccacaaaatctgatgctctcctgagcctatctccttctccatcttcttcttcttcttattgctgcattttttttctctctcgctcttttgccggagtaaactgacagaagggcagggggacggattcattggctgctgattgcagatgcatcaggcaaaaccaggactaaagctgttgtagtactaaaaactgggagaaagaaaacaaaacaaagaaagttcagtaacaaatgttgttgttcttcttcttctttcgagtgccgtgcattgcaagcgcacggtctcctcatcatcttcttgctgttcttgttgtctctactgcttcgccggggccggcgacggcgagctgccgggccacgccggcttgcgcggcgacggcggcagcagctgctgctgctgcttctgggcctccagctccgacgtcagcatctcgaacatgacctgcacatccttgtagtcgcaggtctgcacgtcctcatgtagcttcaggaggccacggctgcctgcacaccatatattgcagtttgtgattagtttttcagatgtaatggtagttcttgccagttccaggatgtatagagtcatgcttagaaaatgatcagaaataaatgagcagcaatcatgtttcagaatgtatagatgtatattggattagatgatttttcgatagatggacacttgttcattttccaatgatggtgaaaatgcatcagaaggtatatgcatttgctactgatttatgcaaggatggtgagatgaataacatgatgtatatatagaatcatgcttagaaaatgatcataaataaatgaacagtaatcatgtttcataatgtatagatttatattggattagatgatatttctatggatggacatttgttgattttccaatgatggtgaaaatgcatcagaaggtatatgcatttgctactgatttatgcaaggatggtgagatgaacaacagaaggtaaagaaaaattcatttgctactaatcaacaccctttcttcttcttctcctttttattttgagagagcaactctttttatactttttgagaggactaatcaatgcattcggtagctttccaacccagtatatggtggtttactgtatgagagccaaaccttcaatgctaaaggctaaaggcaatgaggcccatatactacaggtagatagtactgagcctttttctgatgctttgggccttgggctccacactcaacaggctgttggcccttaaatggtcatccagtagtacataactctaacgacttaattgctaatttctaaaacatactaatttgctaattctatgaaaatcaaaaactgtttgcaattatttggtgaaaacaaaaaatgtttgtttagaaatgtaaactgaacaaaaaaaaaggttaaaagagcatgtcaatgaaacaaataaggcaatacggaaaataatttttttacatgacgccaagaaatatgggtaatacattttacaagccaaggatatatactgcaaatgcaaacacttagttttaaacaaaacactcaattcaagacaggagaagagaaaggaagctaagataggtatgaaaagggagaagggatgcaagtcagtgaaaaatatccaactattatctgctgtgtaattaatggaatttccttcatctttcccaggataaacatccattttctcgtggcctgacatcacggaaactttacaccattccagatactacaacaaatggcagtatggcaccacagattgccacagcaatacggccagggagcaaataaaaaaaagaagaagaaagaaagatgcaaaagtcattggtccaataacaaattggtgcaagtcagtcataaaagttcggcttagtgatcccttgccctctgcaactttctgccaaagaaatggccaatggtctccattactttctaatttatagcaagggcttcagaagcagcaaaatctatgagaagtttcctattccctactaactacaaaaactgtaaaatttccgcgaaattcctatactccatcggagtgtctcggtaggccaagattattattgatttggatggtatatagatttgaaccacaatcccaacaaaactctaatcagctataatctacatctatccattggccgtgtacaaccctgttggatgtagaggacgggttccgatctatcatctaagaaaatattctactacatctgtccagataatttgatccagaaaatacaaagtacagaggtacacacggtgaagtatcctcctgtgtacctaagattgttgagtaaagagaggtcgacattagcatgatgctagtaaaggataggagcacgttgacatgggatcctctggaccaggtccctgcactgcactgcactgcagcaccaaggacgatctggacaacgctgtgccgactgcccccagtagtgtaggactaccatcaccaggatggaccggggaggccccacctgtaagtgtcagtggcagtgcctcacctactgcattcgcatcaatggcaggcaggcaagcaaggcaaaacgttcttcagtgcacacacacacacacggcctgtacgcctcgtgacgccacgcaaatccccaaatcacaaatgcagaacatgcaaaatgctattgctaaatgctagtattaagatcgaaatcgagtcgaaatcgaatcgagatcgtgtgtggtggggagcaagacagaatcaacagtacagagtactagagagacgctacgcaacaagatctggaagaactctctctctctctctctctctctgtccttaattccactcactcatcatcacgtaattcatccatgctggttggttactgaatctgttattctcttgttctgcatttttttttctgcttcttttcttgctctatctgcagtgagcctgcagtaactaactaactaaccaactaaactaactgtgagcattttttccaaattgtttttttagttttgttgttggcgccgcctctataggtacagtagtacatggtactctctaaataaaaaaaatatatgaaaatttattcaacaccttatctctttgctaagtttgattatcttaattgtattaactatgttggtttcttctctaattaaaataaaaaaatgttgatttcttctctaattaaaataaaaaaaatgtgcagttccaaacagaaaaaaaaagagcaagaagaggagacatgtaatgtaaccaaccacatgagcaagtttcagagtttcagcaaaaggaggtgagaaagaaaaaaaggactagtggagtaaccgtatttatcatttctttatttttgttcctttttaaggtcgcattaattagcatcatggttatatccttatcattttaaagatcaatttgcatagtcaaagatggatactcttaattaatcgaatcgcagatacatctaaattaaaaaaaagcgaaaaaaaatgaactcttaattacggatattgcacatggagatagagaaaaaaatggaacgaaaagaaaaaaagcaaagaaatcatgatcaaagaaacccctctttttcttgatgaacaaccaccaccaccaccaccaccaactcgcatggcgtcaatcgaacaaaaccgcgcatacgcataaaagattgaagagaagagacaaaaaagaaaagaaaaatcctaggaaaaaatggcacttcgcttcctccatggaagcgaggagaggacgaactccgattctccaaccccaaaagaagaagaaaaaaacagagagagaacacccgaaatgagacgagattaactaacatcacaagagaccggagatatgcgacagcgacaatccatcatcaaccaagcaaacgaacgaatcaaccaatcgattctaagattatctacgtgggatacaccgatcatggaggaggaggaggaggaagaaggggagagagagaggaaaccgcagcaacagcagcaacaaacagtatacacacaccttgcttcctcgcgcggaggcggccggagacgagcgccgcccacgcgcggcgcgcccggaacgcgaccttcttcctccacccctccatcgatcctcgccgccgccgccgccggttcgccgtcagaagcgcgtggccgccttcgtctccgctgctgtgctgggagccgcgcgcgtgtccccgatcccacggggtttttatcccctggggtttgggccgtgtgggtgtgggttggggttgggttggaccgcccgggttttagggttcatgttaatgtcattgcggtggatggatggatggagacgcggtgtggctgcaagggcttttggttgggtgcacgcacgtaacaaggatgatgattttagtttgggttatgaatttagtttgtttgtttagttaaagagaaaaaaaaactaatacgctatacgagatagtatagtgcgtgttattaaaataccatcttacggagaaggatgttcacgcttgtattaatagtgaagaggattttagtctgggtcgttagtttaatttgtttacgtaaaggaaaaaaaaatactaatacgctatacgagatagcatagacagtattattaaaataccatctgacggagaaggatgttcacacttgcattaatagtgaggagggatgtaatacgtctagaggccggcaggagacgtggtgtggctgcaagggctggtccgatgcatgcacgtaacaaggatgatgttattttttttaaaaaataaaagataaggtcaaggatgaggatttaatttgcttcgtaaaaagaaatgtataatacgcgacttgagatagcaggtcctaaaaataccatctttaagaagggtgtgcatgtttacattaaatgtgaagagtattacaatatatcagcttagctgaatttggacttatcgtgtcacttatacgtcatgtggatgacagatagctatatctctttgttgtagaaaccatttacactctcccgctgtggagctcaccatgcaatgaattttagatttttgaaagactcaataaactccaatctagaaacgtaattccttgctcaccacgtttctttctcatccgccctaaccacctctatttcaacttagaaatgttaccatgttttctttctcctattcttttggcaaattatcctgatctcttcattccgtgctaccaacttcattggttcactactgattagtacatctccgtcgtgagaaaatataggagaggctgacaaccccctaaattcctctatcatccatcgttagactctgatgattaactttcttagcaccaaaatgttagagcattggtagtaggcacaaccaattcctaattggtgtgggaaggatgacactacattgccttgattgttagttcagaatcctatcatagtggcatattacactatatgattggaactaaatacaacaccatatcatttttttgaagaaggctataccatgagtcttaaggagcgggatgtgcacgcttgtattaatagtgaagaaggctagaatatgtctggggtagtcaaatttgaactattcatttcacttatacgtcatgtagatgatagatagctatatccctcttgatgtagaaactatttactctctagttgtggggatcactcaaaataaattatgactttttataggctcaataaactcaaatttagaacctttctttcttactcgccacgtttcttcccatcctgtcctaaccacctctgttacaagtctattccaacttacaaatgttaccatgtttctctttgcttattctttcggcaaactatctcgatcgctcctctaccttatttcgtgctaccaactccattggttcactactgattagtaaatctccttagttaaaaaaacatatgagatgctagtggctcctttacgacaaacgatgttgctaacgttctctatcatccatcttttgtgatgatataatgttagactattggtagataggcacaagcatggtatggttgcaagagtttggtctggtgcacacacacatgcaacaaggattttaggatttagtttaggtcataaatttaatttgttttggaaaaggaaaaatgtaatgtgtgactcaagatagagagctttaaaatattgtcttaaggagcaagatgcacacgcttctattaatcgtgaagaaggctagaatatgtttggggtatctgtatttgaactggtcgtgtcacttctccgacatgtggatgatagatagcttcatagctatatctctcttgacttggaaaccatttcctctctctcattgtggggctcaccaggcaataaattgtaactttctatgaaggctaaataaactccatttagaaacttccttttcttgcttttccacatttcttcccaccctgtgcaaaccacttgtactacaattctatttcaacttagaaatgttaccatgtttccctttgcctattctttcgataaactatctcgattgggcctctacctgatttcgtgctacgaactccattagtctacgccatgaatttaatttgtttaggtaaagaaaaagaaaaatactgatatgctatacgagatagcatagagagtattattaaaatgccatctgacggagaaggatgttcatgctcgcattaatagtgaggagggatggaatacgtctagatgccggcaggagacgtggtgtggctgcaagggctgatccggtacatgcacgtaacaaggatattgtttttttaaaaaaaataaaatataaggtcgaggatgaggatttaatttgtttcgtaaaaggaaatgtataatacgcgactcgagatagcaagtactagaataccatcttaaagaagaaggctctgcaaacttacattaattgtcaagagtattacaatatatcggcgtagctaaatttggacttctcatgtcagttatacgtcatgtggatgacagatagctatatctcttgttgtagaaacaatttactctctctctctctctctctctctcgttgtggagctcaccaagcaatgagttgtagatttttgaaaggctcaataaacttcaatctagaaacttacttccttgctcgccatatttctttctcacaccaccctaaccgattctattccaacttagaaatgttaccatgtgtttttacctattcttgcaacaaattatcctcatctctcctctacctgattttgtgctatcaacttcattggttcactactaattagtatatctttgtagtgagaaaatataggagaggctgacaaccccctaaactcctctatcatccatcatgattaacttccttagcaccataatgttagagcattgataataggcacaaccaattcttaattggtgtggaaaggatgaaactacattgccttgattgttcgttcaaaatccttttcgtagtggcatgttacactatatgattggaactaaattcaacaccatatcattcctttgaagaaggctataccataatgtcttaaggagcaagatgtgcacacctgtatcaatggtgaagaaggctagaatatgtctagggtagccaaatttgaactactcatgtcacttatacatcatgtggatgatagatagctactatatccctattgatgtagaaattatttactctctcgttgtggggatcactcaacaataaattgtgactttttataggttcaatgaactcaaatttacaacctttctttcttactcgccacgtttctgtcacgcccagaaattcctgaatagaattccaagtagaatgtgcattaaaatccctgtctaggaccggccggggtacacaaacgataaagttgacatacagatccacgtcttacaaacatcataaaagtcttacataaatgctggaaaattaaaagataaatggagctaagccttgacttggactgcagtgggaacaccactccacaggcatcctcgacggcacggacgaagcctactcctcggagaagccaccatctgacacgtactcaaaactctggggtttcggggaaagtagggcaagactgagtacaaccaccgtactcagcaagtcataccggaataggggtatgatgcaggatataaccaaaggatagctacagcggttcatttgcataaagcgagcatttaaaggcagcagttgaaagcagtaaaacagttgtaataattcatcaatcttaaccatccactgttcaacgctaccccacgttgcaataggcctaaccatccgcctgaactaatcaattccattagactaagctagggtgagactaatcacggtgaatctggttgaccgcccgtaaccgcgggcacgggtattcgaatagttttactctgatcagaggtgtacaactgtacccacaagacacagccctgcgacacgttaccgtgctccgatatgccaccacgacataccggaaagggaccatgacaggacccttcgcataaccccctctagccaagcacaccacacctcaggtttcacccccgtccccagcgggcaacgggcggtcccctctcgtgcctaggtgaatccggaagcgacagaggccatcgcagggcccgccccactccatcacgcccaccattgcctagatgcgtcaacgagagggaagctacactataagcccagccgttgcctacgctggcttgtggtaagtacgataagttcttccagggcatcccgcgaaccggtccttaagtgccatgggcgcgaccatcgaaaccatgcacccacagcccaccatttaatatattttaattaaccaacaccggagcggtgtcattaaccaacatcattactagaatctgatatctatgcattaatgtaactcccccattgtgtgctagttgaactaagcatggctaagcaatccctagtccaatatctagtcatgttatatcccaagctaacaaaggagcatggtacaaaaatagcatggctataacagtaggtaaacatcccatagtaacattataaaacaatgcagtatttaagggaaaacgatagagcatttgcaatataggatcaacatgttcaagtgataagcatgacttgccttgctccgctgctggaggaacctcggcgactatttcaaagtacaccggagcgtcgggagagccgaaatctaagcgacatacaaagcaaacaatacaaacaggccataagactactgaaacagagaaaaaaaaaccatttttaatggattctatgcatttttcttgatttaccgagacttgaatgggcttaaacggagctcggatgaattagatatgaattttagaagattcactgtgtttttactataaatagaaaaatccttaattgatttattgcgcaataattaaaatcgcggggagagagagggggcggcgccgacatgcaggccccatatggcagtgactcgggtggcggtctgcggtggaccgggtccacggaccggggaaggagcggcgcaccacgtggcgctgacgtggcgccgacgtggcgcacacgtggcggccacgtggcagccacgcgagcggccgaaccgacggccccgatctaccctcagcggcgggtgcgcgcggccggcgcgtacgggcggctcaagccggcccggcggccatggcgcacggcggcgctaccgcggggcgacgacggcaaacggcggtgaccgacggcgagcgacggcggtgtgaccccgagcagcaaggggcagcggcgctaggaggagaggggaaggacgacggggttcttaccgaggattcggccggcatggaggggcaacggcgaacggcggcgaggaatgaccaggaggcgacgacgaacggcggacggtctccggaaccacctagcgggcatgatagagagagagaggaggatggaagagggcaaggacgccggccgaagccggcggccatggcggtgctcaccggcacatgatgcggagtgggttccggcggcggtttccgacggaggagaggtggacgggacggcctgcacgacggcgaacgcaatggcatcggcggcggttgcgggatgcggcggcgccggctggaggtaggagacgggcccgacaggtgggccccacctgtcggcgacctgaagggaggagggaggaggcggccggctgctggaacttggccttcggccggcccagcggggaaggggaggggaagagaatgggtcgacgacccattcaaaaaggaaaaggagggaaaagaaaaagaaaaagaaggaaatgaatttccagggattaaatattgcttgtgctcatttttaaatgattaaaattatttctagagctctaaaaattccactaaaaatcttgttagcacatttcggcatgtagaactcaagaaaaattccacatgccaattccaattattatttgcattaatttattagggtttcgctattgcttttacaccggtattttcttgaggccatttataaattcaatttaggcttgggaaaagaacttcagggtatgacaaacctacccccttaaacggaatcttgaccccgagattcggaagagctggtgaagaggtgcggatgggcggccttcaactcatcttccctttcccaggttgcttcttcctctgagtggtggctccactgaaccctacagaacctggtgaccttgtttctagtcctcctttcactggtatcaaggatgcgaactggcttctccacataagtcagatcttcttggatgtcaatgtgctccgaattggcttgttcttcgggtaaactcaaacacttctttaactgggacacatggaacacgtcatggataccgatcatgttggatggaagttctagctgataggcaacttctcctcttcgttccaagattttgtatggtcccacgaagcgtggtgccaacttgcctttcgtctggaaacggtgtactccccggagcggagtgacacggaggtacatataatctcctgcttcaaaagtgagctctcttcggcggttgtctgcgtagcttttctgtcgagactgtgcaattctcagcctctctctgacggttctgactttctcctctgcttccgttagcacttctgttccgaacagttgacgttcgcctatttgatcccagaagagaggtatgcggcacttccggccatacagcgcttcgaacggtgccatttgtagactggcctgatagctgttgttgtaagagaattcagcataaggcagacttttatcccaagctccgccaaaatcgagcgcacaggctcgcaacttatcctccaagatctgattgaccctctcggtttggccatctgtctgcggatggtaagctgtgctgaaattcgaacgggtacccaattcctcttgcaacttctgccaaaattttgaggtgaattgactccctcgatcagatactatctttttgggtactccatgcaaacacatgattcttgagagatagagctctgccaaccttttgcctgtataagtagtatgcactggaatgaaatgagcaactttggtaagtcgatccacgactacccagattgaatcgtggcctgatgatgtcgtgggcaggcctgttatgaaatccattccaatctcttcccatttccattctgggatttgaagaggttgtaacaatcctatgggcctctggtgttctgccttgacccgctgacaaacatcgcagagtgcgacgaattcagctatttcccttctcatgctggcctaccaaaatttttctttaagatcttggtacatcttggtactgcctggatgaatggagtactgagtctgatgagccttggtgagtatcagatctttcagctctttgtcatcaggtatgcacaatctttctcccagccagattgtgccatgttcatcttcaagtaaatcccgggcttttccgaccctcatattctttttcagttcagctatctcaggatcatttacttgagctgctcttacttgatccacgagcgtaggccgtgcctttagagcagccacaaacccgtgttctacgattcccaagttgagatgttcaagctcctgctgcaattccttacacatgccttcggtgcacaaagcattgcagtagctcttcctgcttaatgcatttgccaccacattggctttgcctggatggtagtgaatgctcatgtcataatctttgattaactccaaccatcttcgctgtcggagattcagatcaggttgggtgaagatatatttcaaactcttgtgatccgtatatacttcacagcggttgccaatcagatagtgcctccagattttcaaagcatgaaccaccgctgccatgtgttggatagtttccttcatgcggacgcaactgccgcgaggcataagcgaccactctgctctcttgctttagaacgcatccaagcccgtgacgggacgtgtcgcaatagacttggaagtctttcgtctgatcgggcagaatcagaactggagcaggtactaatttcttcttgagctcctcaaaactcttgtcacactcggctgtccacctgaatttctcgtctttcttaagcaactgagtcataggtctggcaattctggagaaattttcaatgaaccgacggtaataacccgcaagtccaagaaaactccgaatctgtgacacggtcttaggtggggtccacttggtaactgactccacattcgatggatagactgccacgccctgagctgtaatgacgtgacccaagaatttgacctctgataaccaaaagtcgcatttgctgaacttggcataaagctggtgctcctgcaacttctcgagtaccagacgaagatgttgctcatgctcttcttccgacttggaatagattagaatgtcatcaatgaataccacaacaaacttatccagaaattccatgaacactttgttcatcaggttcatgaagaaggccggtgcattcgtaagtccaaaatacataaccgtgcactcatacaacccataccgagtggtgaaggccatcttgggaatatcctcttcctgaattctcaattggtgatagcctgatcgcaggtctgttttagaaaacaccttggctcctttcagctgatcaaacagatcatcaatccgcggcaaaggatatttgttcttgatggtgacctcattgagtgtgcgataatcgacgcacattctcttcgtcttgtccttcttctccacaaaaatgaccggagcaccccaaggtgaagtacttggtcgaatgtaccctttctgcaactgctcatcaacctgcttcttgacctctgctagctcgttggctgccattctgtacggcctcttgtaaattggggcagtccccggtgccaaatcaatctggaattcgatctccctcttgggtggcatggtagtgaggtcctcagggaacacctctggatactcgccgactatagggatatcttccaatttcctcgaactcttctcctcggtgaccatcggattttccacctcaatctgatttaaggagattccctgcttcagtacgactggtgacttgtacaccactgtttcccctttctcattggtcaaggtgaccgtgcgattcacacaatcaatgacacccttgaacttggtcagccaatccatcccaagaatgacatctaggtctttggattcgagaaggatgaggttggctagaaatggtgatctttggatttctattgttacacaagggctgaattgaatcgaggtggagctattcccgggggtctgaacccgcattggtgtactaagttcttctcttattaacccatgtaccccaacaaacttctttgaaatgaatgaatgcgttgcaccagaatcgaaaagtactgttgcagggattgaggctgcattcgtttgggtgatggggagtgagaatgcacatcgttttccgcgcgcacacttcccaaactactaaacggtgtgttttttgcaaaaattttctatatgaaagttgttttaaaagatcatattaatccatttttgaaatttaaaatagttaatactcaattaatcatgagttaatggctcacctcgttttacgtatcttcccaatctcctcaatccctttctcctcaaacacaccctgagttaacaggaaacgtacccagtacgacctctggtgctacttgcgcctcttctgcggacgcgtggttaacccgagcctggacaaacttgggtccagcacgcctgggcttcgggcacttgtcggcgaagtgaccggactcaccacagttgaagcaggctcctggcttgcctccggtgtccttctttgggggaacgggtgcagtttgctgaactggcgccattggcgggcgtggggctgcgctgcggttgtgctgaccttggccatgatggctgccactgctgccggggtggaagttgcttgggttgtaagggcgatgctgtcgaacaatcatggtggtaggcccaccctgctgtccaggagtgaagcgcggtcgctggtgacttccttggttggaccggaactgtcgaaacctgaattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatctgatgatcaggttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtgtgggtatggggtacccataatctccacagtagcccctgagaccttcacagtcggaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcaaaaagcaacgatattgtatccaatcaattgctttaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaagtctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgcccttctgtcatagtcaaaattgtctattggcaatagctgacgcagtcggcatggagatgaaatgaccaacatgaagacgaaattgctcatcagaagtaacggaagatgtcagtggtagtaaagatgacaccaatcaaatgtaatgaagttgcataaccatggaggcgaagaaaccagtcggcaacagtcaggtcagctagcagtgaagatgtaggcgcccaacaacaacgaaagaacagttggtggtgacaaaagcaaaccgacgatgaagatgtagacgcgcatcaacggtgatggcgaaatccaccaatcatgaagatgaagaaaataatcggcggcgacaaacgcatccgacggtaatgatgattagtggcaacagagatagccgactatgatgacgaagtttcccatcaacggcagcagagtaggctatgttgatgaggcttgacaagatgttgatgaagatgacgatgtcggtgatccagtcaatagcgatgtagcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggtggccggtcggtgaagacgtagacgcccaacaacggcagcataataggccagccgtgcaggcggaaacaccagtcggcggcggtcgaagcggccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtaggtgcccaacaacggcggcataataggccagccgtgcaggcgaggacaccagtcggcggcgacgaaggcgagccggtcggtgaagacgtaggcgcccaacaacggcggcataataggccagccgtgcaggcaaggacaccagtcggcggcgacgaaggcaagccggtcggtgaagacgtaggcgcccaacaacggcggcataataggccagctgtgcaggcggaagcaccaatcggcagcggcgaaggcaagccggtcggtgaagacgtagacgcccaacaacggcggcataaaggccagccgtgcaggcagaaacaccagtcggcggcggcaaaggcgagccggtcggtgaagacgtaggcgcccaacagcggcggcataataagccagccgtgcaggcgaggacaccagtcggcggcgacgaaggcaagccggtcggtgaagacgtaggcgcccaacaacggcggcataataggccagccgtgcaggcggaaacaccagtcggcggcggccgaggcgagccggtggtgatgttctgactgatccattcctggagcgtaagagataagcttaaagccatgaatcccttttatgcatatctggatctggatcctgcagaacaaacatatatgatgagtagtatctgatataaatataatactcgagaaaaaatcaagtattttaaaatatttataaatatgtatttctcctcttgtcaattttgatttccccgagcagatgattcattacgtttaaacgctctgtccgactagtcatagcccccaagcatcgggagtcggcctaggcacttcccagacatgcatatgagtgacatgagttcgccattaatagaacaaagtttcacgaatcagaatttactactcgggtacttttgcaattattaagagcagaaaataaatttatctcatctctatgcttttgatttattccgaataatacttagcaccttgcgttactcggtccatccaacgggcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaatggtgacaaaaaacaccagtcggcgccagtgaaaccaagccagtggtgtagatgatgaagcccattaacagcggcggagtccgccaaccgtataggcgaaaacaccagtcagtggcggcagaggcaggccagcggtgaagtcgtagacacccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggtggcgacggaggcaggccggcggtgaagtcgtagacgcccaacagcggcggcataataggccagccgtgtaggcggaggcaccaatcggcggcgacggaggcaggccggcggtgaagtcgtagacgccaaacagcggcggcataataggccagccttgtaggcggaggcaccaatcggcggcgacggaggcaagccggcggtgaagtcatagacgcccaacagcggcggcatattaggccagccgtgtaggcggaagcaccaatcggcggcgacggaggcaggccggcggtgaagtcgtagacgcccaacagcggcggcataataggccagccatgtaggcggaaacaccagtcggcggcggcgaaggcaagccggtcggtgaagacgtagacgcccaacaacggcggcataaaggccagccgtgcaggcggaaacaccagtcggcggcggcgaaggacggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaggcaccaatcggcggcgacagaggcaggccggtggtgaagacgtggacgcccatgaacggtggtgtgaccaaccaaccgtataggcaaggacaccagtcggcggcgacagaggcaggccggcggtgaagtcatagacgcccaacagcggcggcataatagaccagccgtgtaggcggaggcaccaatcggcggcgacggaggcaggccggtggtgaagacgtagacgcccaacaacggtggcataataggccagccgtgtaggcggaggcaccaatcggcggcgacggaggcaggccggcggtgaagtcgtagacgcccaacagcggcggcataataggccagccgtgtaggcggaggcaccaatcggcgacgacggaggcaggccggtggtgaagacgtagacgcccaacaacggtggcataataggccagccgtgtaggcggaggcaccagtcggcggcgacggaggcaggccggcggtgaagtcgtagacgcccaacaacggtggcataataggccagccgtgtaggcggaggcaccaatcggtggcgacggaggcaggccggcggtgaagtcgtagacgcccaacaacggtggtgtgaccaaccaaccgtataggcgaagacaccagtcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcggagcttgaagaagtggtcgacggaaaggaagtgaaaactcccgaagcgaaaacgaagtcggcgactcatgaagttaattccatcgcgctcgttgataggaaactcgacgcagcccctacctggcgcgccaactgtcgaaacctgaattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatctgacgatcaggttgtgtcatgccccctagagggcctcctgcccaccttatatagggtggggggcaggattacaagatagaaaccttaaccaatatggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtgtgggtatggggtacccataatctccacaggaactgagctgcctcctcttcctgtccattttgttgcgctgatcctcctggcggattgccttgtctaccagcttctcgaagtcagtgtaatccccggagatcaactggttggtcagctcgtcatccagacctgctaggaacttctcctgtttcaatgtgtcaatgtggacatcctccggtgcatatcgcgctaggcaattgaactcatggaggtactcagtcactatcctgttgccctggtggagtgcctggaattctctcttcttttgtgccacgaccccgtctagtacttgcgccttctggaagctgcgacagaactctgcacaagtaacttctgtgcctggcgggcgggtagccatgtggttatcccaccaagctgacgtgggaccctggagctggtgtgtggcgaaggcgaccttctcctgatcgttgcactgcagaagattgagcttcttctctatggcatggaaccagtcatttgcctccatggggttggtggtgctagagaaggtgggtggcctgacgcgtagaaattccggcagcttggactgagggggagggggaccaaactgctgctgctgctgctcggcttgctgctgcatcctctggtgcatctgctagggctggtgctgcatcagctgcatcatggccgccatcatctaagtctgatgggccatcacttgtgcaagagtcgggttcttggggagcggtggtggactgttgccagaggcgctgttgggatatccaccgtcggtgcgttcttcgccgttgctgccttcacctgctgcatggctgccattcctggtgttgaccatctgaaggaagagcagacggagggggtggaaaagaagaaaaacagatgctcaggaactaagctatattatataggaatttaaattgcaattgttctgatctgaattaaaacatttaaaacagcaaacaaatccttattaagacagccacatcataggcacatgatgtcgaccgtcgactgacccacaagcgaacaaacctaaacacacaaactaacaaacaaatactaagcagtcgataaactaagtgaaaacaagcctaatgctcggaacggctcctgcggtcggtggagtcgaaggcgtcctcctgctcgtcgccaggtccctctgagcggctcctggagtctggcagatacgtctcgccgttgcccggctctgagccactggaactgctgctgctgtggtcgtggctgccactgtgagtagcaggcaaccaacctccgttgccaatggctggacccctggcggctgacgctagagcgaaggagagagcggacgcgggagctgacactggaacggaagctgggactggagctggaactgcgggcgctgcgggaactgtgggaggtgctggaggagctgcgggaggaggtgggttcctgggcgcaagctgaatgcgcacgggtgcagtcgttgacttgcgaggcgtggtgcggatccggactcctccgggagcggggagacccttcagctgagcgttctccttcttctggcgtgctatctcatccttcagagctatgatcctcacaagcttcccatcattcgaggccttggatgccttgtgcaggtcagagtgcatcgtgtccattcccctcatcacggcacacatgtggctgaaggtggtgtcattctcactggccgtcgggcggaaggtgctgacgtcgtcgccacttgctcggcgagggtggaagcggtacgccgtgttgcagaagatttagctgtggcgatcacgaagcctggccatcatcaggtatgctgcctcctgacaagtgtgatctactgtgcctccagaggcctcaaccaccatgttagcgaggcaggtgcccacaaagccatgaacctccagacgaacacggtggggaagctcgccactgagcggcggaacggtcgagtactccggcgcgttggggtagcccaccaccagggtcatgcgagccaactctgccacaaaatcatccatgccttctccacggtggttgggtgggtggtcggccatctagagaagacaaagaagtaggatcaatgcatgttcaaatccaatttaaataaagcagtaaaggactcaaataaaatgaacgaatgagagcggaattttgtgcatagatcatttttgcatgagagcgaataaataagacggacttacatagcgataaaataatgagaaattagatacatactaataataccaataagagcataaataacttgcaacacatattcctgagttaggacccaatgcattcctcctatcaaatcccgactaactgtcaaataaacctcaaataattttactaaaaccctagactgacctgatttgataaatcttacttaaacgagcgaccaagatttttcccttgaactacagaaacaaatcccaattttcccagaacaaatccaattgcaaagaacatatgcaatgaaaaggattcagagggctcttaggttttccatttggcttgtcctacagtcaaggtcggctctgataccaacttatcacgcccagaaattcccgaatagaattccaagtagaatgtgcattaaaatccccgtccaggaccggccggggtacacaaataacaaagttgacatacagatccacgtcttacaaacatcataaaagtcttacataaatgcagcggaaaattaaaagataaatagagctaagccttgacttggactgcagcgggaacaccactccacaggcaacctcgatggcacggacgaagcctactcctcggagaagccaccatctaacatgtactcaaactctggggtttggggggaaatagggcatgactgagtacaaccaccgtactcagcaagtcataccggaataagggtatgatgcaggatataaccaaaggatagctagagcggttcatttgcataaagcgagcatttaaaggcagtagttgaaagcagtaaaatagttgtaataattcatcaatcttaaccatccactgttcaaagctaccccacgttgtaacaggcccaaccattcgcctgaactaatcaattccattagactaagctagggtgagactaatcacggtgaatctggttgaccgcccgtaaccgcgggcacagctattcgaatagttttactctgatcagaggtatacaactgtacccacaagacacagccctgcgacacgttaccgtgcgccgacatgccaccacgacatactggaaagggaccgtgacaggaccctttgcataaccccctctagccaagcacaccacacctcaagttttacccctgatcctagcgggcaacgggcggtcccctctcgtgcctaggtgaatc

SEQ ID NO: 4924 - DNA, 1062 bp, Oryza sativa
aacatgttcaagtgacaagcatgacttgccttgctcagctgctggaggaacctcggcgactatttcaaagtacaccggagcgtcgggagagccggaatctaagcgatatacaaagcaaacaatacaaacaggccataagactactgaaacagagaacaaaaccattttgaatggattctatgcatttttcttgatttactgatacttgaatgtacttaaacggaactcggatgaattagatatgaattttagaagattcactgcgtttttactataaacagaaaaatccttaattgatttattgcgcaataattaaaatcccggggagagaggggacggcgccgacaagcgggccccatatggcagtgactcgggtggcggtctgcggtggaccgggtccacggaccggggaaggagcggcgcaccacgtggcactgatgtggcgtcgacgtggcgcacacgtggcggccacgtggcagccacgcgggcggccgaaccgacggccccgatctacccgagggtatatcagacggcggcgggagcgcgcggctggcgcgcacgggcggctcaagccggcacggtggccatgccgcacggcggcgctaccgcggggcggcggcagcaaacggcggtgaccgacggcgagcggcggcggcgcgaccccgagcggcgaggggcggcagcgctaggaggggaggggaaggacgacggggttctcaccgaggattcggccggcacggaggggcgacggcgaacggcggcgaggaatgagtgggaggcgacgacgaacggtggacggtctccggaaccacctagcggacatgataaaaggggttagagagagagaggaggatggaagagggctaggacgccggccgaaggcggcggccatggcggtgctcaccggtgcacgatgcggagtgggtgtcacgcccggaatttctatccaaaattccaaacgcttacatgtgtgtgaaccctcgtccaggaatcagccgaggcacacaataacaaattgataatagagtacaaatattactctaattaataagcgaataaaat

SEQ ID NO: 4925 - DNA, 25515 bp, Oryza sativa
gcgcgcgcgcgcggctgactggcccgcctgggccgaggagagagaagagaggttttgggccgactttcggaccaaagccaaaagaagactttttaaaaccttttcaatttaaattatttcttaaatgcaattccatttattacaaatactttcttagctcaaataaatcccagaaaaatctaggaattatagaattaagcaaagtatttaatgaaattttatctggcccaattttatattggaatttattaattaaacttagattttcttttcaagacttttaaaattatttctaaaaattccatttaaacaacaatttatatattttgaattttcagggtgtgacaaacctaccccctttaaacagaatctcgtcctcgagattcggaagaactggcaaacaggtgcggatgagctgacttcaattcatcttctcgttcccaagttgattcttcttccgagtgattactccactgaactttgcagaaacggataactcgattcctggttcttctctcatttgtttccagtatacggattggtttctcaacataagtcaaatcctcttggacttctatctgctcaatattagcttcttcggtaggtacccttaaacattttttcaattgtgacacatggaacacattatggactcctgccaaagattgaggtaattctaactgataagcaacctctcctcttctactgacaatcttataaggtcccacaaaacgcggtgccaattttcccttggtatgaaaacgatgaactcctcgtagaggcgtgacacgaagatacacataatctccctcttcaaaactcaaatctctgcggcgattgtcggcataactcttatgacgagactgagccacacgcaatctttcttgaatgatctttaccttttcttctgcttcccttaggatatccgttccgaaaacctgacgttctcccgtttgatcccacaaaagcggagtgcggcacttccgaccatacagtgcttcgtacggagccatctgtagactagcttgataactgttgttgtacgaaaattctgcatagggtagattcttatcccaacttccaccgaaatctagagcacaagctctcaacatgtcttccaaaatttgattcaccctttcggtttgtccgtctgtctgcggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtttttaccggaataaaatgagccactttggtaagtctgtcgactattacccaaatagagtcatgtcctgatgacgttctgggtaaaccagtaataaaatccatacctatttcttcccatttccattcaggaatcttcaaaggctgcagcaaaccggcgggtttctgatgttctgccttgactcgctgacaaacatcacatactgctacgtattctgtgatttcacgcttcatacttgcccaccaaaatctttccttaagatcctggtacatcttagtactaccagggtgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaacgaaacctctatcgacaattcccaaatttaatctttcaaattccttgcataattccaatggcaactgtcgtccttctgtagcattgcaatagccttttctgctaagagcgtctgctacaacattagcctttcccggatgataataaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatacacttgaaaacccttctttggatcaggcaaaatcaaaataggagctgatattaagcgacttttcaactcttgaaaactccgctcacattcttccgaccacttgtacttcacatctttctgaagcagtcgtgtcatgggcttagcaatcttggaaaaattctctataaacctccgataatatcctgcaaggcctaggaaactgcgaatctctgaaactgtctttggttgcttccaattggttacggattccacgttactaggatcgacggcaactcctccggctgagatgacgtgaccaaggaatttcacttcggacaaccaaaattcacacttgctaaacttagcatacagttgatgttctcgtagcttctccaatgcaaggcgaagatgttcttcatgctcttctttggttcgagagtagataagaatatcatcaataaagaccaccacgaacttgtctaagtattccataaacaccttattcatcaagttcatgaagaaagtaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagttgatcaaacaaatcatcaatcctgggtagtggatacttattcttaatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattctgacagaggggctacgttgcaaagagagtgcttgattacttggggtactaaccatcaaaggacgtctaagatattctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagcagcgacatgatttacacgagccttggatgctggtacagcagagttattctgggcagggacaaccttcacgcgtcggggcttcggacacttgtcagcataatgtcctggatctccacagttgaaacacaccacgggcttgttgccttgctccctcttggcaggttgttgctgtgctggagctgcaacaggacgtggagcttgattacggatgttgttgccagcattgttgttgaagaactgacgttgcggacgaacaacagacgaagaacctccctgtggcatgggctggggtcctaaagtaagacgcggcttctgattatttccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgggaaagcgacctgaactccttcttcttgagagacactactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacccgaagaaattctgctaacttgttctgtggaggtgcatgattatttccttggttttgctgattctgaaattgctgcatcatcatgttcataagctgtgtctgttgagcaagaacttgagcaagagtgggattctctccattgttgttgttattggggttgttgggaccattcccattgctacgagtgttcaccatctggcatggacagggcacaagaagagaaaccggggaaactacttaggacagagaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagccacacacaagcaaacttaaagcaaaccaactaacacaacgatctaagacaacgacttaacaagtcactctagttcttccaagcatcggaggtcgattgaaggctcgtcttcatcatcttgagttgctacccactcaatcttggaattgttgcgcttagattcttcttcttcatcactacttatgatgatgaccggaggatccgcttgagctggagcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccgatcttcacgatcttgagctgctaacacagtctccgcacgactttcatccatagcccacaacatctcaaccaaatgtttcgtggtagcatcattctcaattccttcagtctcaagataactgccacggtcacttccctgaggttggcgaggatggtagcgatactcagtgtcggcggcggcgcgaccccgagcggcgaggggcggcagcgctaggaggggaggggaaggacgacggggttctcaccgaggattcggccggcacggaggggcgacggcgaacggcggcgaggaatgagtgggaggcgacgacgaacggtggacggtctccggaaccacctagcggacatgataaaaggggttagagagagagaggaggatggaagagggctaggacgccggccgaaggcggcggccatggcggtgctcaccggtgcacgatgcggagtgggtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaattttaacaaaacagttaagtaattaaacaatattaagccaacgctatacaacataccctgttgtataggcccaaccattctgaacaaccaccccggctgcacagttctatctccaaaccaggaatataccattccaaaccaggagctaatcagattattaccagtttaagcatctttttcaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataatccatcatgaaataatagtgaatcattagttatcccataagtgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctatgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcgggctagggtttgggtggaccggcacatgggcggcggttcacacgaacggacggccgagatctaaccgatccaagatggacggccgagatcgatcgggtccacggcggttcacggcggacggccttgatgacgccagcaatgacgtcaccgacggcggcggcggctcggcggagcggacggctcgggcggcgcacgctcaccggcgaacggcggcgctacggcacgaacggaggacaccaacgggaagcggacggcacggcgaacacaccgacgaccaaaacgacagcggagaagcaacggacggcgacggcgacgagaaggaagcggcggctaccttcgggttgtcgacggcgacgaagctccggcgggttccgacggctgcgaaggggcggacgaggacggcggcgacttggcgatgacgacggcggtcttcccgagcggcggcgacagctggagcgacggcggagcacggctgaagcggcggcggcgacggcgaagctagggcacacggcgctagagctcttccgacgacgagaggcgaaggcgagggctgcgacgggtagaggagacaccggggatccttttaaaggggctcggaggcgacggcggaggcccacggcgacggcaacggcgaaggaaaccttcggcttggagagagggaaaaccgatccgaatcgaactcgtctccgacgctttccaaagcgatttaaccaaagattccaaaggagaaaaggtagaggagatcccggagatcatttcccctctattgattcggccggagaaggaaaggaatggccggattggaaaggaaacggcggcggcggctcggcggcgcgaaactagggtttcggcccgaggaggacgacgactccgacaggcgggacccacctgtcagcgacagcgagggcgcgcgcgcgcggctgactgggccggctgggccgaggagagagaagagaggttttgggccgactttcggcccaaagccaaaagaagactttttaaaaccttttcaatttaaattatttcttaaatgcaattccatttattacaaatactttcttagctcaaataaatcccagaaaaatctaggaattatagaattaagcaaagtatttaatgaaattttatctggcccaattttatattcgaatttattaattaaacttagattttcttttcaagacttttaaaattatttctaaaaattccatttaaacaacaatttatatattttgaattttcagggtgtgacagtgggttctggcggcggtttccgacggaggagatttggacgggacggcctgcacgacggcgaacgcaacggcgtcgaaggcacggctcggcacggcggctagcggcggccggagcggtggtggcggcggcggagaggagggcgacggcgctagggtggtggagggcacgggagcgggtggttgcaaaacgaaaaagagagaggaggagacggggcgctttatatagaccagcgggggttgatcgtggtcgggatggccacgattccgccggcggagtggggagaggtggggaggagagagaggcgggattctaaattcgaatcccggccgtctcgagcgcgggcgcgggcgggagatagaaggagtgggcgcggggaaggcgggggggaggcggtgacgtgggcgacgtggcccaggaggtgcgggagcgagcggtgcggcggttgcgggatgcgttggcgccggctggaggtaggagacgggcccgacaggtgggccccacctgtcggcgacccgaagggaggagggaggaggcggccggctgctgggccttggccttcggccggcccagcggggagggggaggggaagagaatgggccggcggcccattcaaaaaggaaaaggagggaaaagaaaaacaaaacgaaggaaatgaatttccagggattaaatattgcttgtgctcatttttaaatgattaaaattatttctagagctctgaaaattccactaaaaatcttgttagcatatttcggcatgtagaactcaagaaaaattccacatgccaattccaattattatttgcattaatttattagggtttcgctcttgcttttacaccggtattttcttgagaccatttataaattcaatttaggcttaggaaaagaacttcagggtgtgacagtttcttcccatcccgtcctaaccacctctattacaaatctattccaacttagaaatgttaccatgtttctctttgcctattctttcgacaaactatcttgatcgctcctctaccttatttcgtgctaagaactccactggttcactactgattagtaaatctccttagttaaataaacatatgagaggctagcagctcccttacgacaaccaacattgctagctaacgttctttatcatctgtcgtttgtgatgatataaatgttagactattggtagataggcacaagacacggtatggttgcaagagtttggtctggtgcacacacacgcaacaaggattttaggatttagtttaggtcataaatttaatttgttttggaaaaggaaaaatttaatgtgtgactcaagatagagagctttaaaatatcgtcttaaggagcaggatgcacacgcttgcattaatcgtgaagaagcctagaatatatttggggtatctgaatttgaactggtcgtgtcacttctacaacatatagatgattgatagcttcatagctatatctctcttgatttggaaaccatttactctctcattgcaaggctcactaggcaataaattgtaactttctatgaaggctaaataaactccatttagaaacttcctttcttgcttttccacatttattcccaccctgtccataccacttgtactacaactctatttcaacttagaaatgttaccatgtttccctttgcctattctttcgataaactatcttgatcgggcctctacctgatttcgtgctacgaactccattagttcactaatgattagtaaatttccttattaaaagaaaggaaaatgaggggctggcaacccccttatgaaaaccgacattgctaggtgatattctctatcatccatcgttagtctgtgatgatattagagtattcacagataggcacaagacgcggtgtggctgcaagagcttgatctagtgcacgcacgcatgcaacaaggatgagaggatttagttcaggtcatgaatttaatttgtttctgaaaagcaaagatttaatgtgcgacttgacatggatagctttaaaacactgtcttaaggagcaggatacgcatgtttttgtattaatgataaagagggcaagaatatgtctgggtagccaaatttgaatgtgtcgtgtcacttatacgtcatgtggatgatatacgtctatatctctcttgacgtacaaaccatttactctatccctctcgttatggggctcaccgagcaataaatcataactttttaaaggctccataaactccaatttagaaactttctttcttgctcaccacatttcttctcactccatcctaaccacctctattacaactctatttcaacttagaaatgttaccatgtttccctttacctatccttttgtcatactatctcggtcactcctctggctgatttcatgctaccaactccatcggtttactacttattagtaaatatccttagtaaaaaaacatatgagaacctgacaaccccctttgacaaccgacgttgctagctaacattctctatcatccattgttagtctgtgatgatagaatgttagagtattggtagataggcacaagacgcaatgtggctacaagagcttggttaggtgcactcacgcacgaaacgaggatgagagcatttatttagtttgtggcatgcatttaatttgttttggaagaaatgtaatgcatgactcgagacagagagcgttaaaataccttctaaaggagcaggatgcgcacgcttgtattaatggtgaagagcacaataatatgtctgagctagccaattctaaactcatgtgacttatacgtcaagtggatgatagatagctatatctcttaacgtagaaaccatttactccctctcattgtagggcttaccatgtaataaattgtaacttcttaaaaggctcggtaaactctaacttagaaacttccttgctcgccacatttattctcaccctatactaaccacctatatttcaactctattccaacttagaaatgttaccatgtttccttttgcctattattttgacaaattatctcgatcgccgctctatcagattttgtggtacaaacttcattggttcagtactgataagtaaatctccttagtaaaaagaacatatgaaaggttggcaatccccttataacaaccggcattgatagctaacattttctgtcatccatccttagtctatgatgatagaatgttagagtattggtagataggcacaaccaatttcttattcgtgtgggaaggatgaaacaagattgtctaattcaagaaatccttctcacaatgtcatttcttacactatatgattagaactaattatttttggtagttggcttttaatatgccctgtccttggaacgccaaaaatatttttagtagttggcttaggggagtgcctaagatctatgaaaaaactagttttatttgaagctagtgcactacgttgatcaattttgcactgccaaataataaagtttttttataacaaaaaaactatctaacctcgtgcaagttatgtctagctctttcagctaactccaatattggtctatgatgataccacaggaagagcaagatattatgtataaattgtaatggtgctacactcttaggatctattggcaagagtatgttgttccattatgggtggcatatcgcatatattcttaatttctagaatatgttgccaagagtacatggttattctagcttttcagcggatttttattacttaagagtagatggggattttgtcccatcactctttttattcacttcattagaaacttattatccgacaaacatcgagcccaacctctattgctttaagccgtccccattgctctcctcctccatcccatgaatgtggcggccctcccactccactctcgtgaactttgcggtggcaatggctctaaagctcgatgtcaccacgatggctctcaggcttgagctcgccctcgccatggcggtccttcgctccaccccgagcttttgatctgctccacctcttccctcaaacatttgatttgtgtcaccatcacctcaatccctcgattcagcggctaccaacaaccatgccaacctctatttgtggctttgccgctagcccgtcctggatccacactgatgccatcgtcgacggcatcatctcgtcctcgatccgttgtgcccagcttcatctcgaccttgatctacattgcccgcttcattcgggcatctcttcgtaccactggtgtgtgatctctccctcgaggccaatcgtatcttgccagcgtcaatcgattagtgatggcttctccaaagcaagcaattggttttgtcttcgatttgcagcaccaccgccaccagctgtcggagatatgggaaccggggtctccatctccctcaggtcaccagggcgctgcagaatacgacaagacatacaagacacatatattcaagccaccaaggttaaaacacccaaagaggaccgctaagtctccaggcgtgccctgaacacagttggtgccccgggccatggggtgccccgtgcccctagggacagcggccacctagagaccaagccaaccatctctaggcctcgggtaggggcccgagcactcgtcgtgccctgagcagaggaccggacataacctttgccttgagcaccccatagagggcatggcaagactgaagaaaagctgacaagactagaagagttgctcaatcactcccttgcattaatggcagtatggcgcacgccttccacccatcctgtcgagaatgttgggagcgtggggaaacatgtgccacgcgtcaccaggtggtcccacgacagtgggttgagggcaccttttgactttggtgcacctcatccgtcagtcaacaggggagaacatccctcctcgtttggttcaaaagagttcaacaagaccaatcagaccgaatttaatggagtaggcttcactcccacatcaatgttggcactgtggactctccttggattataaaaggatgatctaggctaacggatagagggttcgatcccaagcaactaagtatagacactagaactcgagcttccacactgtaacttattctcgatcatccatccatgagtaggatattacgcctccctatagcttgaacctatataattctttgtactcatcttccgcgcgatctacacctagattcgaaactcatcccctggctgaatctttggagggagagtactcgcttccccactagagaagtttcatactccaatacaacaacttttttcactggtaattgttgttcctgagaaacgcttcgtctcccaaacggccaagaacactttcttttcactggtaatttgggtaaccgaatattacaattgtgtttccattacaaagggaaaaagaattcagtgctcccaaacaatccctcagtcttccgtttatgttatccaacatcggacaatagatgtgaatcttccatagaaaccacaattacatgatggttaatttttgttgcatagctagcggcagttcacaagaacccggcttgtctgtactatccggtctccagaacggacccacctgacagcaaaatcttcacacgtcacccccactctcacatgcctgacacatgagaccgttgcccgggccccacgagacatcattaagtgggcacgtggctaactgtcctgcttttgtacacagttgatgaagtagatattttttgggtttcaactgaatcatatcatcatcactaatatgtagctttttgtttctttcatcccacgagctcaggttttaaattggatagatctaccatggaaaggatttaaacccagctttctgttaacagccaatgtagcaccctatcttcagtttataagcataggtgaaaatttaaattttaaaacttaaatttagagctaatttaagtgtcttttatcgtcatttattttacaacatttgcttttaaatcgctataaatgtgttcaaaaaagttttatatataaattaattttaatcgttagtaagctgtttcgattaagcgaaacgatttggctgctattattgttgcctactccctccatccaaaaaaaaatcaatctaggtagggatataacccctcctagtacaataaatctggactaccctttgtacagattcgttgtcctaggatttttgggatggagagaggagtagttatcatataggcaaagataattcgattcgctgtgtactaaactcagatggagaccaaaatctcagcacaactcaacataaaagactaacctgatagataaaatgcgttgtcattgtttatattatttgaccatgatacaaatttcgcatgtactttgacaagtgacaatcaatgtgaaataaataatatatatatatatatatatatatatatatatatatatatatatatatatatatatatatatatatatatatatatatatatatatatatatatatatatatatatatatatatatatatatatatatatatatatatatatatatatatatatatatatatatgttgattgaattattactacggattatctatactccattagggagataaattaaggattttaaaaatatacttaatatataatctaaaacaagtggtctaaaacaatataaaaaattatataaccatttataaaacatattttagaatcatagagcaacaacccacaacaataatctgttaaaatagctgaaaataacctgacctaaacaagtcgtctattttatccccaaaaccttgtaaaggataaataggtaagcagacatgcttggtacaccttgtatgcaagtataatactccgagactttgaatgcttggtagtaacatgtgttacatgttggcatcataagaagtgtacgggtacatgatggagtcgtaatcatagaccattggattaggactttgcagcagcatactagcccatgttggccacacgtatatatgtatgcatgtcatttgtcaaataattttacaaaggtcaatgtatgctctctccgtctcagaataagtttatttttattcatcccatttgtcacaaaatagttcttttttgaaagtaatcgttgcatcagagtttatgagagtaaaaaataagtttattgaggaataattgcattggatttgaaaagataagggtattattggttttctgtgttttcttttgatacatgtatgtagaattagaaaaaataaatttattttgggacggagagcgccgtatcttgtttgttgtgtttttctgatgatgataacgtggcttgcagctgacaaccatgcttgcatgcaacgcatttccaacgcatgtggctctccggtttgtaaagtcgatcgatcgagtgagagagttgatgcacggcaagcagtgagagtgatctgagctctgtttatgtgaaagctacggcttaattttggttggagatagcgaccaaattagccttctccctgtaggctgtatatcatttgttgtgtctgcttaattattgattagtttgggcactaataatatcagctgtgcgacaaaatatcagcgcacggttatattaatgatttatcttctcttcgactatccgaagttggacagttttctttgattaatttcattggcgcagaaagaaattaagggtaggataggaaattttgatactacccttcatctcataatatatggcgttggttagttaaaaaaaattcaggagtaaaagataagaacgatcgaatctacaatactcaataatatctggttttcaacttttactttcgaaaccatttgcttttcagtcctcaacgataaaaatttcacttgatgtggttacgtgacctaaggctaaaatattttcaaagtataaaaaacagtactagtgaaagaattaaattttaattatgatatagaaaattttgacctactaattacgtgcaaataaacttaaattccttttgggctcgaatttagtcgggccaccacagtgatttttgaagtaatctaaaatatttcaaattacgacatggaaaaataactatgtgtcggtatattctcagctcgttttgtagccatattcatcctcttcttttagcaaaagtacgtataggtgataacttcatcggcttgctggagccaatatacttgatgtcattgatgtgctaaataagtgttgtgaggtggttcaaattgcaacaaagacaaagttaggtagttcaaagtgaagctttgataataataagatggctctaagtatataattcactcaaatttaaatttggatgaagctaataagaaaaaaaaaacagaccatgagagggtaacataaatttaaccatcccattagcatgaatacctctgatcaggatgagaaaatcgggataggctcattcatgaccatgtgcagtagtctaatctccccccattaatcaaactgttagatcaaggctaataatataaccgatcttttgactataagattctttatagttttctctcagtctatccatataatagttagctctttacaattaatataaggcctacttgtctctctcacagagtttcttggttcttgtgaccaagccggctgtaagtttacagcccgcttctcctctctcctcttttctctcctccacctcagcatttagccgacttatagcctaccattatactttgctcttaaccgattaattaaaacatcactgtcagctgagcccggccaaatctcgaccaaacgttcaagcgcagaggaaatggcatccccctatcctgggcgaactgaagctgaattttgatggggctttctttgatgaaggcaagaccggtggatggggatttgtagtacgggaccatggtggccactgtgtgctagctggagctgggagaattgagctggtgcatgatgctttgtgtgcagaggctatggcatgtctttatgctctgcgcgccgcagcaaacaacggaatttctcatgtctcagtagaaactgattgctctgtcctagtgcgagctctcaaatcagctgattatgatcaagctacggctggtgtcatcttcaagtaaatcagattgatgtctttggtggactttgtaaaggttgatttgtctttcgcctatcgattttgtaatagttgtgctcatgaactggctcgtcgaggggctaattgggacccgggtcagatgtccatttggactaaccccctcccgtgttttataagatcttttgtggttcgtgattacactgaaccagcgtatcaataaagagcacggtttgagataaaaaaaaaaacatcactgtcagcagcagacggatatcaagaggtgggccccacggggtcgccgtcgttgaccgccgacggggcctccaccgccgtcgttgcggacacgtgtcgggcgatgcggcgcggtaggcaccctagctagccgccccctactacttcactttcagttggaatgcatggggtgccgtgctgctgatcgacctgggccggcggttactgcagttacgttactctctctatgaccacccctcgattccataaaaaaataaatctaagatagtactactccatttatcttaaaatataaatatttttattataaatctagacaactgtgtgtctaaatttatagccaaaaattattatattttgggacgaaggtattataagatatgacatatcctaatattattacttcctccattccaaaatataaagcacaactactattaatctaaagactaagaaaaaattattatcatcttgtagtttggatcgtcctagtaaatgtaatgtatgcatccaataaaattagataatatgaaagtggagtatttaaaaaagtagtaatttaatagagaacatgtcatagttaattacatgcttgtatgcatgtctatattatgaaacatctaacaaaaaaatagttgtgccttatattataaaatggagtgagtataagcttataatagtattaagatgtatcacattttattttttgtttgtttgttttttataatacgaagaaaaataaaaatggttgatatattttctacgagtactgcgaatctagaaatgcttcctatctatttatatactcctatgtcccataaaaagccaatcctaattatgaacctgtattcgttggtatgattagattttttatgggacggagtgtgtacgttcttactccctccatcccataaaaaaccaacctagtactggatgtgacacatcctagtactacgaatctggacatacctctgtccatatttattgtactagaatatgtcacatcgagttctagatttttttcaggacagagggagtatactccatccatcccattttaagtgcaaccatgagttttcgcgtccaactttagtcatccgtcttatttgaaaatttttcgtaattagtatttttgttgttatgagatgataaaacgaatagtactttatgcatgacttatgtttttttagttttttttaaaaaaattttaaataagacggacgattaaaattaggcgtggaaactcatcgctgcacttgaaatgggacggagggagttttttttttacgagacagggtacttcgtaccggtattttctttcaattttctgctgttcagttgagcctcggagaccgtgcagtcagtggagtttccggtatttcagttgtgggagaccggagtagcggacagagtggctgacgtcgcctggcggttgctgttctggaaatcaatgggggcactgtaccttgcgtttcagactcttcgggcgaccgtgactgaatgcgttcggcggctcacgaagaagatttttcttgtttgttacgcgcatgtttttcaaattatttaaatatatgtttctttaaaatattaaaaattatttttaaaagcatattaattcatttttatatttaaaacaattaatacttatttaatcatgcgctaatggtttttctcattttacaaatcttatcttttttctcctctcaaatactcccttaatcatttattactaataatttgttgtccagagaattattagttgtccagagaattgaaataattttaagagtaaattttacaaaacggcatgtaaagactgtttgttttttatcaatgtatcataaaactatatatttaagaaagtgcatcacaaaactacaaatttaagatcatatttttcataaaactacatttttaagatatcatatcaggaaactatagatttaacatcagttttatcacaaaactataacttttgtatccttgatagtgctatggatataaactctacaatctgtggttatttaataactttattactaaaactatagttttgtgatacaatgctttaaatttgtagttttgtgataaatttcgtgctaaatctatagttttgtgatacacattcttaaatctatgattttgtgatagtttgcttgacgtatatgtagttttgtgaaatttactctattttaatttaaattttaagggtttttctagtgtagtttattttccagcataaatttataaccaattttgtccattttttagtatatttttcacggtttatcaactataaatcaaataatcaatcaacatttctatttcttatgatgtaccataaaatactccttagatggtactccacgtggtatattaataatatcaaatcaataatgctccatattgtgtatgctctctaggtctgtatgtcctctctctatctctctgaatcacctcttgttccctcggctcatgcctcataagtcaatactacatgatatgacaaagctgcaaagctttaaatattttttcttctaaattgttattcgattacgatcagatggtgcaattaaacattttaagtattttttcttctaaattattatttgatctacgatccgatggtgcaattaaaccttataataagatcttatatgattatattataaaaaaataaatatgttttaatcgttaaatttgatgtttcatgtgcaagagcgaaatgtatcacacattttattgtgcttcgcatatctttcaactatttcaatgatttaaaatttttgtttcacaacatataacttaatgtttcaccaatggttaactaaaatattttgactgcattaatttgttgatcttatttggcgcccgacgtctagatgccaccatattaaaaacaacggataatactagttcacgaacgctcacttatatgtatacgtagtgtcttaattaagctcgatatataataattatgtattcaatcttgacaattttatactaattcaatcgtggatacccacttgtaggatatattttgtcatttgctctatccgtcctaaaacaattgttttttctaagatttaaaatttatcataaaatagtttgtactaattatcccatcaatcactttccatttaaatttctcccttttgtccccaactatccccatttaattagggacattgtagtcttttctaaaccttaatatatacttaaacactccagaatgacaactgttttacgatgaaagtagtacctactttttttttcgggagaatagctactgtagtccctaaagtttctatgtagaatcagcttagtccttaaccttttaaatagttcaaagaagtccttaaactttgtcataaggcctagaatgggtccaccaaaatcgtcgtatggatatgccatgtcatcattcatgcaaaatctatgatgaattgtccaatttacccttacgtatatcatagaaaaagaaatgtaagggtgaattagacataaccatagggaaaaaaaatacttttccttttttcacctttttgacgtatatttttgctcttatatataccatattttttaactttttcttttgttttttattttcctatgatatatataagggtaaattggacaaatcatatagattttgcataggagggtgatatggtatgtccatgtggcgattttggtgggaccaaggactatatcagcccatgtgacaaatttaaaggacttgtttggacaatatgaaagattaaggactaaaatgacccaggagcaaaattttagggaccatcttcacaattctccctttttttttcatacccctatgttaaaaaaacggaatagcataataagatatgcaaaaatgaagaaaaggaacctaattacattctcacctctcctgcctaacgggaacagacagagcccaagtggtcataagagatcactctcgaatgaaatggaacatccaatcggcattattgattgattttcagttggcacaagaattactcaaaatgagttctgaatgaagaacaaacatcatgaattgaagtagagacccagaattactcgtacaagctgcacgatcgagaccaagagaatctttgtgtcaaacctgtccattggtcagatcgccgtcgcatggactggcagacggacgccttatgatgctaggatttcgctcatcacaacaagaaccttcatttgttgccagatcagatcgaagtcttactctgccaaatgttctgtaaagagattgagatcatcttactttacacagtgaagtcagagaagcacagtgcggtgactttagggtaatctcagccgcccgatttacagcgagcgcacgggatcgatcgctacagcacattacattaacacatgaacaatacttttacacagggacggagctagagaaaagatgagggggttcctgactttctctgtgtaataccggtatgtataattctaaagtgatattgtactaaatagttgtgtacccaatacatataagcatcatatctctaattgatggcaatatataacaagaaaatacatagaaaaattaaaaatatgcgtaccataatgaagaaaccatcttataactagccacttgctgtcatcctactcccctccgttcaatgcaagcaacaaacactaacttaatcaataatcatgggttatggatggtctagcaaaattgaaagaggggaccaacgggacttgacttatcaattggattttgatgctgcggcctacggtggtgaagttggtggcgaacggtgaactgttggccaacgttgggcatggtaggagtaggcgataccggtggccagcggcaggcacggcaagggcactagggcgggccgcactgccgcaggcgtccagggctgatccaggtgataggggcagccgacgtcgccgcgtcgggcacaatcaggggtagatctagacggcgagagactgaaagatgagggacgagtcgcgcgttttgtggaagacggaacgatgccgccctgatttctgggccttctccaaaaacacgtgcgatgagactcctcatctcctctcatctgggccttctccaccaataaaaaatggaataagttcaccggaggtccctcaacttaacagcaagatttttcgaggtcccttaaccacaaaaccagaaatatctacctctaaactcactcaaaccattcaccggaggtccctcggcagtattttcgcccggttttgctgacgtgacatcctagtcagcaaaaaaaattaaaaaaatacgtggggctcacatgtcagctgcacattttttttcttctcttttcttctccttctctcctcttctccttcaggctgagggcggaggcggagcaaccgcgcgccgtggtcgccgtcatcgtcggctctccaccatcgtcgtcgccatgagcgaggctacgcggcgcggccgtccggcggcggagcggaggcagcggagcgcggcggcggagcggaggctgcgggcggagcagccgcgcgccgtggccgccctcgtcgtcggctctccaccgtcgtcgtcgccgtgggcgaggcctagagttacatgcatatatgcattcattcatgaatatatacatatatattcgatcgatcgatcttgtcacattcaacccgtgcagcctgcaaatcaatcacaagctgcttttgctttggtctttttctctctattgcatgcatgtatccctcacttgagaacccatagctagcatgcatgcgttcacgggcttttggcctttcttctctcgcgcgtggagggacgccattgccgccaacaagctcgcgagtgaacctcagccggctctctcgcctctccggcaagaagggcgccaaggccgccctgcccgacgacgacgattacgagccccccgcaccgccgctcccacccggggacggcgacgatgacgaggagcccatcaacctcgtcttcaagggcagagatgaggccggcgagagagggggtggcacgccgcatcggcgaagaggtcgccgccgaccgcctgccgccgctccacagccacacttgcccctccgccgctcgccgaccaagccccccgctccgtcgtaatcgcccgccgccctccgcccaccgttgcttcgcctaccgcgctcgtggaggtcaaccaacacgacgacgacaccggcggtgaagagctagagcatgacgagcgccgccgctccgctgccactctcgcccgctgccctgcccgccgctcccgccgtcccagccgcctctctccccctctcccgccaccgctggcgcgctcgctccacgccgcccaccgccgcgcccgcctcctctcccctctctcgcttcttccccacgcgccgtgcccgcaccgccgcctgtcgccacgccctcatctgcccggccgcctcactgaagaagacgagaaaagaaaatgtgcagctgacatgtgggccccatgtactttttaattttttttttgctgactaagatgccacgtcagtaaaaccgggcaaaaatactgccgagggacctccggtgaacggtttgagggagtttaggggtacacatttctgattttgtggttaagggaccacagaaaatctcgctgttaagttgagggacccctggtgaacttattccataaaaaatctatgggctggccgactgggccttgtcgagtggaagttttgggctagacaatggaggggggttccttggtttgggctagaggggtgcccatgtggtagagatataggggttacaagctatttcgaattttggaccgggttcctgggcaccccctggtcctattgggctccgcccctgcttttacatagtatggttcgttgtttaccactgccgctacagccaataactgcaaatcactgttttgtactgtagcacaagacacaaattactgtgctcctctgcctttagcaccgagaggcagagaagctggatcctctttaaagagcactatattcttacccaaatgtgctggtaatatacataaagtgctaatatttgctaagagaataatatttgttatagttatgctttgtgtattatttatacttttattgattttgtaggagtaaatttaaaaatactttgtacgttcctacttcctccctcatcgtatacgaaaggagggagtatttcactattgactagtgctgttttaagtttgatcgacaatatttttaaattatcaaattttaatgagtgaaattatttaactagttaggaacagatggagtatatgattaatcaaatataggtcaatgtcaatattggagaaaccattcaaatcctatatactccatccatcttataatataaggggttttggagagatgtgac

SEQ ID NO: 4926 - DNA, 9478 bp, Oryza sativa
tgtcacatccccttctaggttgagttttttttagatggaggaagtaaactataagtaaaaaaaacaattgtaattacctggagtatatagcagtgctctatgattggaatgttgcacaagcttaactgccacacttcctcccaaacttgatattaaccacagccaaattaattagggcaagaagctaggtcgcttagataaaaagaatataattttgggatgtggtatgattttcgtcaaggaatttttagggatgtagaaatggagaacgaaccattagttactgacatcacaaatctactagtaactcttataactctatatattaaaagtatgtatcttttttggcagttggtacaccaaaagcaagctttatttgtccatttgggttagtgatgaaatggatgagcaatgaggtagtacatgttctctcaaaaaaaaaaggaaaaaaaatgggaagacataactaagcatttgaaagaagagaaatgacattctttcttttccccttcacatctgcccttcaattctcagaggagaaagatgatagggaaacatcagtcattgtcactgttgcaacctctgatcaccactttgtgatgtagaaatctccactagtgacagctaatgatttgcctctctcagggatacttaatgaggaaatatcaaacacaagagtaaaaactttcactggctggctccaaggtttaaaaaaaaaagagattagtcttgccctctctgtctcaagatgctatttaggctgtgtttaggagtaaggattgggaacccttctctcctgcacataaaacaaagcatgcattagcgcatgattaattgagtgttaactaaaataaactttaaaaaattaatatgatattttaaagcaacttttctataaaaaaaacttttataaaaacacaccgttcagtactttggaaagtatatcaaaaaaaaatgagggaggtgagttaggaaaagagagggaagaatacaaccttaggaccactttgaaacaccgttcagaaaaccgccacaaatattttataaaaaagtttaagcactccaaaaagcgaaatatggataccagaatttgaaccatatcatcatcgaaaaaggataataccagattatgctaccagagtcctggtgactgtgaaaggtcactgcctcactggtgtcaacatccgttgtcgtgttaggtcaaactcgaaggagcctctgtgctccttgcaaacattgtgagtttttactggacatccgccaatcatccacttgcaaacatttgagcttttataatgcttctattttatatccctccaaaaattcatcacccaagtagattaaggtttagagttacttttggtaagttcatctcatcacaaaaacacttgtatgcaaacataatcttgctctgactccgagtgagatattgtacttccgtggtcagtaaaaactcaaaactggggcacacgcttgcattagaatatgacaaaagttaggctgatcatatcacatcaaaatatgaacttaataaacacgagcaggtaagaggccatcaggctcaagctcaactcacattcagaataacacaagccattttcatgagcaagtatttgcaagaatgtaacaattctcagataaatgaacagatgtttacacacgaaaacaaaataatcacatgttactgagattttacagtgttggcactctgctgtacatacttctcgttccctcatgcccattagaaaaaaaaataaaaaaggacacaccagggtagattaatacaaaactgcaagcctcaaaaccaaacctgtgtgaccctcgaaccagtactgaacgcttggtaaaatgggagatggtaagagggcacacctatgaatcgaaagaataagccgaaactagcaaaggcaaactcagactaaggaaaaatggaggactcatcccacacaatgtgaaaatagacacattgcacaacgaccatggctgccaagggctattcaggcatatacaagttgacttgtacgatcaaacagtgctttagctggaggttgaatgaggaaattttaagcatgattcaagctaaaaaagttggagagcgatcttcattctattttgcttccactttggaagcttgctgaatgcttcctttgtcattccaaacttgtctttgaattcagccgaagataagtaggtctgcatttagttcaaaatggggtatgtggtcattacctggtctgaggataagtaatacgaagtagctaagtatcgaaaagatcatatattcacctctcgcctggtaacgtcaatttcagtgacaggatcagcagctgtagttatcaggcgatcatatgggtatactgggagcccctcgtcatcttctggttcattttcttttacatcttcattaatagtgagagattcaactctactggtcatggtgttaatgccttcttttgcatcttcctcttgctttggcttctccaactcagatccatcttaatttgtacagaattttacaaacaacaagaaatcattaacccttcctctgtttaaaggcaattttatgttccaagataagtgtatcacataccttttactgatttagggcgatcaaaagaaccagtgagagaagcagttgcagatgacttagacggtgcacttgatgagtcaggtgtggcagattttgggtaaagttttttaactacgggtggaggggtggaaagatttctgctgtttgcactttcaaagttagcagccaatgcagtgaatgccggagatcttcccctaacacggacacgttcagggctgaaagacatactcctcgagcgctgagatttgtcttgtacagtgcttctccctgaatatgttggtgttcgtcgctttggtttctggtaacaagttagaaagattgtaaatgcaaaggttccacatccacagataggtctgctaactacagaaaaacacttacagaccacagacttacaactagaaatgttataaataggtggttccatgattgtacacacaaaagataaacagaacactgttgtctagcagaaaacgagtttgcaacaaagaataccatatatggttatttcgacatggcagactatcataagacaactaaagtttgtacatatcttacatccaaagcaggagaacctccaccctttacaatggaaagcttcctctggtatgaattgccatgcatctacaagagaaacaagagtgagtacaacacattgaagatgaaaacaaggagcattatggtgcttctgccaaaaggaacacaaactacagttgttcatcttatgaatattctacttacaagtgactttgctgagtcccaagtgaagaaccttgtgaaaaatgtaggctcacttccttccatgataacaaaaattggtgtgtcgctggatagattttccatcaggaaatcaagcttaacgaatttctgatgcagtattaaaaataatagtcagtgaccaaaagaaaaggagatgccacctaaagtgcttcagcatggaaaaacaaatcattacctcaccaatgtccagagcttgtaatcgcactttgacatctacctgctggccaacccaaacaaatatatctgagtgacagtccagaatgaatacatcttctgtcatcagatcatcttgagtgaagtggtatatttctttgatctgctcaaatagatttcacagctcagtcagtgttaaatgcaaaaacagagaatatgtgcagacctgtatatgtcacaattttactttattacctttaaattgccttcatggaccccaataggtgttgttggcagaatagaagagcagatatatatcagaaaactcgaagagcaatgtgaactgaataaattataatagaatggtcaattcatggttacctttgggtaggatacatgagaaaagatggggatcactttcatttgcccttcctatcttttgacttggatactcagatttgcctccaagtaagctccaaaattgatctgtttctgacccttctttctgcgatctggactgcgaatttggctgtgatgaagaaagcaaagcacgaacaattctattgtcactacttgatagatatcataagcaagaaggaacacaagtatgcggtacacaacaaatttcaaataataagacttgcaagtattcctagtaagggaatagaaaactgctgggaaccagcctgcactagaaattctcaattctgtcattctgggattgggctaagtggagccaaatcatcccaagtttcagttagttatgcaaaacaaagttccaggttatgcacaacagaagacccaggttaatgcaaacaaagagagctaggagaagatgtccgtcaagtcactagtgcttgggatatgagctgtggtctggctatgctctcagtctttgtctacctggtgtcccttgtaggtgctctaggtgttgcgcgtgtcagtctgatctgtctagtttccaggatgctgcatttcctgtctttgttttgttcttttgagctgggctgtgctaagtctgatctatctagttttagtttttaagccgggtgtgtgcgcctcatgcctcatgggaagtttcattaaaccgggtgtaaaagcctttcctctaaaagaagttgcacttggtctgatatataagaaagtctatactcggttcctcaattcttcattggtttaattttcattcctcaatgcaataccaaacggaatccatcccccaactatcaaaaccatgcaaataatatccctatgattgttttgcaagtgattttgagtgtggtggcttgccacatcatccttttttaccatgtcatctgccacgtcctgtgtgttagtcctttctcttcctttttaatagaaaacaaataatgaaaaagaagatgcaaataatatgcctagtagatggatgatctaacaggttcctttgttttatcatttcccctgacatcttcatagtgtactgtggtaaacctttgcagggagtaattactcaagatgttaatgcaatatttgttttccaaaataacaataggaattgatcaagtacaacttcaaaagtgtgtatgccttatcaaggaggattgttccataccttaattatgtctagctgcctctcaactacctcttgatctaatgacgtagtaaggtttccagtccaagtgaatacagtatttccatcatgtaggatgtacgaataggatgaattcaaagacgatgccgcctaatgaaagagcatgatcaagttaccttggaagcaatataatctaattccaaaaggagttcaaacatatctttaggaatgaaaatgtgagaacttacagcatcaacttgaattgcctgcatgttttctggtcctgaaccttgaattcggaagagcgcaagtccatcttccaaataagtgtcatcatcaataccattttcagcaataaatttcttgtatccagagcttagaccaccctataatgaaaaagggaaagaaactaagaattggatgttgtgttcaacctgagctaacagtattttatagaagggaaccttaaacacttggaagctttgaaatatgacgaagaattgaattggttcttttccctcatatagtcgtgtctgcatgtaaccaagaacaattagatacacaaggaagtcatgtctggttcactaatgaaatatggagaaactagtaggttacctggacagcctgaaatttcgcagactcaaccatcttgcttgcaagtgaaatagcagttaccctatcctcctgaatccaaattgaaatattttttaacacctacattttctagtatgcactaacagaacatgtaacaaccgcatgctgttatccaaaatgccacttcttaacagaaacagatagatcattgtggcttccagttcataaatcaaaaggatggaaaacagaagcatatgctgtccatagaaccttctaagttctttcttcattgtcctaaagtccggacttcattgataacttaattaaaaactaattgtgagctataaggtggaaactctaaatacaatcttataactatgaacatgaaatcaaagataaattttacctcaatgctcttcttcccaaaccaacttccaataagacactcctccttgtcatctccagggtacatatattgaaatatgtagcaatcgccagtgtaaaattttgattggtcagcagatggcagaagtatcttgtccttatcatttatgcgccagacctgataacagatatagaaaaaagaaaaatgtgtggacattttagctctcagagacccagaaattgaacatatagagcagaaataaaatcttgacaggaaaacattcttgtaaaaattaaaaaatttaggagacaataaacataagataatataaaaggccaaaatattcaagtgatactaaagatctgaaaatttttcaggcaaatgagatgatgttaaaaacactattgttgagaattgacaagtcagatagtgcagaaacacacctgcaaactgccagtgcaatcaatgtaagcttggggttcttcttttgcaggagcagctttcatcaggcccttaacatttaagccctggcgtttcagaagagcttcgagaaaattaatagaaaaaaggtcagaacattttatcaatggaaaagaaacagtgaattgacaagattgcatataataacctgcaacttttcctcttccatcctcagatgacaatttcaagtcaggtgtctgtggccactctttaaattttgacttgaacataactgtctcaaacccctcaattactttgattacatgtgtttttgttcggttatcatcagagagcaatttctgcatacacaaacaaacattaagtatgacggcaaaatagttcaagatccagaattaatttgagatatattagatgtataaaattatgtgatatatttctccagaaaaagtttatgttcttttctgggtgatctggactaagtaaccaaatttctaaaattcagcagaattattggctcatcatttcatcaatgccacaatgaaaatgcaagcatgttggaaaattctggtttcattcctccaagctttcaagcttatgtgattactggaaaaaatgcccgtgcattgcaacggaagaaaacatgagaaatttaagaaaaggttaagaaaaatttacattatgtaattaattaaaatataaaatcacaactatacatgtatacgatgttgaagaaaagaaaggctcgtaaaaatcaaggtaaatgtggaaaaataaaattttccaaataaactatggctggatttattttttattaaattctccatgattaattacactatgtgaaatttttccgatattttcagagcaccattgctaattttaataatacaaacatcattttagcatttatttaaatggaaatctaaatgaaaaccctcctttctccctgggccattttgagcccattctttctttagcccgtagctgagccggcccattaacctcacttctcctcccttccacctcggcctgcaagcgcgcatccagcccatcaagcaaccacaaagtctaatcagcatcccttctcctcctctcactgtcgcgtgggtcccagtgctacagggtcgtcccctacctccgtccgactccgcagcttcccaacaccgccggaaaccgccccctccatgaaatccgttcgcatccacggagataatccaaaattgattgaggggttttgatccttatctctttctctttccctttttccaagaattagagcaaaatcgcatcatatcgacctcggaatcaagccatatagcaaaccacctagagttgtccgtttcgcgtacggggagagaatcggactggcgcctccagggacgacgtaccaaaaaagttggcaaaaacatcttaaacttttataataggtaaagataaagatatttctgtttcacaagaatgtgatgacattacataagtatttcttgaaagaagaacatgttacctcagcagcttcactggcactcttcctctcctgcaaagatgtggttctgcccatccaaacaaataattcgacaccacaatctaacaagtaacacttatttgtcttgagcaactcgtgcaataaggattcataattgataggctccaactttccttggttaaaactgaaaagatgcatttcataaatattgactgacctcaagtgaaaattgttgtcttcaacaaatgaacacagggtttgtatataaatagcacatttccaattaattaccagagcaatttgaaaacagtttcttcatatttctcattatcttctacaggggctctccttggtagaggggcaaagccaccaaaaaaaccccaaaattcaccagcttcagcatcggccatcaacctgccatcctctatgaaaaaagtacaatcaaacatatgcggaaaatatcattgttccagtactatgaacacacaaggacctgaaatagaataacttaccaacagctgcaacttcacacttgccctcgtgaaatgtatctttgatgtactgcacgacttcaagagcctttgcacgctcttgaatagacgaattggagccattgaactggaaaattttggacttcgtgtccagaataaatatgtcatcatgattcagggacgatcgagcaaaaggaacctagtaattgaatagaaagtctgatcaagacatgaatagaaagcccctttctgaagaagaaaacagttatctagatagcttgcctctttgacatgaacaacacgattccctgtacagacatacagacgggtttcgtgctcctgctcattgacctcaacatgcttgaacccagatgccactcctcctggctgtggcatgatgcatggtctaaaatatgagaggaacttatctgtttcattgccttgtatctctcggtattgaacagcgcgtccaccaagtgcagcatcaagctcaactgttaaaattgctgcagttccagattcatcctaccatgcatagaattggtttcaacaaacttttgaagaactgaaagtctgcatcatctaattatgagaattttacctgactagtatctttgccaatccagtaatgaatgtcatgtcgaagagaaccatttttcaaggcagttgtctaggaagaaaaaaagagcacgatgaaacattattacattgattgagaattatgcagcaaagcatttccctttttccatgagaattagatgcaaaacagtaaatttcagaagatagtttatgtcataatatggtaataagagatttagagctgtggtgtcagagaaaatttaagaaactatttcagtttcctaaaaccatgagagaacagtacatatgaatgaaactgtcatattgcagtaacatgggggcaaacacttgggagctttttatgaggcttgctagatactccctccgtcccataatataagggattttgagt

SEQ ID NO: 4927 - DNA, 14962 bp, Oryza sativa
  unsure (1)..(14962): unsure at all n locations
caaaaactgaaaatcccttatattgtgggacggagggagtaccatgaaaatgctaaacaattttgccatgtaaaacaggcgaacatttatatggttgagcaagctatagaataagcataaatttatactctataactgaacatggatagactattttaggcaaaagactaatgatatgaataagaggacaaaagagaggatgatatatggattatgagttatgacaccatataatatgtacttggataccttcaagatgatgtaagaatcacccatgaaaaattttccatatgaagacgcaggaataggaactggcttgaagttctcgatgcgccatatttccaagcctctgtagtgtattaaggataatcgtggctttgtacattgattggactaggaccaataaaatagtgaactgaacagattgtcaattgtaaatactcaaaaaagatcaagagtttaatgaatatttaaagaaaaaaaggcttctgctaaatcactacagaccctgtgatcattgttatctcattaacttctactctgctaatgctaatgtctagcatattgtcaagaagcttgcacctgtcaggatacttcatatgtgtgcacagtagcattgcaaattcatgatcatctagcaaacaaatgcattttacttgttttagcagaagtgtacaattaaattatcttcttaggaccaattaattcaacatggtagatagtgttcactcaacttatggacaaaaaacaactaaaccacaaattcagagtttcaacatgcacaaagaagttttcctggttgacttaagtaatgttatcttgcaaattaagtgacttcaatcaaggtgaagataatgaaagcaatagaggaaagtacactaaggtgaaattaaaaaaaaggatactccttttgcccagcaccacgaaaagctggatccaaatccttcatagaaaccgacatccttgatgttaaagaaacctctcaattcttctctttcacaggagagctaatagtatgctgtaaacaggggtagaaaaggtgggcagtaattaattagcaaacgaaaatgcacttggttttccttttttacgaaaattaaactagatagttcagttgttaagaaacacgaccgaagacatgccaagtattaggtattctggttatataaagaaagtcagctttgatgatacaatgtctactaacattaaagtaaggatgaaccaaaacaggcatactatcatatcactaatggtgactacatgccccatatagaatgtgaaaaatatgcagtacgccatttccgcatcgaaatacacactccaatgtattgtagaagtctgactagcacatttgcatttcacaaccaacatgaccatgggacatgaccctaagttccccaaacaatgactagaactgtcaaagcaatgcagcaagctaagaagtttgcgcttcctaagggttatgtctacacaattgaacaatgatccaattccaaatggttaagcaggcaccgagaggcacgaatctggatcaatcaatcaaatgagcactcccagtctcccaaccactaggcgccgcccgccgcgcgaggctggacagaacacagctcactgaagcatcaccaccccccaaaccattcctcccctcatagcaaccaagcttaaaacctcacgcgattagcccccacccaacccggctccatacctcccaaataaccagcaaatgcgaagcttcccgnncgaactccaccccaccccccaccccctcgtgaaccccgtctcctcataccctaaccagggccgcctccccccctccggtcacctccggatacctccacgcgcatgccgccgcgataagcggcgagtccaccattagtccaccaaagctcaagcaaactatctccaaaaaaaaacaaaaaaaaaaagcaagcggcggaagatcgagagcaccgacctgggagggaggcggcggagatcggagcggggaattcgcgcgggcgaggtgggggggggaatcgatctggagcggcgagaggggaggtggagtagaggaggaagaggaagaggaagaggaaggctcgagagagaaaggaaagggaaaaagaggcaaagcgggcagacagaacagaagcgagagagagcgcaccttttgttttgcgcgttttatgctttggtccctctgattgtccctatttttgttccggtgaatccacgagtttgaggatctggatgttagatgtagctgtacctcgtgacttgtgtggcaagaggtcggtgggttttttatgctttcggactttcggtcttaaaaaataataataaataaatctaaacctaattatgtgagatcacctaattatatgtataattttttacgaatagagtattccttcgtaaaaaaaataaattagaattggaggtgaagtatgctaatattcattgtattagaatacatcacatctaattttaggtttgcttttagagacaaagttattcattatggtactgagatacgtcacatataattccaggtttttatagagaaagtatttatgttagacttttagtctatttttttatgtttatcgaatttgtagtgtggtacctcatattctagctaagtctataatttatgaagctgatgctatatggactgtaaataatatttagtagggcctctattatatcccctaagatagaaaggcatcaaaattacccttgactacagcccctattcttgaggctctatgccacagtccctatacactattcattagcgcagaaagacatttttcctcacctatttgttccctctcctccctaccatgcaccgtacctccgccatgctgccgccccaccgtccaacatcctcactattgccccttcacccctctttcgtcgatgcatgctagaagaatagatcgatggttcattgtcatccccaatcttcgttgtccttatcttcaagctccctagatgttgtgttgcaaccaggttccacattagccttcgagctcctccgtcctagtccgccgcaactcttttatttgtcccctatgacatcctctaccgacgccatgttgttgcttggatagacttcaaataactatgaactatgtggtgtcttaaacatttgctactcgtattttgtcattccatatttaaaagttttaaatttaaatttgagttgtggtctttgaaattgtgaatttgtatatgatcagattatatgcattagaaatatttatgttcaattattctatgttaactaataatagtaacataaagtgtatgttgatatagaagagaagaaaattgggggcttgaaaatggagacatcctagaaatgaatgctccgttggagttggaggtattttttaagtagttacttcctaggaaatatggatatcccgtaattgatttttagggctctataatgggggcttcgatcattgccaaaattttcttaccaaattaaagcattttgatatttaattaagacaatttatttggtgctatcaatttttaaaagcaaacaaattgatcaaatgatttattttctcctaatttcttctataaaaatattccctccatcccatcccaaaataaattgatttatattttttttaaatgatctattttgtttaaatgtttttatgtttttttattttattctataaatgatttaattaataagtttctataaaacctcatgcatttatttataaccagtaattagacacatagtacatgaatgatgacatactcaagagaatgagtttaacaagtgaaatttggataacttggagagtagcacacataagtaagttaattctacatcatgcctatcaacttgtgtatagagaaagttctatctcctacctattcatccatcaatactatttttctattacgagtgataatttcatattttctcttcaccattgtatgctcccttcgatgttaggaatgttcttattttgggatataattaatattgtattaaagagcaataaccagttgccctactttggatccaagcatgagccttttgtccatttccgtcatggctagtatagcattatattggaaattattgtcaatcttttgttgaaaacacttgaactcttcgatagccgtagggcctcctcaccttatatagcaaattacagtctatttttacaagttatgattatacgtctatttatctcaaatattttcaccatttactgttcatctaatttgtatacacatcgtttttatttaagaaatcattgacttgatgattggagaaaaagaatcatgagatcaaaagcaaaattatctctaaagcgaaggcactgaaagcaattttggaacaataccaaatcggtggttattggctaacttgctcagagaagttggaggatctaggttcaattttgtgcagagataaagggggtatctgaaaagcaaagctggaacggtacacggcagcaagggtggcaaatgatggactggagcgtgcgtgccactaagcaacacctacaatacagaacacacttatcttttctatcagaatatttttcaaaactgctctaaattgcaaagttaatagtatattcatcacataagtattaaactagacattttcttctttttatatattgcacatatgtgcacacgccacaacttatagtcaacattatatttcacagcatctgctgagttaactaagacttattaattctatctttccaatctagatatttttcaaaactgttttaaatcagaaatccagtcatatattaaaatgttttaaatacaaaatcggttttctcatgtttgcacacgccatggttcaagaatcaagagtcaaaacttcacggaatctgatgagttgattattaagatgtattgattttttatctatgagactatgacaggtgactttggagaattggagtacatttttaattaatttgggaatttcatttgcatttgatattcggaggatatttggggcggtgtcctgtgtctcctcattaatagtctgacctcatagagatgtaatatatatactccatgagggaaatgatagtacttaggccagtgttaatttatcatgtgctactcatgcagctgagaaagtaccacacttattagtagcactatgtactccacaagtccattgattttggaggccctgtggtacttagtttcattggaaaggaagttgggcaaatgcaaagatgcattgatcatcatttgctaatcgatcacctgttttaccagtcatatgggaccagatgacagtagggacatatatagggggacataggaaattggtttctgggttggcactttggcagatccccattctttgttctgttttgggtcctacctccacatttggttattgctttggtatgatatgaagttgatagtttgctttttcttcattacttggaaaatgtaataagtcaaaagatcgatggtcatgaatggcgatattttatatttgatctgataatatagataaggatcttttgcttctctttattagcttacgggtgtgtttgatagtagcggttgtgaacctttcctcattgcacgaaaaacagagtgatagattagcatatactcactccgtttcacaatgtaagtcattctagcatttcccatattcatattaatgttaataaatctagatagatatatatgtctagattcattaacatcaatatgaatgtggaaaatgctagaatgacttacattgtgaaatggagagagtaacaaattaaatattagctaaaaattgaaaaataaattaatataaattttaaagaaactttcctatatatctttttaataaaaaacatatcgtttagcagttcgggaagctatgaaaaaaacaaagacagtataagttcggaagaggtagtatagaacatgcaagtctattgataaattgatcggtgcatgcaacctagcaaattagggaaatatagtcacccttcttcttcacttgcttaaacttttaggtaaaccgactaatgtaatgtaagtgactttaatgttttggattacttaaagggcgatgaagttgcgcatgagtctaacaccccgcgggagcctggattgtcaagggctccttccttttgatattttgaggggttgttgagttctctacccaaatttgcccttcctaataagaaggtagtgctaatatgaccctcggcccttgatccatttaatcggtcaaaaaataaatttcacaaaacctagtatatttgtttcaagtagtacaaaactaaatgtttggaatattgcgtatcattaataaaaaacatttttttccagacgtaccaaaaatggtttttgcatgtggaactctagcctgtctatccgaaaggatatgcaaaaatcgctcttttttcatgtgggtgctttatgtcgtccgcacgcaaaaataaaaatccaaataataataaaaaaactagctccaccgtcagatcctcccgccgccgcccgcggatctggtcgtcatgggcccggtggaggcggatccgcccgtcaccgccggccgcgcccaccgcctgccgccatccatcgtcggccgcgccgcccaccgccggccgtgagagaagagtgagagaggagcgccgctcgcgacagaggagtggagagaagaaaaagaggcgagagagtttagtggaaaggaggtaagagagatgaatggataagaatgaaaaattttgaaatgttaagagggaaatgaggaggtaactcggactttaggtgattacttaagaggtccgtctgcgaaaatatattttcgtgtgtggcccattaagaggtccgcctgcaaaaataagcttatttttgcgtgcggacccttaagagacccgcttgcgaaaattgatttttccgcaaggtcctcttaagaagccgtatacgaaaatagaggacgatttttgtagatgcgactagttatggtccgtctgcaatctaaagagggtctcgtccaaaaaattcatttctgtagcagtgtataaccacatatattagtattatggttatatagtttgtcaaacattttcttaacctattgtacatttgaattctatacttatattcaaaatttgagttcgttcaatccatcgccaaaatattggagtatagccatgtaagtaaaatattttttcttatgctacaatatcgagtaaaactagttaatggtgcggttttttgaaaccttaagaccataataactgcagttatatatgtgacatgtccaaactaacaaggttcttttacaactcaagccataataatataatacatacatgtgaatctataaaatttactcaaaagaatttattgccaaaaaattggctaacaaactgtcaatttgagtctaagcatacctcctatacatgagtttgtgcctttcggtatatggaaataccatatagccaatagtatacgtgaatgtatccttttattaagaaaatacgatgaatagagaaggaaattatcttcctaaaataggaggcgttagagttatagtcgggaagataatgcctccttagtccgtatcatattctatctctccgaattcttcttggagaggaagatgatgttcgatataatacaagaccctagaaggagagggaacataccaacaaaatacaagccaatacagataagagctatgaaggctgacatgagggattagagctacctgcaatctcgatgagttcatattcaaagacgaatactacactagctgtcgactacgtgtgagagctacatgatgtcaaaccgacaaaaaaaactagattaggtgatcccaaatattatactcatgtgatactgaaggtagactagattaggtcatcctaaatactgtactcatgtgataccgaggctattacctgtcagttaaggggcccgaacctatataaaattctgtctcctatctctttttaccgtaatctcgcatataccttggttacaacgacagccatactataaatacagtaggcgagtataacccgtcaatacaaaccccactaattaaaacgcaaacatttctatttcttttgaactccgcacgtctcaatttttttggagaggaaaagaactttccattaacttaaggactcagcaaaatcgctggccaccaagtcctccatgcccggaggcatactgtcccatggttcaacggtattccgaggacatttacaacccaaagctgctaaagcatgcgctactctattacatttttgtggtgcaaaaacaaagaaacaggaaaggaaactacttccaatcagctatttcgttgaatatagtattttaccaaaatttttgggaacaacatattgtaccaatttcgttgaatatagtattttaccaaaattcgtcaaaatctgtatagacctgtacgggcaataaaccaaagaaatcctttttccaaaggaaaaagtacaccgaaggtccctcaacttgtcatcgagttacaaaatcgtcccctaatcacaaaaccggatacaacgcatcccctaacttacaaaaccagtgcaaactagatccctcggtggttttgactccggttttaaccgacatgatagctgacttagcgtgggacccacgtgagccccacatgtcagcgtggccacctcagcctcctctcttccccctattctctcccttcctcctctgtccctctctctcacttcgccgaacaacggaccgatgccggcggcggtccagagcagcagtcgtgcctccgcacccaccaccgcggtggcgcccgcttctaccttcgcgcccaccgccgtggcggtcgagcggtccacgtggtggtgcgacgttgagcggcccgggacagcggcgtggcgccggtggcggtcgagcggcctgggctgccaccatcgtcgtccgtatgcaaccaatcgcaaatctggggatgaatctattgatgggagagggagacgacgaggcacgttgctgcatcaagacagagacaaggagcaccggtcaccaaggacatcgggctagcagtaggcggtggtgcatcgtgtgtgtcttttcatcactgaagtcttgtggagatgaagagttgaatacacagaagataagcgtgcgctgtggggcagcaaggacggcgtgcagctgccaccgactttcgcccccacaacgcttgtcacgctgcctcggccggcctccgccgccgctgaccgtgcgctgtaccctataggtagcctctccatgccgtccgggtcgaggtgcaccgccgccgcgtgagagccctccccatctctccttttctcgagctcggctcgccggacccgtgttgtcatcgtcgctgtcgctgtccgcttccacccaccaaacgcgtccctctccttcgacggtgggcacgtcgtgcgcgcatgcggggtgggaggaacggcgtgacaagacggacggcaaagagtatatgggcacggcggacgcgggcggctgccgatgagggaggagatgccaccggcggcggcggcggcggcgactctccgctggctagcgtccagcccgcggtgacaacgacggccgcacgccgcactcccccacacaccccgcgcgcggcgcccgacgcctccgacatgccgccgcccacgaccgcgaaccacccgtagcaacccggccctcagcccctcgtccgcctccttcgccgacgacgacgccgcccgacgcacacgcggtcgagactgcctgctagcccctgcccggttttgcagttttcaccaactcgccgggagctcgcttcggaggatgaagacgacgccgacgccgcacgcgaacgaaagcgaggtcgcagcccgcctcgctcgcctgctccgcggttctcctgcgcatgcggcgaacagctccgcggtcggggcacccgccgagtccatcgccgccgcgtggccccttctcccgtgtcgccgcgccgccgtgtcgccccttctcccgcgtccccgcgtcacctatcgccggcgccgcccagctcctcccccgctggcgccgcccagtttttacgcaccagccatccgccgcgccagccgaaccgtacccagctggccagctgctttcgtgggaggagagagaggaagagaggtggagatgggaggggaagtagaggctgacacgtgggacccatgtgggtcccatgctgagtcagctgctacgtcagttaaaaccggagtcaaaaccgtcgagggatctagttttcactggttttataagttagaggaggtattatatccggttttacggttcggagacgattttgtaactcgatgacaagctgagggaccttcggtgtactttttccttttccaaattgtaacgggccgagtgggccggaaatggcatgaacgccaacttaacgcatttccattttcgaaagaaaaaaaaaaccacacgaattcccaatttcaaacgccgatctctccgtctcgccggacaccgcaaccacccacccacccactctaccacccatggaccacgccggcgaccacctcgacccggcggggccgccggtcgggcccgtcttctcgtccgacggcgtcgccgaggtcaacgcgtggttggccttcctcccggcggaagccggaagggccgggggaggcggggtccgggctccgggagggcgcggcggcattgtcggcgtcggcggtggtggggcggcaccggagctctcgctggggcccgagcccacgccgcgcggggtggcctacctccgcgcgctggcggccgcgtcgcaggcgaggtcccgcgcggcggggatcgcggccgcggggctgcgcgcgcaggccgcggagtaccgcgccgaggcggcgcgcctgcgggaggcgctggagcgggcagggctcgcgcgggacgcgctctcgccgcccgcggccgtgtccgcgcgcgccgtggccgccgtcgccaacctcctcgccatccgcgacacggagatgagcaggtggagggggctagggttctcagtttttcttcttcttcttctgcgtgcttaattctcgaatgaataagactatttgttctgccattcgcattgccagtgagagatatgaacatctaacaagtcgatctgtttagcatatgcggttttatcctcggcattgggtgaacttcgatgaagttgtaattccagtaggcagttctgttatgcgtaatgctgttagtttagtaggccaaatagcaggaacatgtaatatgtctggagcacatgctagtttagctttcatgtttggttctaatgcagacaaaaacttagtttgggatgcattattgcaacaagaaacaaacaatttgatggtggagaacagtaatgttaggcttcatactttcatagtgagtgttctggtgattctttccttttgttttcattgttctctgattactttgaaatggtggttgtgcagctttgttgtggccagtgcggacctgtcgctgaggagagcagaggtggaggagaagagggacaaggtgcataaggaatcaaaggcgcttcttgattacacaaggaaggccatcaccaagcttactgagctcaagaagtgagtggaaaactattcactttcagtatacttaaggagatttgtgcaaccacttatatctcttgaggaaaatataatgaacaatgtatcatttgaaggatgctggaaaaatttaaaaatgatgtggagaagcaacaagcagaacagatgacggattggcagacaaagttggttatgatggactcaaaggaacgccaatatatactccaagtctccaattataaggtgactagtttttcttcttttgcaagtggtgtaatcagtatatggttttagttcttcttttgacctgatagttttggccgactaccactaaacaaagcagtttctgttgctgaagcagcatatggtgtttgctagagattgtcaactgttagaacttagaagtatatagtcagttatcatttatcaatacttgtgcttgtgagtttagcaggatgctgcaggacatgacatactattatcaagctaaccgtacaactttgaaatcatttcaatccacatatttcctgaatcttgacctgaagaggctgttgatcagatgcttatctgcgcttttatgcactctctgctctatctttgattggttttgtaagatagggcaataactgtatatagcttgtgtgtgttttgggggtagctgtgaaattgttcaatgttgaaataatgatgtatctaactaataggtagaatttggtttgaacatgcatttccatcacttgtttctgctgatgttaccgtttgctagtgacgaagttagtcatatgatgagttgaatagtttcacatcatgatctgatgttgatagtacaaacatgtgttacttctaattttaagggcttatgtgatattatactattcttgttattcttaccttaacagcttggctatctagagctatccatcccccttttagtccgattgcatgtatgccgcaacacactgttctttgatttggtaatatacaatgacacattttagattcactctccttttctatctgttaggcaatgctcaaccgagtgggatatacaccgaagatcaatcatggtgtgctgatggaaatgacagagcataagaaggatctagagagaaagactaaacccattgcagacacattgagaagctaccaggacttgccaccagtatgccttttgctttctgttttgttccttttcttcagacataaatctttacttattcttggtattttttgtgactgtcatcaggacaaagctctagcagctctagctatagaggacaaaaaaagacagtatgcggcggcagagaagtatctggaagatgtgttacagtctgcattaaccacacctggcctatcatgtgtgtgtgtgtgtgtgtgtgtgtgtgtgtgtgtgtgtgtgtgttattaagtttgtaatactatttggtctgacatgccattgattgatagtgctatgcagtaatggccattgatttcttgtaagttgtaacttgattctatgatcctgtaaaatgcatgttctactgtttacctaaccacagcatatttcaccacacaaacttatttctgttgcagctactgagctaccatgtcatcgacaaccaggatgcctctgaacatcttggcctgtttgctgtatatcattttgcattgatgtctatgtgattatggatagtcatgatgattcatgggatcaattgatgctatatgctagtagattaggtaaatgtgatcatatgccatatgaacatgccatttgtctttcatctgtccttgcatctttcatagagttaaccagatttgttggctttattccaattgaattcttatgctcatattaaatgttagtactttctgcgatttctattagatgtttagcgcttcttttttccccaaataccataacaaaatgtgttctgctacaacttccagaatatttctttcaggtgaattcaggtattatttgttctctcatcttccattggctaatgatatagcttaatttgggctctttaccaagttattaaactagatattgagctgattgccgaatcaggttggttctcttgagctgcaaataaaatgagggagtaatgaagactacctatattcctgagcaaattttggactttggagacatcctgaatggtggttccatacttccaagaaataggtgggtgactttatcctgaaattgatgtgctttcacactatctgtaatactagaataattatatccatttttcttgatgcctgattattttatttctataggaattgtgtttgcactgtattttgtattcctttctagatctgccttgcctgtcgacaatacaacaatatcttattagcatgttttttattgttggagctagatgacaccatgacaaagtgagaacatctttaggaaatgttctacatgaagaaatcctatagtattaaatattcattgccaattgtgctttctagttatgttgataaatatgtaattatcttgtctatctcttcattaaaaagtgaatgctgtcttgctaacttgctatatatatattgaatcgaaagctctgttgtctgttgctatgttttctggtagacccaatagctaaaggcaattccatacagaatattcaaaattagaacactcaggtagaagctgacataaagaagctggagttgttatcaagtggacttgtgcttcccacttcccagtaggatctaaatattgcaataataatatttttcagaaattgttctttgtttgaatagatgttcttaagccctgactctgaaactcttttcagtcggcctgtaaattgggaacaatgatctgtccttcaaatgtgccttcgcctgattagcacaactggctcatgaacattaaacttggcactcggcagccatttagtgtaacatgctaacacattacaaaaaccatatttggctatagctgataggacactgcaaatctgcaatattgtgacaatttaccttgggtcactattcattataatcgcatcatttccagctgaggaagtgaatatctccctgagctctgattgaacaccatcaaaatatcatttggtttggactgaatggtggtgtggttgacctccccagttttataaatgtattgcctatattttgtattgcagtccctagcatattgtgctttgaaggcctggatgcatgattcccctggttttactctgcatagaaatgagaagtcctggttgcaaagctgtttccagtgctgcctcttagtgaaagaaggaatgctgattcccctcttgcatacaaccttacaattgaaggtcagtattacttttttttttttgctgatatgagcacaaaataggtggcttaaatttcttccattttagtgacttgcttcatatcttagcatggaa

SEQ ID NO: 4928 - DNA, 1123 bp, Oryza sativa
tatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatggga

SEQ ID NO: 4929 - DNA, 1137 bp, Oryza sativa
gcttcggaagatccgctcttcgtggaagttgaagccggcgtttgggaaagcgagcaaggcaagtcacgtcacccttgagcatattgaatcccagtttataaaattattttgatttaaattattgcattatcgctttgtttaaattcccgcgttatcactgttttatttagccatgcctatttacctttgttatgaccttattattattgttattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaac

SEQ ID NO: 4930 - DNA, 717 bp, Oryza sativa
gtcagaagttcagaacttcatcagatagtactgtcagaaatccccatcgtcagagagttcggagacgtgtttccggaagaactacccggtatgccgcccaaccgggagattgagttccggatagatcttgctccaggaaccactccgctgtacaagcgaccctaccgtatggcagcaaatgaactggccgaagtcaagaaacagttggaagagttgaaagaaaaggggtatatacgtccgagtacttccccctagggtgctcctgtgatttttgtggagaagaaagacaagacgaagaggatgtgcgtcgactacagagctctcaatgaggtcaccatcaaaaacaagtaccctcttccccggatcgatgatctgttcgatcagcttaaaggtgccacggtattctccaagatcgatcttcgttccggatatcaccaattacgcattcgtgaagaagatattccgaagaccgcattcaccacgcgatacgggctgtatgaattcacggtgatgtcgttcggtttaaccaatgctcctgccttcttcatgaacctaatgaacaaagtgttcatggaatacttggataagtttgttgtggttttcattgatgacattctggtatactcacaatcagaggaagaccatcagcaccatctccgtctggtgttgggaaagttgcgggaacatcaattgtatgccaaacttagcaagtgtgag

SEQ ID NO: 4931 - DNA, 5306 bp, Oryza sativa
  unsure (1)..(5306): unsure at all n locations
attaagcaaagtatttaataaaattttatctggccccattttatattggaatttattaattaaaattagatcttctcttctaggcttttaaaataaattctaataattccaattaaacaacaatttatatatttttggatttttaggatgtgacagcggtcctcggctcaccctaggtcgacggcgacgacgaaaaaggctgtcggagcggaggaaggcggcggcgcggctcgggtcgtcggggtcgacggcggtccggcggtccgcgggctcagcgaggggttggacggggtcgacggcagtgcggcgaagccggaggaggcgacgccggggcgggagacggtccggcgagcggagaaggccggccggaggtcgtatgcgactgatgaaagagagagcgacggcgcgagctcgattccggcagggagacggtgcggcaagggccgaaaccggcgaaggaagccccgggagggtttatatagggttgaaaggggagaaggccgcccgaagggaaagaaaccggcgcggcgctctcgggctccatcaatggcgccggcgggattaggggagggtttccaaacgaatccaagggagagagggggggaaaattgggggaaaagggagagggaatcacggggaataattcccccttattgattgcacgcggggaggacggaatgcggcgtattcggcgncgncgncgcggcggcgcttggcgcgggcggagaggcgggagcggcgggaggaaggggatgacgggtgggccccacccgtcagcgagggtggtgggcgggcccgcccgtcagcggcgcgcgcgcaggaagaggctggatgggccgcgggggagaggagaaagggggagggagatgggccggattcggcccaagagagggaagagggatttttagggtttttcttttttaaaaccttttcaactttgtttatttcttaataattattatttgtgctctgaaaattccactaaaatttatttacgcattttaagcttttaggaaatttacaaaaatcctctaagccttatttggcttttaactttgcacattttaattgttggtggggttgggttggtactcttgtttatggctaggatgggttggaaactatgtcatgtcttccgtccggataccgtggtggtatgtggccgcgccctcggttatgggcaagccgagcaatgtacccaagttagtgtttttaattcttaacacctgcttaacaactaaaatgtggaatggttggcctgggttggcttgggacgagctgggacccagggtcgggttgccagttcggtctgaatcatcgtaggccttgggttaaggcaggttcgtgtgagttcacggccttgattaataatcttgtatagctctaggaccgtgtttacaaaatagctttgagcaactaagtgtcttttagtgctgtttactgcaaaccctaacccccctatattatggctcccttgtactcccttgcatttattctgcacttgtgggtgtgtcttgttgagtacggtggttgtactcagtcttgctcaatttttcccaaacccagaagagaagcccctggatgatgaaggctttggtgtctagctcgtgcctcccgtcaagcgcctgtggtcgtcgccatagtctcccgctgtttcccgtttgtctttgtgtgtgctgggccttcgccgcccatgtaataaagtaaccatttacgcctccgcttgataaactctgaaatgtatcaacttttggtgtaccttgcctcctgggacaaggaataatacacacatgtaaggaacgcccgttgggttatttccggtcgtgacatatttctccgtatttagccccggttgtatggttatgacgggctgtcgtaaagaactcggcagtcaggggtggctcctcgaagtaccaggagggcatcggaaagagggtattagctagtatgttggttaactagaatgtatgtatactatgtatattagaagtatagtaatagattatctttctattttcttcctacctagcttagataatatattataagaatgagtagcttatgcttgtgtgttactctacccttggattatcttaacccatgcttagaatatgattatcacaaataatatataaattgttagtcaagttctctctatatgatcttcccacgggataaaataaatacaatacccttggaatactctcgggtgaaatgctacaatggtatatccgtgcgcttgcggatgaactctgtaaccataatataccagaagtatttgtgtgccattggtgggaattatatttctagtaatgtcgttaagaaataccaacagaggggagaattatacccgaacgagtaagctctccgcagccgcgcaccctacgccgaactcattatgctcggtgatggaactanggccaccagatacagaaataatctggcagaccccttcaacaaaggaaccgatctcgggtcggaaggtaaagtcgncagagacaacttggggcgcggtgagtgtcatatcagacactgtcatttagatcgccactgcctggccctctcgctggcgactcgccgaagcaaatgtcacagccccaccagcgccagaggctttcgccgtcgccagttgcaatgcttggtccgaagcaacagcgttggccgaagtgctgcccccggttggcgcgtccgcatcactagcaggcagtggagacaggagcctcttttgtggaggtgggtgtcgtggccccgacgaagttggcatcccatccgaagatgtttcgctgtccgagaagccaccggccacctgcaccacccctttcttcttcctttgggcggcggcaccggccttcgacgacgagccagtgatggttagcaacgcattagcactagcgatgttttgaggacgcgtgggcgaagcgctagagccggccccagccttcgcccgaacagggcttggggtatagccgtgtgacccagcatcgtcgtccgacccgtcttccctctcatcgtcgttgtcgtcgtctgcgttggtctccacggcgtccttgcccactcgccgagttcaaacctggcttctcttggccacgtcgcgcttccacttttttgacgtcccaacgtcgtgatcgactctcgcagggttcgcccggctggctagcgtcccgtcgtagacgcgattcgcctgtccattggactgttactgaagcaggcgagcgtactcggcggtaattaaacccccgatcattttcgccgactcagctttggcatcctccagcaaacgaactaattaaaaaggggaaagatgacaaaaattatataagcccaaacaagccccaagatgtgagatatcgaaggaggggagggaagcttatgattgatgccaggaggaagcacgaggcgggaaagaccgagcacttcttcaccctctgcggtagtaatcccccaatctcgcgcgaggggagaaatctgtagcatgcaaaatttttcgcagaggtcgcgggtgctcaaccgatgcgcaaccttgcgaagaaggatgagccgtgcctcaagcacgccatcaacatccacgttcggcttgatgatcatggcgatagaaagacgccggaagcgaagccacttcgccttgtcatcttcggcggaatcgtctttggagaagtaggggttggcgatgtagaaccatttttgcatcgaattgcggtcccactttgccatcgacacaaggacaggccatgcatccgagcgctttggccgaagcatgaagttacactgccaaaaacagtcttctttggccccgccagagtgttgtcgtccttggtccccacgcacaccatgaacagggtggcgaagagctccgcggtaggagtaaatccacacgtccggcacatccagacgaacacgaccaagttgagaaatgccgatgggctgagctaggggagcttgatttcgtacaactccagcactgatggcagaaagttgtcacatggaaggcggagcccggcggtgaaaaagccggcgaacaccaccgttcgcccgtccccggtcgaagggacaacgtcttcgcccgcacaggacacctggcgctccgcaaggacgctggagaggacaagctcggccaggtcggcctccttgacaagaaacttgccaaggtagcacgaccaaccatcgctgaggctgccagggtcttcgccagacgatccggccttagtaggcttgcgaggagccatcgaatccgcgatgaaagaggtggcgaagacaggaggcgaaaagctagagcaggaatgatagggctgaaggcacgagagtctgacagcggtaaaaacgagaagtggggaggagtgatagcgacctgggatgagggttgtatagcccgatcgcacgacggttcgactcccacccaaccacagcctgacacatgtcaaatggtagacggaacggtaaattcccatcgagccgggccacacagtggcaggctagaaccaaggaaaaccaagaggcccacggagcccgatactgttcactttcaatttcaaaccacctatccatttcgccataacttgggcgaaataagaaaagattactaacacaggaactaagctctttgtaggtgcaaaaggataggtttcagtaggaacatcggccgaaagggggcgcctcatgccataccacacaatttgcatttgcacggtatcggtggaagctccctacttacccttggccgtgaggggcttgttggaggtataccacgagggccttcggccagacctgcagaaaccgttgtcacaccctgattttcgtcttaggatttataaatcatttaataaattattaatagaatttatattaaatgttcattaatttacaagtgaagttaattgtgggaaataaaatttcctaaatataaagcatggatggatttaattttttattaaattctccatggttaattatactctctggaattttctcggattttttcggagctcaattcctaaatgatacaaagaacagttcagtaattatttgatcaataatgatctaattataattgttaagtgcttttcttgcttaaaatccttaaattataaattgttgtttaaaaggaattattagaaatgattttaaaagcttaaaagagaagatctaattttaatttgctaaatctcaatataaaattgggttagataaaattttattaaatactttgcttgttcctctattttctagaattttctgggaattgtttgagcaagggaagtatttttaataaatgaaacatcatttcacgaattattttaattggaaaagtt

SEQ ID NO: 4932 - DNA, 2330 bp, Oryza sativa
taattattatttgtgctctgaaaattccactaaaatttgagggctccttttaggccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacaaatccaccccccttacaggaatctcgtccccgagattcgaggatgggttgggcggtcttctcttcttgtctgacttcttccgtcgcgtcttttataacaaacttgcctagcaaaacttctccactctggactgcttggctcgatctcctattgcagatggaatcttctcttcacctgacttatccctggttgcaccttttggctgactcagactaggttgcggtagttcagtgatgcttccgttccagaacttctcatgattcatatcttcggagtcaacctcggacaagttatcaacttcatgtcatgcgtcgtaacctgcttgtcattactaggataccatgcttgttatttgcttctaactcgccaccaactgcctcatattagcttccctggtctccgggtgatagctacttctgctatttgatgcaagggtcgataactttacctttgaattatgcttcccaagagagccaacttatcctacttgttatactttgacgtcttcccaaatggctttactgctggatttgttattgtctaatcattaccctgtcaaatctgaggcttcgttgtgagaggtgattttaacctgacctctatagactatcttcgaacatatcactggttctataactgggaatggctctcacgaacaagcagctcggattcactttctttacattcagtttacttcccattattatcttcaggttgtcctcagttagcattcaacgtattcctttacacttttaaccttgatgtgttctttcccattggatcatctcccaagacttggcattacctggtaaccggtgcttgcacttttcacttcgtgtagcatctgataccgagttgaagatttcactccttgccttcatagaaacacttttacctaggtcatcttgcttacttaatgacaaggtgactgttgcggggcaattacaatcaggggtcttccttgagcgatgcagagcatgtttctgtttatcaatcacctttcggcctacttcttttatgctagagaacatctttgccaatctcttttatcaatcatctttcggcttatctctaacaggtggtattcttgaatgtggattgcggacgcttctggggatgatgaggtcctttggcttgctgcctttcggtgaaaccttgatgtggttcgtcaaaagctgcactgactaccttcagggaaatacattgtctgctatctgtatctataccactagggtttaattgccgatggtcatctttagtgcttcctcgagatggggagcatccaaattgttcttctgccacatcacctttgacctttttctgataccagataaactaattaccaaccatcgactattatgttctcaaatattgatgtctcctggatctccttatctgttggcaggtatatccgatcttatcaatgtagaggtatggcgggtacccttcggggtttcctccaacaatccttatcttgatctgtaaaaggcgtatccgaactcctatcctcaactactgtctcgttagctttttaacccaacacagtttaattgtttttcttttccatccacaggttggctattaactcgaggttagaatatagttcctctgacacgagaccctaggtctcctttgtcagtaaacaattatacacatgatcacatatccgcatctttcaaacgaatcctcatggaacttgtctgtattacacatttctccctcattacatgaatacgaggcactgccttaaacaaaaagggacggtgcttaacatcggtacattgtattctcaatatgaatcatccataagcatagcaagctcactgtttatagacatgaatatatttatgtattacatgattgctgcaaactttcgattacaccatgataagtagcggactgaaaaccacaaacatggctgctcattttgattctggagagatatagctggcattgttccagtgactgcatcctcgattggttctgtgatgatgtgataggactgcataatgctatcattcacaggagaagcttccttctgattgctggttgaagcggatgacggtcttctgcttggtatcgccctccggaggttgattgcccttggctaggcctggagtag

SEQ ID NO: 4933 - DNA, 4087 bp, Oryza sativa
gcctatggccgccgtcggcgaccataggggcgcgggcgcgccgctcccgtggctgtgccggcgtggccggcttggggcgcgttccgcggctgccatgtggggcccggccgtcagccgcccgcgccctcgggtgcggctgacgcgtgggacccacggcgccggccgccgtaagccgcgtgcacccagtccaccgtggaccgtggggctgccgcgtgggccccactcccgtggacccggtccgcgcgcccctcccctcggctgacgcaataaatccgattttaaattaaaatttaaatgaagaaattcgcaaatatccatttaaagagcatataaacttcaaagggccatatcttggccatttgaactcggaattggaccgttcaagtctctaatttttccttaagaagtcaagaacccatttttgtgctttgttcctgcttgttatttggagtttattagtgtgtaagccttttcttttccgttggtcgtgtagacgctgcagcttcggaagatccgcttttcgtggaagtcgaagccggcgtttgggaaagcgagcaaggcaagtcacatcatccttgagcatattgaatcccagtttataaaattattttgatttaaattaatgcattatcgctttatttaaattcccgcgttatcactgttttatttagccatgcctatttacccttgttatgaccttattattattgctattgttattatttccttgttcaccctagagtaaacaaaaccccaactagtggacactctactcatggcaccactagtttaattttaggtagatgcttcgcaatttaattaggcaacattaggtggttttataactttagactttgggaattctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttccgcctgcctgtcccgggtatcccggccgtaggtgggattgggtcggtactcttgtctaaggctaggatgggttggaaactatgtcacgtcttccgtccgtataccgtggtggtatgtggcgcgtggttacacgtgaggaagatgtgtcttgtgggtaaagatgtacacctctgatcagagtaaatctattcgaatagccgagccctcggatatgggcaagccgagcaatgtacccaagtcagtgttctaattcttaaaatttgctcaacaactaaaatgtggaatggttggcctgggttggcttgggacgagctgggacccaggtcgggttgccagttcggtccgaaccatcgtaggccttgggttaaggcaggttcgtgagggttcacggccttgtttaataatactgtgtagctctaggatcgtctttataaaatggctttgggcaactaagtgacttttaaaggctgttactgcaaaacttaacccctatattattatccccttgtactcctttgcattaattatgcatctccggtgtggcttgctgagtactgtggttgtactcattcttgctctatctttctccccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatgtaataaagatgtgtcttctatatcatgtttgtgtggtgtaccccggcctttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaaggtttactcttttcttccttcttcaaatttcaattagtactagatggtcagctttgcgaagaagaagatgtcgtcagttgtttgccgaagctccggaagactgcaggatccgcttgagaagtgcaggaagcagtgaagccagctgtgaaggagtgaagatcttgggaacccgtcgcagaacctaagccaccctatagggtagtgttgttagtcgtgtgttccttgcttgtgtgtgtagcgcgtggtttgcatcagtgggttgtgatgtaaccatgctaggttgtttgcttaatcaacctgcagaataagcaaaacaaacaacacatcaacaaaaagagttagttcctgtaaggtcttgtccctagttctggtctattctttccttgtatgctttccctctcaacctctaccttgtgacagatggataatactggtaacaaaggctatgggaatgatggatccgatgactcaagaacccaagccaatgggaatgagagaagcatcaacgaaacctcaccagagctaatccaagttgtggttaaccaaaccaacatgttggcaacagcctttcaactattacagaattggaacaacccagcaggggcaaccaacgttcaagtgcctacagtccagcaacagtgcaagttatcagaatttctcaaaactgagcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaggcatcacggccagaaggacataccatcacctggaacgagttttcctctgtattcaggagatcacatgttcccgcgggaatgatcacactaagaaaacgagagtttcgctacctgaagcaaggggatttgaccgtcacagagtacctgcacgagttctatcgtttggctcactatgcaccagaagatgtggaaacggatgaagacaaacaagagaagtttctccaggggttaaaagatgaacttgcagtgcaactactcctagaggattatgaagattttgagaaacttgtggacaaagccatgcaactcgagagtgagcataatcgaatgacgaactgcaagagaaggattgtcaacatcccagtaattccatgtggtaaccaaaggcagcgcactgagccacttcagatcaccgggtcttctgttgtgcatcaagagttcctgctccaagaagacggacgcgatgcagacaacaacactagcaatactaatgatgatgataccaccaacaaccatggttcttgccccattagtgaccactcgaataaagcgtgcaatgtcagtagcattcaccaagatgtcaatgatagtatcaatgttggaacccagaatgacaaccttagcaattttgacactgagaaagactccaatggtgatagcaactatggtaccactgatgccaatgttagcaaggattggcaaccaccgattccaactccaagtcagaatgatcgccctcagacggatagctcagcaaagaagaacgttgatttgctacaattgcaaagaaccagggcattactcgagggactgcctgcaaccaaggcaaaatcgacctccacattaccggcaatttacaagaatcagacatcccaatcctattgggggcactggagcaaacaccgtacccgtgaggccttgtggtaatcaaaaaccatagcagaaacaatgtaccgaagttaagcaccttccctttttgtttaaagcagcgcctttgattcatgtaataaggagagaaatgtgt

SEQ ID NO: 4934 - DNA, 766 bp, Oryza sativa
cccagaccaatttagtattgcttattttgctacaatctggttaaaatatcctatacttagattgggacaatacgtaagatttggatgatttccgggtggctagtattgtctcaatcgatataagatttaccaggtacttatgtcgaacgaacgagtacgaccgcagtttctagaatggggacagacctagttattaggttaattggcaatatggcacctctgtatagtggttcttatttttaagtcctcgcgcaggaggcaactatagccgcgaagggcaatttctaccattaccatgtacaggtaattggtttattgagctcaattataattatggttatatttctaaaccctgatcgagatgacatggtgtcatacgatcagttccccttaaatacctcgggaacgccagaactcctcttgctgctgttaatattacgttcagggcatatgaggatataagttcatggaacaggtgccacaattgttaatgacttaatactgggccatgactgaagccgatgattatcagcaagtcgtggactgcgggtaaagcgtacatctactgcagtagaatatctttgaaactattcgaatagccgtactcatggaattgagtaccgggactcatatggtaccctggttagaaacctaaagtttatatgttataaatcctgctataattcttccagattgtccaatactactttttgcaaagaaccctattatatgtcagtgcatatcatatttccgagataacttgctg

SEQ ID NO: 4935 - DNA, 586 bp, Oryza sativa
ggctggcggcctcctctatttctcctttatgtagatttgtgaattttggcccagtttgacgtgtcaattctgagttcttggcccattcatgcataagtttgattgtcgacatcgtccgatggacttatcttctatgttgatgtcgattctcctccactttattgtcattctctgcaaaatgttagtagacctaattctagtagaatattattattctgacatatttatgcattgcaagcatcactagttctcctctattttggtaatattgacggtcgaaactgatcgataacgactgtcaacacctgtaccggtggcgcggtgggaagtcggaggtgggcatgatctgggagggcggtgtagaaccagtcgttcttccggtcgtcccactttttgcgcagcatgcagttgatgtagcggtgcagcgtgtgggcgtgtggctggaagaagctgccgcaaacctccatcgctggggacaccagctacaaggtgaagaaccagcggaagaggcccaatgaacatctcgcacagatgtgcgaagatggccagtatcatcatggtgttgggggtgtggtgcgccatctgg

SEQ ID NO: 4936 - DNA, 1694 bp, Oryza sativa
gaaagatgtgaagtacaagtggtcggaagaatgtgagcagagtttccaagagttgaagaatcacttaatattagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtaattcatgcgttgaaaatttggcgtcattatcttttcggtactcgtacagaggtgtataccgatcacaagagtttaaagtatatctttactcagccggatctgaacatgagacaaaggagatggttggaattaattaaggattatgacatgggaattcattatcacccgggaaaggctaatgttgtagcagacgctcttagcaggaaaggttattgcaatgctacagaaggacgacagttgccattggaattatgcaaggaatttgaaagattaaatttgggaattgtcagtagaggtttcgttgccgccttagaagcgaagcccactctaattgatcaagttagagaagcccaaattaatgatcctgatattcaagagatcaagaagaatatgagaagaggaaaagctatcggtttcttgaaggatgagcaaggaactgtatggttgggcgagagaatctgtgtccccgacaacaaagatttaaaagatgcaattctgaaaaaagctcatgataccttatactctattcaccctggtagtacaaaaatgtaccaggatctcaaggaaagattttggtgtgcaagtatgaagcgtgaaatcgcagaatacgtagcagtatgtgatgtttgtcagcgagtcaaggcagaacatcagaaacccgccggtttgttgcagcctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcacttagcggaattgtatatggcaagaattgtgtgtttgcatggcgtccctaaaaaaatagtgtctgatcgaggcagtcagtttacttcaaatttttggaagaaacttcaggaagagatgggttctaagctgaactttagtactgcttatcatccgcaaacagatggacaaactgaaagggtgaatcagattttggaagacatgttgagagcttgtgctttagatttcggtggaagttgggataagaatctaccctatgcagaattttcgtacaacaacagttatcaagctagtcttcagatggctccttacgaagcactgtatggtcagaagtgttgcactccgcttttgtgggatcaaacgggagaacgtcaggttttcgggacggatatcctaagggaagcagaagaaaaggtaaagatcattcaagaaagattgcgtgtagcccagtcgcgtcataagagttatgtcgacaatcgccgtagagatttgagttttgaagaaggagattatgtgtatcttcgtgtcacgcctcttcgaggggttcatcgttttcacaccaaaggaaaattggcaccgcgttttgtgggaccttataagattgtcagta

SEQ ID NO: 4937 - DNA, 4479 bp, Oryza sativa
ggtgacgtcaacgctgacgtcatcggggtcgtccagccgtgagccggtcgtgaacgttcgatatcgtccgtccgttttggattgaatcgatctcgaccgtcagttcgcgtgaccagtcgccgtgcgcccggtccaccaaaaccgtagcccgctgatgcaataacgttcttttccttttcaaaaataattcattattgcgtcataattcaattttaaccgatttaagtgttttaatccgatttaatcttcaaaattcataactaattcatcttagctccgatttagttggttcaagtctctaaatttttctaaaactgagatctacacattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattatttctattcaactattgcatttattttcgaatgtcattgggtggaattaacctattctttgttatagcccttttgttcttgattactttattccttgataccttgggttataataatttgactggttgaactttatttatattggttcaactagatattagatataattgcttagccctgcttagaaacattagcacactattgggataactataattcacttttatttcatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcggtggattgtgttgtgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgagtctaacaatgtcttttgtgattagtcccacacttctcaccctaatagaagatgctataattggtaataatttgattagctcctggtttggaatggtacattcctggtttggagatagatctgtacagccgggatggttgttcagaatggttgggcctatacaacagggtacgttgtatagtgttggattaatattgtttaattattacttaactgttttattaaattctcaaatgtttgctaaatgctgcttttgcaaatggaaccctattatgccatcctttgttatcctgtgcacttgcatatttgatgcgtggcttgctgagtatgtcatatactcaccttgcaatcattcatcagaggaagagttctacaatgatgctgatggtgtgaaggattaggtgtagccttggtcaagctgcctgtggagtggagtcgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgaaagcgtttggaattttggatagaaattccgggcgtgacagaaaacaatgcataagttgaaataaatcaatagctttaaacaggttcagcatgctcaaagggttgtttgggatctgtgtgacttgccttgctggccttggaactcttcaaattcttctcctgcgaaaacagactctccggaaacgtcggaatctaaacaaaaaggagcaaaatcaccaaaatagcacataaacaagcatgaacagtacatgtggatatttttaacatgtagatctcaattttagaaaaatttagagacttgaaccaactaaatccgagctaagatgaattagttatgaatttttgaagattaaatcagattaaaacacttatatggattttaattgaattatgacgcaataatgaattatttttgaaaaggaaaagggatttattgcgtcagcggctagggtttgcggtggaccgggcacacggcaacggttcacgggaacgaacggccaagatcgatccatccaaaacggacggccgagatcgatcgggtctacggcggctcacgagagacgacgacgatgacgtcagcggtgacgtcacctccggcggcggctcggcgactcggcagctcgggcgcacacgctcgccggcgaacgacggcgcggcggcgcgaacggagggcacccacgggtagcggactgcacgacgaactcaccggcgaccaaagcaacggtggaaaatcaacggacggcgacggcgtcgaggaagagcggcggcgacgatcggcttgacgacgacgacggtgctccggcggtcgacagcgacggcgtaggggcggacgaggacggcgacgagatggcgaccacgatggcgacctccccgagcgacgacgacgactggagcgacggcgaagcacggctggagcgacggcgacgacggcggctcgaggttacacggcgctagggctcttccgatggcgagaggcgaaagcaaaggtggcgacgggtagaggagacaccggggatccttttataggggttgaaaggcggcggcgaatgcccacagcgaccggcgacgagaaggaaagattagggttcgggagagagatcgatccgaatcgaactcgaatccgcgaatttccaaacgaaattagccgacgattccataatagaaaagatagaggggatcccggggatcatttcccctctactgatttcatcgaaaacgaaaaggggccgcccgaattttgaaggagacggcggcgcagctcggctagggttcgggcggcgggcgcccggaggttgacgacgaccctgacaggtggggcccacctgtcagcgggagagagagaggagagcggcggctcggttgcggactgggctgggccggggaggagagagagaagagagattttgggccgactttcggcccaaagccaaaagaggatttttaaaacctttttcaatttaaattatttattaaatgcaattccatttattaaaaatactttcttagctcaaataaatcccagaaaaatctaggaattatagaattaagcaaagtatttaatgaaattttatctggccccattttatattggaatttattaattaaaattagatcttctcttctaggcttttaaaattatttctaaaaattccaattaaacaacaatttatatattttgaattttcagggtgtgacaaacctaccccccttaaacagaatctcgtcctcgagattcggaagaactggtgaacagatgcggatgagctgacttcaattcatcttctcgttcccaagttgattcttcttccgagtgattactccactggactttgcaaaaacggataactcgattcctggttcttctctcatttgtttccaagatacggattggtttttcaacataggtcagatcctcttggacttctatctgttcaagattagcttcttcggtaggtacccttaaacacttcttcaattgcgacacatggaacacattatggactcctgccaaagattgaggtaactctaactgataggcaacctcgtacggagtgcgacacttccgaccatacagtgcttcgtacggagccatctgtagactagcttgataactgttgttgtacgaaaattctgcataaggtagattcttatcccaacttccaccgaaatctaaagcacaagctctcaacatgtcttccaaaatttgattcaccctttcggtttgtccgtctgtctgcggatgataagcagtgctaaagttcagcttagaacccatctcttcctaaagtttcttccaaaaatttgaagtaaactgactgcctcgatcagacactattttcttagggacgccatgcaaacacacgatccttgccatatacaattccgctaaccgacttccggaataggttgtctttaccggaatgaaatgagctacttttgtaagtctatcgactatcacccaaatagagtcatggccctgatgacgttctgggtaaaccagtgataaaatccataccgatttcttccacttccattcaggaatcttcaaaggctgaacaaacccgcgggtttctgatgttcttgcttgactccctgacaaacataacatactgctacgtattctg

SEQ ID NO: 4938 - DNA, 4268 bp, Oryza sativa
ctgagggcagcctcctccctttagtctcgatacgccctgacctatatcaccaataataaccggggcagcccgaaccccaagcacggagggggcggctgctgctctaccccgggcccgactccctcgggggaatgccacatgggtactgagggcagcctcctccctttagtctcgatacgccctagcctatattaccgatagtaacccccggcgttaaccctagccgaacccttccatgagtggccaggtttgacgccattcttctgatccagtgacatgtgtgcctagtattttttgagtcatgacacatttccgcgatcgcggcccagcgcgcagtggaaaaccgcatccctggcaatgatgggccgtcacctcgcaattgccacatcgcctggggtggcgcgcggagcggatgcgtcagtggcttcgctagcgaataatgatggcgattctgtcgtaggctctctaaccttccattatatttgagagatgatgtgaataattcaaatcatcatacaaacataatgaaacatctgacgcctcgagagaagaatattagagacattgctgggcctttagcctgccagtcaactttagcctgagatgtacccgtcaatccactcgaaggtggcgaccagatgtgttacacattcaggagagctgacaaaaatggctaaagatctacaaacatctcaaatattttttaactcatactcatgtgaatctagttgccaggatgtgcactagattcacactttcatcttaagcatggacatacatagcaaacacaattaagatgaaaggaacttaaggacttacaacaactaaatagatacataggccgaccggcaaatagacataaatatagaacaacggaagcttgactacccaaatacaagcacaccgactaggggtataccccatcaagttctcatcctagaagaagcaatcgaaacatgcatcactcaaagactaagtctaaatcctgcaagcaaaagtttattccaacagcaagagttagtatattaatcaaattaatgtattggcaagcacaagacaatcctaacatactacatataaggcatatattcaaaggaaggcattatgtagtttattttcggcataaagaggttttgtttcacaaatcttttgtaatggagtggcaattcaactatcaaaaacaagttttaacttttatcattaagttcatcataattccatcataatcaatctcttgttgtcatccttgacaacaagtcataatatatcaccacactcacagaactcaacacattttatcaatttcaaaccaagttacatgttctcattttaaaacatagtctatactcataacacttcaccaaagcgctcatgaccgtgagcatggctaatcgattagtttagagaattccgcagagtttgtacagctttacccacatgatctgaatcgctctagtttggtcggtacccgtcggtaccaccatactatacgcattaagtacattctagaggtcacaacgaagccttcacactacttagaatctagccttgcaccagcacgatacgtgttcctccatcctagacattcttggaatatgtctagaaccgctaagtagcaggcccacgccttaaactaccacgatgggaacccaccacgtggcacaataccgttgtattggacatgtttagtcacctaaactaccactttggggtaaataggaagctcctctgaattattccaactcatacacaccggcctaccagaatgcaaggctagttctaaatagattaatcagcttagtccatcccatactagcacatgtggatgtacgaataactttaagttggtgacacaagttcagtccttacggactcgggcaaacactccccctatcggtatgcaactaacatcatatgcacaccacttgccgcccaagtctaaaatcacattttacttattttagttcacaaatacctatcatattcattttattccagcaaaggttcatgcgtcaaaatcatattttaattatagatggaatgagcatttgcatgtttctaagcatggctaagcaagtagttggacatagagcatatataaacctatttgagcacaaagagtgtactctaaccatttctaggggtttaagcagcaaggatcacaattattgaaggtagggtatgcagcagataggtcataactaccttatcccaattttaaatatcggtatagtttaagttcatatgcaactttgcaaacaaatattttcattcctcaaatcatgggattcaatgtgttcaaaggatgggaggagaacttgccttgatattgagaaatgtttgcacctaatccattccttcaccgcttatgcaattatctaaataaaatacacgttatgcaattaaacaccgaaatagtcaaaaatctaaaatgctctaaaatgtatgatttgtgcataataagtaggtactgatctaaaatgaacttaggtgaaagaatttccattttgtctcattccatttgagagttatgaattttagaagttatgtcggtatgtagtagtgtttaattaggcagtgttataaaatgtttctataaattgattttaattaaatttgacttcacagaggtgaagagatgagttttctaagactagaacatttggtttcacaatttttagagtttctatgaatttctaatgtattttagaagttacaactttttatagctgtatagtgttatataggttcatggctttagaggtttaggtccagaacttgtttcatcttgctagtgatgtttaaaatgaatgatttagtctactaatcaaattttagttcacaaactttgagttgatattactctactacacattttgtaacttagggaatgttctatgttaatgactttacatattaacctagagttttgttacacaagctatgttcatctaggttttagtgaatgaggatgaatttatagcttttctggtctaacaaattttagttaggtttaattagagctagactacatctatatatatacatacctatgttttgcttaatcaacactatatgattagcaccaattttatccaattaaggttcagagctataatttgtacaaaaagtgccacattttactttactaaatttaagttcactctttttctgactccatagaaacttggttcactctttctggactaaggatgaattttctataagttgtacaaattaaaggctaccccaagttggttatttccttatataaatatttagatgtttttattatacagaaagtttatatttttattttacaacttggaaatacatgttttggtgactctacagaacttgagtttactcaaagaggagttaagatgaattttatatgaacttctaaagtttaacttatctaaaacttattattttaaagataatagttttaaaggctttggaaaagaagtaattatatacttttatttctcctaatcagagagtgtaagttgatgaatctgtggaacttaagtttgttcaaaactaagttgagatgaattttatatgcattttataaatttctatattaaatttaataactttatgaatctacagaagtttgaatcatctcaaaatgagctatatttaattttatatggattttacaagtttaggtgttttcttgatatcaaattattagtttgtgtatttcttttatcctttttccagtttttaaatagttgggtccacaagtcagtgagagactaatatgcaggaaggcccttgaggtttcaaggaatcaatctgcagtccaaaatgtgcgatgaaccaaattcattaagagtcctcagattcttttaattcattactaattagtccgttgtcccacatgtaagtctaacatattttacattttaaaccttacaagatttaaactttctctaaatgaggttctcagtgcctaatgacatggggcccgctcgtcagtgagacggtggccggcggacagagcagcggcggctcggcgagtttctcgccggcgccggcgatgaacggcggcccatgtcggtgtgcatccaaaagagaaaaggtagcctacataaatgcgaacccgacggtatcctttttgcgagctgcagtggtcagaatcgatggcaatggcggcgcgagcggcggcagtcctcggggtgacgatgcaggttgatttagaggtcagatctaggtgaatggagtgcatgcatgtaactaataggtctccaggatgctca

SEQ ID NO: 4939 - DNA, 1889 bp, Oryza sativa
gaacgacgacgtgaacccggagcaacgatggctaggtccgcgttcccataaaaccactgcattttaggggctgagattagaggggatggaaccggcatcgagactagattaaggaacgcaaaagaagatgaaacggccgctgctctatttcgttggcgaccttcgtcttcttggtggccgacgatggagatgaggaagaaaggagcagccggagctcgttccctcgatttgcccggatcagaagtcgtaatggggaggaggcgatgcagctggcaggaagtgaagacgaggctcgacgttgccacgtcgaggccacgcatcgaacgcacctgagagttgttggcgccgatctttcctctctcacgttctctcttgcctgctggtcggttggaggattgcacagggtgaggacgagccacagccactgataagtgggcccaaatcgatgacaccaaggttagggagaaagggaagggtagaaacaaaggtagacttgattttggacgattttccaggatttatttctcttccccttttttgttaattcatatattaatttgtgttgcagatgtgttcatgtggattttattgcaggtggatgaatgtacctagtttccatttctttggttgcacttaaaaattatggataggttgctcacagaaaattgaggaatatgggctatttggaaactagtttgaatttttaggaggtctaaaaagaggataaaaattctagaaaaattatatttagttatgataaataatctagtatttaaataaattatttaaagtatacacttttatgcattttaattcactttttgggtgaggtatggttttagccaataaaggattataattagtctactatgtgactgttttgactaatttatttgaggcaccaaacttagttattaagttgtaccaaaattacagtaagttgtatgtgttaaatagagactacataaattttcccatgattttaccttgcatattttattttaaataattagcaggatctttctatatatatgtcccactttataaatgcatctaaagatttttatgtaaagtacattaaacttctttcacttgtgatggcattattttgacttccttatcttatcttttaaaattatacctcatgaataacttttgttttgcttagtgaaattatttcccttaattatgttcatgagtcctaatatgcaatgccaaccaaaatccaaatgcactaagaagactcaagtcaaaacatgtcttatgcgagtatgcatgcttgctcttacgtttgcatctatgccctaggttagagatgaaaaaggttttaatttgttctcaaattttaatcatgcaatggtttaggtcggttattacctaagttaaaacgaaaatttttggctgtcaaaattggaaaagttaatttcaaactattttgacgagaaatttttaagtccgagaatttcaggtatgtgacagattcttttggtaaccgcgcgcaattaaggcgggcgtggctcgccccgtcttgaccgcaacgaccgcacgcctaccacgcgtgtgtcagaagcagcgcgggaaatgagagggtggagttagtggccgtgagaaacaaggagccaggcgtgggtgaggggagtacaacagggcgccgcgtaaggatttccttcccttcctttcgccacttcaatcttccacgcttaccgtgccctagccttctcggttcttcgcctttctctcgccgcgcacactcgctcgctttgtccctgctccgccagtgcgatggcgcgtggttccacaccactggacgacagcgtactgcctccctcccgcatcgtcagcgagaggcaggtggggctgccgcggaaatccatgccaacactgcccag

SEQ ID NO: 4940 - DNA, 2409 bp, Oryza sativa
ttttggtgtaccttccctctgggacaaggattaatgcacgcacgtaagaacgcccgttgggttatttccggtcgtgacaagcagtcgtgtcatgggcttagcaatcttagaaaaattctctataaaccttcgataatatcctgcgaggcctagaaaactgcgaatctctgaaactgtctttggttgcttccaattagttacggattccacattactaggatcaacggcaactcctcctgctgagatgacgtgaccaaggaacttcacttcagacaaccaaaattcacacttgctaaacttagcatacagttgatgttctcgtagcttctccaatgcaaggcgaagatgttcttcatgctcttctttggttcgggagtagataagaatatcatcaataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatcgatcttggagaaaacagtggcacctttaagctgatcaaacaaatcatcaattctgggtagcggatacttattcttgatagtcacatcgtttaatgcacgataatccacacacattctctgggtatggtctttcttttccacaaaaataactggagctccccatggagatgaactcggtctgatgtatcccttctgaagcaaatcatctacgtgcctcttgacttctgccaactcattggctgccattctataaggtctcttatggatcggagttgttcctggtaccagatctattctgaactctatatcccttttaggcggcataccaggtaaatcatctgggaacacatcgggatactcccggactataggaatctcttccaaagttatctggttcagtcttgaccttaaagactcagaagacaatgcatgaacagttacaactcgaccatcattgctggtgagagttacttttctgttggcacagtctatcacacctttatgtctggctaaccagtccatccctaggatgacatctaggtctttggattctaacaagataagattggccagaaatggtactcctttaatttctattctgacagaggggctacgatgcaaagagagtgcttaattacttggggtactaaccatcaaaaaacgtctaagatcttctacttccatcccatgatttcccgcaaaactcatagataagaatgaatgtgtagccccagaatcgaaaagtactgttgcaggacctgagttacaaggaacgtacccaaaatcacatctggagcatcttgagcttctgcagcagcgacatgattaacacgggcctttgatgctggtacggtagagttgctctgggtagggacaaccttcatgcgtcggggcttcggacacttgtcagcataatgtcctgggtctccacagttgaaacacaccacgggcttgctgccttgctccctcttggcaggttgttgctgtgttggagctgcaacagggcgtagagcttgattgcggatgttgttgccaacattgttgttgaagaactgacgctgcggacgaacaacagacgaagaacctccctgtggcattgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattattaagaaataaacaaagttgaaaaggttttataaaaagaaaaccctaaaagaagttctttttccccccccccttcctctcttgggccggctcggcccacttctctccctctctctctctcctcccctccggcccatcggcttcccccgcgcgcgcgcgccgctgacaggcgggcccgcccgccactctcgctgacgggtgggacccacctgtcatctccctccccgcgccgcgcccgccgccgcccgtgccctagcgccgccgccgccgccgaatccgccgcatcccgccttccccgcgcgccataaagaggggcgaattactccccgcgtttccctctcccgattccccctcttttccctctctctctccctcggattcgtccgatttgaatcccgcaatcatcgccggcgtcttcaatggcggccgagatctccgcgcgcgattccttcctccccgccgccttctctcccttccgacgctataaaatcgtccctcgtgcttcgctcttccgtttccg

SEQ ID NO: 4941 - DNA, 809 bp, Oryza sativa
caggcggaagtgatcccaccattcagaggcagggccttgcaactgatgtgatgcaaatgagaccttctcctgatcagtgcactgaagtaaatccaacttcttctctatggcatgcagccaatcaccagcttcaacaggattagtggtactagagaaaacaggcggcctcacacgaagaaattctgctaacttattctgaggaggtacatgattatttccttggttctgctggttctggagttgttgcatcatcatgttcattagctgtgtctgttgagcaagaacttgagcaagagtgggattctctccattgttattgttactggggccattcccgttgctgcgagtgttcaccatctggcagggcacaagaagagaaatcgggggaaactacttaggatagagaattactttaacttttattgatcttaactgagttttattattacaaactgaagactcccacaccactaaactcaccaacttcctaacactcaaaagcacctaacactcaaaaacaaacaaacacatgcaattacatcccaccactgatgtaaatcacatgcgacccacacacaagcaaacttaaagcaagcaaactaacacaacgatctaagaccacgatttaacaagtcactctagttcttccgagcatcggaggtcgattgaaggctcgttctgctcgtcttcatcatcttgagttgctacccactcaatcttggaatgggtgcgcttggattcttcttcttcatcatcacttatgatgatgatcggaggatctgctaaggtaaaggcaacttctttctcca

SEQ ID NO: 4942 - DNA, 307 bp, Oryza sativa
gccatttgtatgctggcttgatagctgcattggaggagaactcggcataggggagactcttatcccaggtcttcccgaaatctaggacacatgcgcgaagcatattttttaggatctgaattagacgctcggactgtccatctgtcacgtcctgattaaaacattccgaaataaaaatcatcttctaaaaggaataatagaacaattaaaatttcgaaagagaatggccaaccttaaaatacgtacaagaaaaactcaaatgggacccggagaatttttggtaaatctccttggtctaaaagaagcc

SEQ ID NO: 4943 - DNA, 2700 bp, Oryza sativa
agcttgtcgtttccgtcgttgcaaaggtttgtgagtgcgtcgaaagtgatcaagaagattattgaagatcgattatgcaaggcaagtcacagatcctaaacacaatccttgagcatgttgatcctatatttaattctctatttatttcaactgtgcatttattttcgaatgtcaccgggtggtgtgaacctattcctttgttatggccaatttgcattgaatgctctattccttgataccttgggtaataaattgattagcttgaaccttgtatattagattggttcagctaaatgctatatgtaagtttgcttagctatgcttagaaacattagctaactaaaggggttaattataaactatgttatattattattattaattatggttacattaaatggtagctcacgatggttaatcgtgtgatgttaattaattgataattaaaatctggttaaggtgggttgtgagcatatggttttgatggttgtgctcatgacaattaaggaccggttcgcgagctactgttgtgaaacatttatcgtgccaaccacaagccaccgtgggcaacagctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccatttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttaatatctggtaataatttgcttagctcctggtttggagttagatctgtacagccgggtatggttgttcaggatggttgggcctgtgcagcatgggtgtgctgttcagtgttgattaaaattaatgattaattactctactgttttacttatcttaaatctttgctaaatgctgcttttgcaaatgagcctatattatgccatcctttggaatccttgtgcacttgcatacttgctgtgtggcttgttgagtatgtcatatgctcattcttgcaataatcatcaaacctcagttgaagataaaggatccagaaggagaagacgtttggcttataccccagttgagctgcctgtgggagtggagctgaagccttcgctagaccgtaattccgctgctgttttcttttctttgtaagtatgtaacgttattattatgatggatttgtatataaaattgtcagtttgtgtacctcggctgattcctggacgaggattttacgcacaaataagttcagaaattactagtgaatttctgggcgtgacaacgccctactgctgtggaagtagaagctctcgtggtgctaactatagttgctcctcaagttggctgacgtgctcctggctttctctcagctgctcctcaagtgtatccatcatcccgcggcgatcgttgcactgatcagatagctgctgaacctggtcaccatggacctagagctgtgccttcagtgagtctatctcactgccccaagcctgatgctcctcctctagctgaagctgctgcactgtgaggtcagtcacctcggtctctaactgtcccacacgcctctgctggtcgtcgatctctaacagagcctcctcgtcgaagttgtctactgcctcagcacatcgggacagtcaagtcactatcgggttgtagcagcaaggtgtgtcctggactgtgcagacggagttgctctcctctcgaaacgggtggtgagcaaactcggtactcgccaactcagctcggtgaatagagctaagtcggagaaggcctcccgggctgcgtcctgcatcgcggtctccggtaagtcgcgacggtggcgtgtcggaaagctgtagcctgactctgaaggaactcgtgtatgagcctcaatctgggcctcccaaacgggtccacactgtctcactcggtagatcggaaatctggggtaccgtaggcgcctcatcactcgatgtagctcaatgacgtatccctctgagtggggtacgcccatctcccaggtagtgggtgaatcctgatctgtcatctatttttaagaaaaaccaaagtcagctaaaagtaaaacttgttttgtgaagaaaatagttaagagtaagatgaaaatcgtatagagttttgtaaacatagcatttttatttttttttgaaagtattactaaatgggaatttctcccttggccaactagaaaggggtggggtgccatttggtctttcctacagtcgtatggctctgataccagctctgtggacccccgtttttataacaggaatcaatcgtgtaaacagtatcatttccctggatcaagtagtctggtactcacgagttcatagctgaaataccaagtgcacatacacgagagtctagtgcgaattattacatcataggcccccaggcatagtcttagaacataggaccgaacggtccggaatacattccaaaagcaaaagtagataaggcagcggagttaaggcagcggcacgccatcgccataggcaacgaccgtaactaagac

SEQ ID NO: 4944 - DNA, 5359 bp, Oryza sativa
tcataagggcaaccatgtaaaatcccctataatcataaaccctagaagaacagagcctataatagggttataaatagccccctaaggccatgtaatggggggatccccaaaaaatttctaatcaaccaatacagtcgtctttatttccaacctgttgagagagccacgtcgttcgacgtgacgcagttatcgttcgacaacaaaaactaagcaaggaaatagaaagtggtactctatgatctgttctgtctctcaattgcctaaggtggtgacaagcgtgtattccacaaatgttagtcgtaagggtaagcctccgtgcatatttaattaacatgagagagagtactcaaactgtgcgcttgtacattttagatatacaccattgtagcaactcctgattaacaaccaagtttttgtttccctttcgtcctttactcgggacgagcaaaggttcaagcttggggggttttgttgacggtcgttacagacaaatttcgaccgtcaatataactaaaataatggagaattagctatgcttacaatgcattttgtttccaaatagtatatatatttccacttgtacatggaaataacatgttacaggaatttatcaaataaaataaagagaaagcggagaaaacctcactcctaagcaatcaaatggataaggagggcccacatgtctggtgtaaccggcagaaaccgctttaactgccataaccacctaaaggacccacctgtcagtgccctgcccgaagctagaggcctgctgggccggcctaagttcggctgaactgccgaaccctaatggcgacggctcagcttggccctccacgtgcacgctccaaatcgcatactaatgacggttacaggggcaaaatggacaattcgcatagctacaaccgtcataaatacccaataaaaggaggagctcattcactctctcaacacactcaagcaagctcaaattcttcttcatactttagtattagtagtatagtgctaagcggagtagagtagattagtattcggagtcctcgaggtctccggaagagttttggtatggctctagcagctcttgtattctcttctgtaatactttccgaattaatgaaatactcatttttatacatcttcggtattttgttcagtctgagtactggtcttacattatatctgtgttatattaattatgtgggtagcctaccagagaggtgtaatggtgcgggtttaatgtctggttaaccagttgctctatgtcgtgtgcgcgggtatagagtagtatttagtaatgtaagtgtggtacttagattattaaatatcattaattgggcatatatgctgcgggacagtagaggtgggccgctgatggtgatagctcagtactggtattcctccacgttagtatatattcctaagacaaattcctggggagggtactcctccgtatttagccccggttggacggccatgataggttgtcgtaaggaactgggcaacccggggtggtctctcgatgtaccaggaggacactgtaggggggtattggccatatgattgtatattagcagatgtaaactaggaattgagtgtatgttagaagtatagtaattgagtgctttctattttttcttccacttagttagaattattttattatgaggagttgaatagctttgcttcgtgtcactctacccctatattaaaattaacctctgcttagattttgataaatacaaataatgtatgtataaagagtattagcatagtctactcatattatcttcccttggaattaaaaatacgataccttggaatacttccgggtgaaatgctacaatagtatatccgtgtgcttgcggataacttccgtaaccataaatataccaggacaatttctgcgccattgctgaacagtgactactgtgacgacatgggtatcaagctctgcttcacctcacccgcccaccccaagagcaacgttcaagcggagcgtgccaacacggaaatcctcaatggcctcaagacgaaaacttacaacgtcctcaagaagctcggggactcatcgatcttggagctgccggcagtgctctaggccgagccgcgcaatagaagaaactccatgtttcctcgtgcacggggctgaggcggtcctcccatccaagctgaccctggggtcaccctgggcatcactgtataacgaaaatgatcaagatcagcttcgacacgacgacctcaactaccataaagagcgaaggcaacgtgcagcccttcgggctacccgttaccaacaaagcctgcggcgctaccatcagtgcaacgtccgggcctggtcactgcaagtcaaagaactcgtcttgtgccacgtcccaacgcgtgcaagattgagcaaactctcacccatttgggatgatgttgagggtcgttagcgatcaatttcgaccatcaatattatcaaaataaaggagaactagttatgcttgcactgcatatccatgttagaataacaatattccacaagtgttaggttcattaaccttttgcagagaacaaccataaagtggaagagaaccgatatcaactcaaacgataaattaattggacgatgtcgagaatcagacttatgtccgaatgggccaagaactcagaattgacacgatcaattgggccaaaattcacaagtctgcgaagagaagcaacagaggaggcagccagccaaaacctgggctggttgggccggcacctggttcggccgaacccccctggcgccgttggatgcagggtttcttctagacggcgtggatcactccccaatgatggttggagggcagttccgaccattccaactgccacaaccgtcattggcagcctatttaaggagctcctcttctctctccacacacgcacctcaagcaagagctctctcatattcactcaagatagtttagtagtatcaagctagtggagtaggaatagagtagaaatcggagtccggaagccttcagaagagttcgggtatggctctagtagctcttctcttctcttttgtaagctctgtacttttattagaatactattctatatacatttatggtattgaaatactttccgagtacatgggtacctactttacattatgttcatgttatactgaatatacagctagcttatctgggagaagctgtggtgtgggtataatgtttgcttaagcaattactctatgtcatgatgatgatattagagtagtatctgttagtttaggcgtggtatctagatttggggatatcattatttggggttatatgctgcagatgagaggtgggccgctgatggtgacagctcagtacgggtattcctccgcgcgtgtatatagtcctaagttaattccctggggagggtactcctccatatttagccccggttgtatggtcatgatgggctgtcgtaaggaactcgacagttaggggtggcttctcaaagtaccaggagggcatcggatagagggtattagctagtatgtcagataactagaatgtatgtatactatgtatactagaagtataggaatagattttctttctcttttttttccacttagcttaggtaatttagtatgagaatgagtagcttcctgcttgtgtgtcattctacccttcgattatcttaacccctgcttagactatagttattacaactaacatataaattattagtcaggttctctctattatgatcttcccatgggattaaataaatacaatacccttcgaatactttggggtgaaatgctacaatggtatatccgtgcgcttgcggatgaactctgtaaccataatataccaggagtatttatgcaccattgctgggaattatatttctagtaatgtcgtttagaaataccaacaagcatttctggcaccgttgctggggaagatttgtaatagagattaccataactagtactttatattttcctctgtataatcactgtcctttgcaggctaaccttggttgttttcacttttattatggaaacagggtagtgcacgactggttttaagttgccagaaaacttcaaagaaaatccagaagctttcttctggagcgtcaggccgcgagtcgctgctcgacagaaaactctaccaacagagaaaccagccgtaccagcgtcaccgaccttcaagactatgactaacaagactctccgtgaattcgctgctccctctgctgacaatgtgaccattgggccacaaattaacctgggagacgtggattttgatttgaagtctagcctcatcacgatgcgcaggctagccctttctgtggcaaccaaatgagaatgccaatgctcatttacagtagttcctagagatttgcagcacatacaccatgaagggtgtcagtccaaacaacgttaggctacgactgtttccgttttctctccttgggaaagcgaagaagtagttttatgctaaccatgctacgatcaatacctgggatagatgcttcacgacattcctctcaaagttctttccgatgggcaaaaccagcgcccttcgcggaagaatttcaagtttctaggagacaagggacgagtccattcctgaggcacgggaacgacttcaagaatatgtggccgcctgtcctcatcatgggatggatgactggctgatcttgcaaaatttctataatggactcactcccatgtcccatgaccacctagacacggcagctggatgagatttcttctcaaagacggttcgaggagccatcgatttgatagagaagatggtctctaatatgggttggagcgaggaacgactccaaacccgtcagcgaggcatgcacaccgtcaaggagatggaaatgctcgctgccaagatggacctcctcatgaaatgattggacgaccatgacaaaaggccacaaggcatcgtcaaagccttggactcacacgttacatgtgaagtctgcggcagcacgggtcattctgggaatgattgcccggaaacccatgaattggcgatgtacatgggcaacaacaacaatgggtatcgtccacaaggaggtcaggggtggaatcagccatgcccatattatcaaggagctaacaacaacggtaacttttctaaccaaccctccttgaaagatctcgtttttgtgcaagctaagaccactgatgctttaagcaaaaagctagctgccaattacaagatcttagaaaacattaatgttaagctagatagcttcgcttctgctttccaaaaccagctgagctttaacaaaatgatagaaacttagttagctcaattagctgccttagtacctgcaaatgagtctgggaggattccggggcagc

SEQ ID NO: 4945 - DNA, 1066 bp, Oryza sativa
ttgtgcaagctaagaccactgatgctttaagcaaaaagctagctgccaattacaagatcttagaaaacattaatgttaagctagatagcttcgcttctgctttccaaaaccagctgagctttaacaaaatgatagaaacttagttagctcaattagctgccttagtacctgcaaatgagtctgggaggattccggggcagcggactcctccattgaaaatgttaaggtgatcaccacgaggggaggtaagtccacttgtgatctgccatatcctaaccctgtaggaactaacaaggaagcgccatctggtacttcagctgacaaaaagattcagctagagaaggttgtgccacaagcatactatgacacgcaattgctgccatttcctcaaaggaacaggaaaccgtcagtggacgagcagtttgctcgttttgttgaagtgatctagaagattcacatcaatatgccgtagttggatgctatataagtgctaacatacgcacgttacctcaaggatatcctcaacaacaagagaccgctcccaacaatggaggtggtcaagctgatggagcagtgcaacaatgccatactccacaagttcccggaaaagaagaaagatccggggtgtcctacgatcacctgctcgatcggggcacaacagttcaaccaagccttttgtgatattggagcaagtgtcagcgtcatgcccatggacgtctttgaaaagctcaacttcacgatgttggcaccaacgccaatgcacctgcagctggccgactcattagtccgttacccaacagggatagcagaggatgtgccggtcaagatacgggattctttcatcccagatggtttcgtggtgctggacatggaaacaggaaaggaaacactgctcatcttggtgcatccattccttaaaactgcaggagccaacattgatgtgggaacgggaagtatccgtttccgtattaacgggaaggaagagaaatttgagtttcagccaaggactaaacactgctccatggtcagaatcaagtacgggccaaacctaaaaaatatcctggtg

SEQ ID NO: 4946 - DNA, 2224 bp, Oryza sativa
caaagccacgcagcaaatatgcaagtgcacaggataacaaaggatggcatagtagggtttcatttgcaaaagcagcatttagcaaacatttgagaattataaaacagttaagtgataattaaacaatattaatccaacactatacaacataccctgttgcataggcccaaccattctgaacaaccaccccggctgcacagttctatctccaaaccaggaatgtaccattccaaaccaggagctaatcaaattattaccaatttaagcatcttttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaactatgctatacaaacgataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataagccatcatgaaataatagtgaatcataagttatcccaatagtgaatcataagttatcccaatagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggtttcggtggaccgggcgcacgggcggcggttcacgcgaacggacggccgagatcgatccaatccaaaacggacggccgagatcgaacggtccacgaccggctcacggcggacgaccccgatgacgtcagcgatgacgtcaccgacagcggcggcggctcggcggagcggacggctcgggtggcgcacgctcgccggcgaacggcggcgctaggacgcaaacggagggcaccaggacgtagaggacgacgcggcgaactcaccggtgaccaaaacggcggcggaagatcaacggatggcgacggcgacgaggaggaaacggcgaaaaccttcgggttgacgacggcgacgaggctccggcgatctccggcgacggcgaaggggcggacgaggacggcgacgacttggcgaccacgacgacggtcttcccgagcgacggcgacggctgaaacgacggcggcgcacggctggagcggcggcggcgacggcgaagctagggcacacggcgctagagctcttccgacgacgagaggcgaaggcaagggtggcggcgggtagaggagacaccgggggtccatttaaaggggctcggaggcggcggcaaaggcccacggcgggcggcgacgaggaaggaaagattggaagaacgaatccgagacgaactcgaatccaactcattccaaaacgatttagccaaagattccaaaggagaaaaggtagagaagatgccggagattgtttcccctcaattgattcggccggaaacggaaaggaacgcccggattggaaaagcggcggcgggggcgcgaaactaggtgtacgcccgaaggaggacgacgatcctgacaggagggttttttaaatgcaattccatttattaaaaatactttcttagctcaaataaatcccagaaaaatctgggaattatagaattaagcaaagtatttaatgatattttatctggccccattttatattggaatttattaattaaaattagatcttctcttctaggcttttaaaattatttctaaaaattccaattaaacaacaatttatatattttgaatttccagggtgtgacaaacctaccccccttaacagaatctcgtcctggagattcggaagaactggtgaacagatgcggatgagctgacttcaattcatcttctcgttcccaagttgattcttcttccgagt

SEQ ID NO: 4947 - DNA, 4064 bp, Oryza sativa
ccgcgccctcgggtgcggctaacgcgtgggacccacggcgccggctggcgtaaaccgcgtgcacccagtccaccgtggaccgtgaggttgctgcgtggccccactcccgtggaccggtccgcgcgcccctcccctcggctgacgcaataaatccgatttttaattaaaatttaaatgaagaaattcgcaaatatccatttaaagagcatataaacttcaaatggccataacttggccatttgaactcggaattggaccgttcaagtctctagtttttccttaagaagtcaagaacccatttttgtgctttgtttctgcttgttatatggggtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttacaaaattaggttgatttaaattattgcattatcgctttatttaaattcccgcgttatcactgttttatttagccatgcctatttacctttgttatgaccttattattattgttattgttattattaccttgttcaccctagaataaacaaaaccccaactagtggacactctactcatagtaccactagtataattttaggtagatgcttcgcaatttaattaggtaacattaggcggtttacaactctagactttgggaatattcatatcacctggacactttggaatggtttggttgttgtggaattggcttcacaccgccccctctattcaaaatccccaaaatggttttaggctgggctcggggtgcatggttttgatagtagcacctcggccatataaggaccggttttcgggcctctgttgcaaagcactaccgtacttccacatgtctagtaggtaaggcttagtttgtggctcagtctagttataaacaaaagtacacggatggagatggacgaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttatcaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagttctaggatcgtgtttacaaaatagctttgagcaactaaatatctttaaatgctgtttactgcaaccctaaccctttatagtataactcctttgtactcccttgcatttattctgcacttgtgggtgtgtcttgttgagtacggtggttgtactcagtcttgctcaatttttcccaaccccagaagaggagcccctagaagatgaaggctttggtgtctagctcgtgcctgccgtcaagtgcctgtggtcgtcgccctagtcttccgctgtttctcgtttgtctctgtgtgtgctgggccttcgctgcccatgtaataaattaactatttacgcttccgcttgttaaactttgaattgtatcaacttttggtgtaccttgcctcctgggacaaggattaatgcacgcacgtaaggaacgcccgttgggttatttccggtcgtgacaagttggtatcagagccacccttgaccctaggacgagccgtagatcccaagccatagcagtattttcgaaataaaaatcctttgtatttgtgaaaaccctctagtctctctctgtcttgctgcttcatttatcgccaaaatctgacctttttaaatgttgcttttctttttggttttgtttgtagatggccggcagcgtcagccgtcgtggcttggacatgactggtttcgtcttggagctgcggggcatgtgcgttgtcctggggtatccgcatggagtggactaccaggccaggccgctttcggatcaggagggtgacgatgcagagccccacgctgcgtgggaggttactgcagtgatcctcactggctctcccgagcggacttcgctggcagtcaccgcgggtggagattctttccccgccgcttaccaaaacgccgctctcctcgccatcggcactcttcaccagcgctacccggacgagttgtagcacttcgcctaccggtaccacccctgccgtggaggagcccgcgactacgccaccttccgggatgctagctcgaagaatgacgctaccatcgtgcacctggcgcgcatggtggaggcgtacgacgcggctcgtatcgacttccatcagatggtgcgccgtgggatggtcgagaacaacttgaagatcctggagctgcatcaggagaacctgcagctcaagaaggacctagacgcagtggaggcgcagctgcatcagctcaagatcgcccagggagaggtctgccgccccaagcgccaccgcgtctaccgcagccagaagatcaccgcccgcaaaagcacctccaggcccgagcttgttcgtcagtccctggcgtggacctgcttcgtggagacccctcgtgccgagcccgcgcccgtggttccccaggaggggaagcctccggcgttggtagcacggaggatgcgctgttgctcaccttccgtcctggcccgtcgcagcggtagacgagcagttagtaggcttgcgcgtgtgttctttctcgtttgtcttcttgttggagtcgtgtggggcatggttatgccgtgtgtggtataactgtgtcggagcctgtctttattttattcgtctaagcaacttgaactttaatgaaccaatttaatagcagtaataaattcaagaattatggtagtcgtgggtggttagctttaattgtcagctctctctctgtttgctggttctgtgtggggttttcagatggtgatgaccaggagaagtgctaataccggtgatggcaaccaacctgaaggcagcaaccacaaccaccagggcaggccacctccacctcctcctccgcctccaccaccaccaccagataccaacgccattctcacccaaatcctcgcccagcaggccaacatgatgactgctttcctccaccaacctccaaaatccgccacaacagaatgctccaccaccacccccacaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggcccgtttcaccgccgctttccggaggacccatgtgcctgccggagtcatggcccttaagaaaagggaattccgggagttgaagcaaggcaaccgctctgtgatggagtatttgcatgagttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagcgccgcttggcgaatttccgcaatcaacagatgctaaccaaagggtccgctacaccaatccctatccagggggatcct

SEQ ID NO: 4948 - DNA, 470 bp, Oryza sativa
attgtgacgcttcgcgccaaggattggggtgcgtgctcatgcaggacggtcatgtggtggcctatgcctcacgccagctacggccccatgaatgcaactaccctacccatgacttggagttagccgcggtggttcatgctctaaaaatctggcggcactatctcattgggaatcgctgtgaaatatataccgatcataagagtttgaaatacatcttcacccagtcggatctgaatcttcggcagaggagatggttagaactcatcaaggattatgatgtgggaattcactatcatcctggtaaggccaacgtggtcgctgacgctctaagtcgaaagagctattgcaacactcttaacgtccgtggcattccacccaaacttaatcaacagatggaagccctgaacctaagcatagttggtcgcggattcttggctgcgttggaagccaagcctaccttgctcgatcaa

SEQ ID NO: 4949 - DNA, 1897 bp, Oryza sativa
attttcaacgaaaatttattgtgccacgaccacattgaccgttgaaacccaacggccaaaagtgcggccggtgggcccacaggggttcggccgaaccggccaggcaacggttacatgccacttttggcagggtaacggctagtgggtcccacatgtcatttctaaccattgtaggtgtccaatataagccagccagccaagagagggaattccatcccatttcaacacattttcattccctctctaaaggtttctctcaagttcattcaagctttgatagttttccttaaattcaaatacttagttgcatacatacaagttgctttggtgaaactaaccagcgggtgaaattcttgctattctaaccctcgccgagttagtccgttcttgctccattgtgtagaatgaggaggcgattgtctcgtttgttcaaggggtccgactcttcatcaagtcatcatgactagtctatagctcgttcatcagccgatgtctcgatggaggacgccgacgctccgcgacgtctcctgaacgacgccgacctcgatcttgtcgacgatcgggaaagacaagcttactacatgctgagtaatcgggagtatgctcacacgcgagaatactctccgaagctgctgaaaaagataggtatggaaacagacttttgtgccatctggaaagctgttggttggcagagatttactgtggtagatgagcctggttctcgtttacttactttgcaatttttgtgcactttgaaagaaatagaagatggaatttccttttgctttttccataaataatacacacttacatggaaaggattaagtacacttcttggttttcacgattcctgtaaatcaatctccagaaatgaatttttaggttcgagaaaaataggttttgggaagatatttgtggtgctccaatttgcacgaaagctaggacgaatgacgtccataattctacacttaggctcatgcacaaatggattgttatgactttgtttcctagaggtgatcttagacccattaggggggatgaattaattatcttgtttgccatggttagaaagatcaaagttgctcctgtcaaatgtatgataaggcaatggttagaaagtataagattttttgctcctgttgagtgcacttccttgattactcggatagcaaagggactgggggtcatcaatgaccagattgcttatatcttggccgcttgtccctgtattgataagaattatctagtgcaagggcacattcttaaacatggagtagatggatctttgatatactttttccccggttgtacaaatgaaatcccgctgcctaatgcggggtatcatttgtacaacttccataaactaaccattcccctgcatatcatagaagaatctcgtgtaggtggaacatacagggagacacgcaacgtggcaagaaaggaacgagaaggttcatcatcctcaacaccgtgcagatgtatgaggcaggttgggaggcaacttgggatgcgcccggatggacccaagctccacgccacaacatcggagtctcaagctggacaagtgccagtgaggaccggtggcgtgcacctcatgacatacagtgggggacaaccaaccctccagattaagcagtatgcctccatccccaagtgaatggcgctcaagttcctctcgttgggtcttgagtgaaatcaccagcagaatgtataccctcgatgtgcagacgggagatatccaaaaaaacctcgcggaacacatagcacagacgcaagaatggtaacagactgctgatgctcagttcgccaacatcaacaacatacatgatgcagtaacagcacgacgaccttcaagcatactttcgctttcaggggttcaatcattatcaaggaccct

SEQ ID NO: 4950 - DNA, 757 bp, Oryza sativa
agaaaagttatgcagataaccgacgccgtgacctggaattcgcagtggatgactttgtgtatcttcgggtcacgcccttgcgcggtgtacacaggtttcagacaaagggaagctcgcacctcggtatgtgggtcctttccgtatcattgctcgacgcggagaagttgcttaccagttggagctgcccgcctccttgggcaacgtgcatgatgtgttccatgtgttgcaactcaagaaatgccttcgagtgccatccgagcaggccgactcagagcaaattgaagttcgcgaagacttgacctacgtggagaagccagtgaaaatcctggacccatggaacgcaggaccaggaaccgggtaatccgtttttgcaaggtccagtggagcaaccacgccgaggaagaagctacctgggagcgtgaagacgagctgaaagcagcccatcccgatctcttcgccagttcttccgaatctcggggtcgagattccgtttaacgggggtaggtttgtcgcgtcccaaaacgactctaaaacacatcctcaaaattatgcttagaagaagtaaaatccttgtgaaagcctccaacaattaaaatgtgcgaagttaaaagtcgaataaggcttggaggatttttgtatatttcctaaaagcctaaaatgcgtaaataaattttagtggaattttcagagcacaaataataattaagaagaaataaacaaagttaaaatggttttataaaaagaaaaaccctaaaag

SEQ ID NO: 4951 - DNA, 1546 bp, Oryza sativa
  unsure (1)..(1546): unsure at all n locations
aacctctctacgtctacagtcgataattcctttgttctttgttaaccaatccatgcccaatatgatatcaagggtctgaggtatcaaaaccataaggttggagggaaacaccacatccctaagatgaataggtacgtcgatgcaagcatggcttacggttacctcacccccaggcgagtgtactatcataggctttctaactcctaccagagttaagttgtgctgttgactagcctccagggatatgaatgaatgcgatgcaccagaatcgaggagaactttaaccggggtagaattgatagaaaacatacctatcagtacgccctggtcttcctgggcctcttcagctcgaacatggttcacttgtccgcgtccaaatccggtggcggtcctgttagtctgaggagtcctgaacagacctcgtccagcagcaggggtagcagccccgtgaatagccattgcattagcttcggtgcgaatgggtgtcttgtttagatgaggacattngttggcgaaatgcccatactcttcacaattgaaacagcttnctggcctcattactncagtagcggcctgattccgtgcangagcttcgntctgaagtgtaacccgcctgtggaagtngctatgtgccgtaggaccggttcgttgtaccaaccggtggntttcatcctgatgaagtagcttctttaggatgcttgagtgcgaacttgaggtggggntcatgggcaagctnctcttacgattgtgctncacaaccttnncnngtcgtttncaanctcacgaccttattgatcaaactcttggaactctnattgatcttggccaatcataggcccacgcaactcatcattcagcccttctatgaacttgtcgatcttttcctcttcatctgcgaggtctacgattgcgtagcgggtcaactgagtgaaccggtttagatattcttgcaccgttgtgtttacttgtcgcggacttctgaactcggtcttcttcatacgcatcaccgcagcaagcacgaagttctcatgaaaagctgcagtgaattcattccaagtgggttctccagcatcttcttcccgagcttccttgtaagtatcccaccaatcgccagctggtccctccagttggtttactgtgaagatcactttgtcggcttcgcgcatccggacaagggtcagtttcttctctatgatgcatagccaatcttctgcctccataggcttgtctgccgtagcgaatgtgtgtggcttagtcctcataaactccaaagctcgatcctcgacagttgccttgattgtttgcaatggtttgcagaagttgggtttgggtggccataacgccagccagggtggttaggtcgggtgattgagtctcttcattgctggttgacgcccgacgtcggcttgccatctgtgtaggccgattaggtaagtaacctagtttcctaactagcccttatggttttattctgttaaggaaattgttttgatgtgaacttcgttttgcaagcatggtggaataaactcattcataacacaacagt

SEQ ID NO: 4952 - DNA, 2364 bp, Oryza sativa
ccgcctcttgcgtcgtcgccggccgtcgtcggttgtcgtgggacgttttggtgagtaccatcggttcgtctcgtcgtcctcttcgcgtaggtgcccttggataggccggccgacctctctatcgccggcgaggtcgtctcccgtgtcatgccggcgatgatgacgtcagcatgacgtcatgattccttttttccagttttttctaatagattaaatcttctgaaaatcatatctaaataaccgtagctccgtttcaggtggttcaagttactaaatttttctaaaataaagatctacatattaaaattgtccataaattgaattaaatttatttaattctttttaaatgggctttaattagatttaatcttgtaaaatttataataaattcacttggagtcagaataaggccgttcaagtctcataattcatctaaaatcatgatctacatgtttgtttactttatatgtattgtttatttggtttttattagtcttttacttcgttttgcgtgttagcttgtcgtttccgtcgttgcgaaggtttgtgagtgcgtcggaagtgatcaagaagattaattgaagaccgattattgcaaggcaagtcacacagatcctaaacacattcctttgagcatgttgatcctatatttaaattctctatttaattcaactgtgcatttattttcgaatgtcactgggtggtgtgaacctattctttgttatggccaatttgcattgattactctattccttgataccttgggttattataatttgactagttgagctttatatattggttcagctagatgttagacataattgcttataccccggttgagctgcctgtgggagtggagccggagcttcgctagaccgtaattccgctgctattttcttttcttttgtaagtatgtaacgttattattatgatgaatctgtatattaaattgtcagtttgtgtacctcggctgattcctagatgaggattttatgcacaaataagttcggaaattactagtgaaattcgatcctcgacggttgccttgattgtttgcaatggtttgcagaagttgggtttgggtggccataacgccagccagggtggttaggtcgggtgcttgagtctcttcattgctggttgatgcccgacgtcggcttgccatctgtgtaggccgattaggtaagtaacctagtttcctaactagcccttatggttttattccgttaaggaaattgttttgatgtgaactttgttttgcaagcatggtggaataaactcattcataacacaacagtaaaatatcataaataacaacacagagttccacagatagtacataaatcatgatacaatcgactgcacatatacgcagtccaaataaagttcatccaaatggtacatcgaactaatcatcaagctactcgtcaatctaggtaggggggtgtgtctcgcatgctatccaaaaaccatctgaagcgagatcgaagctgcaatagtcctccagtctagtcatccaaccatccgcaggaacctggggcaggaagagggtggtcgctggctcgtgcaaacctgagtccccacggctcggaagtaggggtctctggatctagcttgggcttcttgcccgagggtcgtgtgctcttgcaggcagtgctgagggtacgagggcctccgacaaaggtgatgcggtggacaggagtctcgtcctctgaagggtcggtgatgtccggctctatctctggctcggtgtcggtcccctctgtcttggagtcgacctggatcggagtctccaaactggaacccagctgcggtgaaagagtggagatcagtggagtgtgcacaatcttcggggcaggtggctgtgtcactgtcgggtccaccaagtaaggtgctgactcggtagctagcatatcaacctctcccaacagagcgtggaacgctggcgggtacggcggggtaaggaagaagtagcggtcacgcctgtcacatcctgattttcgtttcaggatttataaattatttaataaattaatagaatttatattaaatgttcattaatttacaagtgaagttaaatgtgggaaataaaatttcataaatataaagcatggttggatttaatttttattaaattctccatgattaattatactctctaaaattttctcggattttttcggagctcaattcctaaatgatacaaagaacagttaagtaattagtaatcaattaatgatctaattataatgttaagtgcttttcttgtttaaaaatccttaatttatagattgttgtctaaaagggaattattagaaatgatcttaaaagcctagaagagaagatctaattttaattaat

SEQ ID NO: 4953 - DNA, 2296 bp, Oryza sativa
  unsure (1)..(2296): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttactttatttacttacctttttactttgactttctaaactttattcaaattaatccaaaaacttgtgctattaattggataaaggtcttaactcactcctttcacttgtctttagatgccgcgctacaagcctgagtacctgtttggtgttgagggttttgtccaggagttgcgtacgatgtcctttgtcattggatttgggactgcccctttttatgcccagattcctcatgatcgtcatgaagagaagtgtcgagtcaaagtcactttgaacagtaatagtgaagaggtcccctcagtaatgttcgaagctggaggaagaactacatccatgcatgtcaggaggtggcaaggatcgccataggagagctccgcgatcgctacagtgatcagttggccgacactgagtatcgctaccatcctcgtcaaccacagggaagtgaccgtggcagttaccttgagactgaaggaattgaaaatgatgctaccacaaggcatttggttgagatgttgtgggctatggatgaaagtcgtgcggagactgtgttagcagctcaagatcgtgaagatcggaatcgtggtaagatttgtaagctcgaagacaaggtggatcgtttggagaaggaactagccgcattgaagggagaagcaccgccgcagaaggccaggattcgtcttaccgcaaggaagagagctctatttgtccctcgttatcaattggcgccaaaggttcgtgtggtggagaaagaagttgccccaaccctagcggatcctccggtcatgatcataagtgatgaagaagaagaatccaagcgcaacaattccaagattgagtgggtagcaactcaagatgatgaagacgagccaaatgagccttcaatcgacctccgatgcttggaagaactagagtagcttgttaagccgttgtcttagatcgttgtgttagtttgcttgctttaagttggttgtgtgtgtgggtcttgcatgtgctttacatcagtggtgggatgtaagtgcatgcgtttgtttgcttttgagtgttaggaagttggtgagtttagtggtgtgagagtcttcagtttgtaataatgaaactcagttaagatcaataaaagctaaagtaattctctgtcctaaatagtttcccctggtttctcttcttgtgccctgccagatggtgaatactcgcagcaacgggaatggtcccaacaaccccaataacaacaatggagagaatcccactcttgctcaagttcttgctcaacagacacagctaatgaacatgatgatgcaacaacttcagaatcagcagaaccaaggaaataaccatgtacctcctcagaataagttagcagaatttcttcgtgtgaggccgcctattttctctagtaccactaatcctgttgaagctggtgattggctgcatgccatagagaagaagttggatttactttagtgcactgatcaggagaaggtctcatttgcatcacaccagttgcatggccctgcctctgaatggtgggatcacttccgccttaacaggactactgctgaacctatcacttggcttgagttcaccgctgctttccggaagacgcatataccatcgggagtggtgtctctcaaaaagaaggaattcaggtcgcttacccagggatctcgctctgttacggagtatctgcacgagttcaatcgtctggctcgttatgctccggaagatgtgcgcaatgatgaagagcgtcaggagaagtttttggaaggacttaatgatgagctttcttacccactcatgactggagattatcatgatttccagaagctagtggataaggctattcgtcaggaggacaaatacaatcgcatggagcagaagaaacgtcggattgctcaattcaagacacaacaggggaataatcagaagccgcgtcttactttaagaccccagtccatgccacatggaggttcttcgtttgttgttcgtccgcagcgtcagttcttcaacaacaatgctggcaacaacatccgcaatcaagctccacgtcctgttgcagctccaacacagcaacaacctgccaagagggagcaaggcagcaagcccgtggtgtgtttcaactgtggagacccacgacattatgctgacaagtgtccgaagccccgacgcgtgaaggctgtccctacccagagcaactgtacggtacca

SEQ ID NO: 4954 - DNA, 2042 bp, Oryza sativa
attgcccttggctaggcctggagttggtcggggagagacacaacttctttcatctacaacaattctttgctgaggctgtcgatgcaaagaatggttgctaagatttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcactgcagttgtaacaaacaataactttcttacactcgggttcttcatcttgtacttgatttctcagctgctgtattggaacttccaaaggtacaacgcagatactggcccctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaacggtgaccttggcggggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgaccgatttctccacaacgagagcatgccttaagttctattttattctggttaaagccttggggagacttcgcatcttcatcatctgaggagacttgatctgaatcttcactaccagacactctacctccattagctaaaagatgctctgtcaactgttgtgcaccttgggaggaatttcttctctgatgttttgtcattcctggtggaggccattctgtgctggtaatgatcatcttacggacttcatcttcggttcgcattgggcttttcttttctgctgaggacagttccttgcgtagtgcccttgctcatcacacataaaacagatgatacttgcttcttttgggtcaacatgtggcatggcatgaggggccttctgggatgttggcggagcgctgacttgtggagagagagcttggactgcctccaactgcacttgatgttgcatctgactcgggttcaaaattgcaatccaatgctgctgtagtatctctataagcaattggttctggttaatcaggtgttggacactgccacacaactggtgtctggtgcttcattcactcggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaaacaaggaaacacacgactaacgactctaccctagagggtggcttaggttctgcgacgggttctccaagatcttcactcctgcttcacagctggcttcactgcttcctccacttcactagcggatccttgcagtcttccggagcttcggcaaacaattgacgacatcttcttcttcgcaaagctgaccatctagtactagttgaaaatccgaagaaggaagaacggagaaaccttttgcaaatagcattaggggaaggagaa

SEQ ID NO: 4955 - DNA, 3576 bp, Oryza sativa
gcccccccccccccccccccccggtcggtcgccgtcgccgccccgggtaggaagagagccaagagaggaagagaaagaaaaagaaagcgaaaagagaagagagaaaagaaagagagaaaaagaaagaaaagaaaataggaaagaagaaaaggaaaaataaaagagaaattaggggagagattaggaggatttaggaaataaaaatggttggggtttaatcgtagattatttttggaaattcctagagtgtaatagtatttcgatcggaattccgggttaattataggaatatatttctcgatcggattttattagaattggtggtagtgaagtatttgtaatttcatgaaatattttaggatgtataaatcgaaattcgatttgcctatttcacgagtagtataattaatataaaagaatcgactttcgcattcgacttctatttggatttatttggatttttatttgaattctaaccgaattcaatcgaattttcgcacgtaattttagagcccgagggagttgcggatccgagcgaggaccaagacccgcaaagcttcgaacaaggcaagtcatcactattccttgaacatgttgatctcatttgcaaaattattttgtttacaaataaaattgcatgcaatgatgaacatcctacttgtgattatgccatgtcttgattattgtttacccttaaatcctataacaatgatttacgtataagtccctagacaactatgacaaatgcttagaaatgctactctagatttatgcatactcatatttatcaaatgctatgtgcttgggcaattacctttgggaaggtaattgagatgcggcatgtggagacatgagcgccacattgccataatattaatgacatgatttgtgaaaggaaaataaaactaaacaaatgttttcgactggggcggatggaggatttgggtggtatccggaaaaggctagtgccgtccctggtcaattaaggaccgagccatgaagttaagcctgaaacgactcccgtacaaccgtacttctcgaatgggtatagacctagcggattagatagccgagcggaggcagtatccatgcatagtggtttctcattgagtgaggcaggtgcgctacggtgggacagccgttgaggtagggccgcgaggcgtgccctacatcggtgtcgccattggtaggactgccatgagtgtgcgagaaaaaacttaactttaaaccacaacttaatatgtgtgtgagacttcttcccccgggagcgccagaactcctcacactgctagaaacatggacgcctagagtgtatgaggatgtaaagttcatggagcgggtactgccaatgcgaggttatcgaaaggctttgccgtgacgcgtctcatgtgttgggacgaggctcatgtgttgggcagtcgcggagtgcgggtaagtgtacatccactgcaatgtgagtaaaccaaatctattcgaatagctgtgctcgcagttattgagcaccgggacatgtattacacttggctagactctaaattcttaactgtgtgggatgagatactgcatgaagattttttttatgctgatggagccacttcctaagaggagggaaggtggacgtcctcagaaaaccatgacgactcaatggcgggaagctatccttgggatcacaatggatggtggacagaactgtcgttgtctaatgtgaacattggtattaaaacttgatcagtctatgataggtcttaggcttgtgaaaagaattacaaaacttgctttgcgcaaaagaaccatagccattctttgaataccctctatcatgtgcattgttgctgtggtgacttgctgagtacggttggtactcaccctttcaatatacaaactgaatcagaggtaggagttgaagcttcggaggatccctacgcttactaccaggagggtgatgaagtcgatggcgctcagtaggtcttagttacggtcgttggctgtggcaatggcgtgccgctgctttaactccgctgccttatctacttctacttttggaatgtattccggaccgttcggtcctatgttctaagactatgcctgcgggcctatgatgtaataattcgcactagactctcgtgtatgtgcacttggtatttcagctatgaactcgtgagtaccagactacttgatccagggaaatggtactgtttacacgattgattcctgttataaaaacgggggtccacatacatataccttgcacctatatctttgagatatgcagcatagtagcaactcctgatcaacaaccaagtcttttgtttcctttcgtcctttactcaggacgagcaaaggttcaagcttggggggttttgttgacggtcgttatcgatcagtttcaaccgtcaatactaccaaaacagaggagaactagtgatgcttgcaatgcataaatatgttagaatataaatattccactagtattaggtatactaacattttgtagagaatgacaaaaaaatggaggagaatcgacatcaactcaaacgataaatcaatcggacgatgtcaagaatcagacttatgtatgaatggggcacgaagtcagaattgacatgatgaattgggccaaaattcacaagtctgcagagaaggatcacagaggtggccgccagccaaaattgggctggattgggccggccccaggttcggccgaacctccctcatcgccgctggatgcagggtttcttctggacggtgtggattagcttccaatgatggttggagggtattttcgacattacaactgtcacaaccgtcattgggaggctatataaacccctcaccttctcacttcactcacacaccttaagcaatagctctctcatttctctcaagtttagtttagtagtatctagctggtggaaaagaaatagagtagaaatcaggagtccggaagccttcggaagagttcgggtatggctctagtagcttttctcttctcttttgtaagctttgtagttttaatagaatactcttctaaatacatttatggtattgaaatacttttcgagtatatgagtacctagtttacattatgttcatgttatactaaatatacggctagcttatctgggagatgctttggtgcttatacaattactctatgtcatgacgatgatattagagtagtatctgctagtttagacgtggtgtctagattacgggatatcattatttggggttatatattgcggatgagaggtgggccgttgatggtgacagctcagtatgggtattcctccgcgccggtatataatcctaagttaattccctggggagggtatttctccgtatttagccccggttgtatggtcatgacgggctgtcgtaaggaactcggcagtcaggggtggcttctcgaagtaccaggaggacatcggatagagggtattagctagtatatcgggtaactagtgtcacaccctaaaaattcaaaatatataaattgtggtttaaaatggaattttagaattaattttaaaagcctagaagagaagatctaatttaattaataaattccaatat

SEQ ID NO: 4956 - DNA, 2044 bp, Oryza sativa
  unsure (1)..(2044): unsure at all n locations
ctttgattatgtcgggtccaaacaacgcaggttctccagtctcggaccacattagtggggtacggcatcgtcgaccaaataatgcctcatttggcgacatctttaggctagcttggaaactgttgtcgtagaagagttcggcgtagggcaaacatttctcccaatccttgctaaaatccaacgcacaagctctcaacatgtcctccaagacctggtttgttctctcagtctggccgtccgtttgtgggtggtaagctatgctaaaagcaaggtaactccatagggcttcatgtactttttcccagaaatgcgaggtaaactgtgtgcctcgatcggatataattctcttaggtacaccatgaagacatactatcatggtcatgtataactcggctagcttgacaccgctatagtttgtcttgacaggaataaatctcgccgtcnnnnnnnnnnnnnnnnnnnnnnnnnaaatggaatcataaccatatgcggttttaggcaatccaacaataaaatccatacctatctcgtcccattccactcggaaatcctaaggggttgcagcaaacctgccggtcgctggtgctcagccttcaccttctggcatacgtcgcaaagtgctacatattctgctatgtctcttttcatgttggccaccagtatccttccttcagatcctggtacatcttcgtacttccggggtgcaatgaatatgctgattcttgggcttcttttagaattaatcccctcagtccaccctgtttgggtacgtagatcctcttcttataccatagcgtttccttctcatcaattgagaattctttcgcacgtccagcggccatgcgctccttcacttcttggatcacttcgttgtccttctgggcttcctctatctgggttctcaaaagagggtgaatgtccagggtgtttatctgtccacgaggtactatatgtaggtttagctgggctatttcctctttaagctcaggagccatcccttccattctcagatgattgcaatggctcttacaactcaaagcgtcggccacaacgtttgctttgcccgggtgatagtgaacctctagatcataatccttgattaattccaaccatcgcctttgccttaggttgagatctgactgagtgaaaatatatttcagacttttgtggtcagtgtagatatcgcaatggtttccaatcaaatagtatctccaaatttttagcgcatgaaccacggctgctagttctaggtcatgggtagggtaattttcctcgtgcggtcgcagttgtcgcgatgcataggccacaacctttccgtcctgcatcagtactcctcctagtccttgccttgatgcatcacaatatataacaaagtctttcctattgtcggggagaactagaataggcgtagaggccaatttttccttgagctgctcaaagctttcctggcactgttctgaccatacaaacttcttttccttcttgagcagttgagtcattggtcgagctatcttagagaatccttcaataaaccttcgatagtatccggccaaacctagaaagctctgaatttcggtcacagacttgggtgccttccattccgtacggcctcaactttggcaggatctactgctactccaccggctgagatcacatggcctagaaaggcgacttcctttaaccagaactcacatttactaaattttgcatatagcttatgcttccgaagtttctcgagtaccaaacgcaagtgctctgcatgctcttcctcgtctttggagtagattaaaatatcatcgatgaatactaccacaaatttgtccaagtactccatgaacactttgtacataagattcataaagtataccggggcgttggtcaaaccaaacgacattactgtgaactcgtacaatccatagcgtgttaagaacgcggtcttgggtatgtctccgatcctaatcttcagttggtggtatcctgatcgaaggtcaatcttagagaacaccttagctcctttaagttgatcgaaaaggtcatcaatccg

SEQ ID NO: 4957 - DNA, 11031 bp, Oryza sativa
tgcattcatgttagcagtagaagaaacagcctgaatcaaagcggtagcagaagttctcctagaaaatgcaccagcaccaagtccagatcctgcactggcaccagcatcaccaagtccagaacctggactggcactagcaccaaatccagagacctggactggcaccagcaccaaatccagaacttggactggcactagcaccagcattaccagcaccaagtccagcaccaagactggaaccacaagcagcagcaccaaaaattttcccccaagctgtctttttcttaccagaagaagagcttggggttgccctttgtaatgtcacagcaccaaatttactttcatacttagcatacatgtcagacaatgcagccctaacctcatttaaatatgcagagtaatcaccactaataagttgtcccataatttggagaacattgctaaaacccctgatcttggccctaggatccaagataaaagcaaatgaatacagaaatggaatctcagaccagtatgacaagaacttatttttcatgggaacaacaacatttctaaggttccaatcattctcataagtatttagatgtccagcaatctcaagaatgtgatgcataattaatggagatgttggataataaacaccagacaaaataacagttgaatcataaaattgttcaaggaataaaagaacagtttcagcaattgtccagtgtaaatcagtcagtaatggctgaccatcagccattggatggtgagatgcaataaacactgaaaaaatgaccctatgtggcaagagatgcttaagcattagataagttgcattccatctaacatccatgtccaaaccaaatttacgaggacgaatacctttagcaatgcagaagtttttgtataaagcaatgcgctgattagatgcatttataaatgaaatagcagttctaaaatcttgaagcatgggtttgaagatttctagaccagccttaacaattaaattgatgatatgacatgcacaacgctgatgcaaatataaatcaccaatataaccagacagagcaggtttaagactatccattgcttttgaattagcagaggcattgtccagggtaatagagaagatcttattagtcaaaccatattcttgaacaacagaaagcacacgttcagaaatattttcagcattgtgtgacacatcaattagcaccagtcccaaaatcctcttctctaattgccaattagaattaacaaaatgggcaacaacactcaaataatcctccttagcattaccagaccatatatcagatgtcaaagcaacagagctaacagacttcaaagtatcaataagcatagcacgtctcttgtcgaagaccttaaaaacgtccctactgatagtttgcctagagacaacactaaatctagggttgtgagcattctgaatatactcctcaaaagcagcagattgaccaaaagtaagtggaagatcctctctagcaatcaacctaaccaactcagttctagccacatccggtttatattcccattgactaacagaaccatcagcattaaacctaagcatggactgagacaaagcaccaacatttctaggtttgcacgatttaatatgcctaagcaaatgtccagtaccaccagttgaacgagcagacaatgttttatgacagtaattgcatttagcagaaacgcgaacctgagcgccattgcgctcttcaaagagttcttcaaagtcgtcccatacctcagacctggacctcttgttgctagcacttgagccagacggagcaccgttgccatcggcaccggtaccatcatcgtgtggctccggctgcgacagatctctcagaggtgaagcagtgttgccaaacacctcgatgcgttcctcctccaagtcatcttcgtcatcaccctgcgtccccatcaccctcgcctcgtagttgcatgaggttggatcaccatccatcgcaggcactccggttcctcaacggtggctgccgcctgccgctcagcgacctgcaagaacaaatgaaacaacgacgagagcagagagtagttacggatctgatcgaatagagaaaataaactaaaaaaaaagcttgtacctgcgcatccggagcaccggagttgccgttgatgatagagatccacagatctacgagaagacaagaggagagactagatttggggggtggatgagtggatctgagtatctgacgaagagaaacgatgagggttgcaaaaaaaagtacagaatggagaggaaatcgacaatgcgaccgtcgatccggtgaccggagaggcggagacgaagagctcacggtcacagatcagccaaagagatgaaagaaaaggatagagaagagacgacccttaaagcccccagcgggagcccgctgacccttggtgctagatccggcgaggcattcataggagacgcctacaaagagggatggaggcgtggagggctgaggggtcggagcctgtaggtggaggcggagcggccgagcggctgatcggtcgagactccagactgatgtggctagggttagggtttgtcggtttgatgcggtttggggtatttatacccacccggcataacaggcctcggtcgggccgtgcctgccgttggaccgtgccgggccgtgccggcccaccgtgccgacctctttcgtgccgggccgtgccggcccaccgtgccgagggagcggcccaagcacggcccggctgttgggccgggccggcacgggcacgaccccagtcgggccgtgccgtgcctgggccgggccaatttgttgtgccttgggccgggccgtcgggccccgggccttatggccatctataagttcgaccacagaaccagattattcatgcatgacttgggaatgaaacaacgtgtataagtggtctagctggcttaattgttgagcatgtaatgaagcaagtagggagcctagtaaaacttacacttgcatgacttgggagcctagtgggcctttctagcctggcccatgtgcttgccaaaaccgccggttttgaggtgtccggttcgccggtttgaaaaccgcccggtttatctgatttttactggttcaattgtatatctagtccttgcagcaaaccgaaccggttgaggagctggtttcggtttttcttggtccaaccgccgggtcaggcccctttttttttactaggatggtcagtgtatttgctacatgataaaatttttaaacacgtggaggctgctgcaattttttgtggcacatggacacgatatgccgtgccacgaaaggacgcagttcacgcaagcatgaaaagattcctaccagtaagaagcaatatgtttctagtactgttggacggtggcaccagttgtatatgtacaacaaccaaacccagtgtgtatgtacagctattgccgccgtccaacagtacttccaaacatgaggttcgaaacttgtacaggcatccaggatgtttctgtgaggtgaatgtcgaattgtcgatggtgctttctctagtaggatgtaccgctgcaataattagggatgaaaatgggagcttctagcttgcaacggtagtctcgcatactaaaattccatgatgaagtgtcctgcaatggtgatgatgatagtagaaaatagggaggcatatgtgtagcacaaatagcaacaattaatgaaccaaataaatagtcaagcagaggtgacgacaatagagatctgaaacgaacctgaatcttgtacgttaacaccggccaccacagaaactataaccataatgaatgaacctgactttagcatcatgtgccttgacgctagagagaatccactcagtacaactgagttttccctacttctacaatctactactgattttatcaagttgaataatatgctatcgtgttttcttgaacctatactacatgccatcgtcatctacaagccgttagttgaacatctgttagagctttagttgaacatctgttagagctgaaaaaaggcctatttaccctaactcatgttttattgtgtgtcagatactacttccttttacttctccgcgctcgctacctttgttttcaaacttacaactgcgttgaaattccactgcctttttctttcgaacttactgctgcgctgaaattccactgctattttatttcaaacttgctactgcgctgaaaacctgaaattcaccacattttgaccccccataatacgcttaacaattccggcattattactacctgcatttttttttcgcagcagcatttcgttcaactgcatcaaaatgtacatggacggatatttgtataacactcagaaaaaaaaaatccattcccatgccactttactcgcgcctcgtgagatgactaatacagattacaaaatgagagatgactaacaaacgttgattaccattcactagcaaagcaggagcaacggcataagtcccatacagccaggttcagagtcaaaaaaaaaaatcacaagaacagtagtacagtcggccggccagccagcggcgcgtcgatgggatcccggcgaccggccgccgccacgcttcgatggggagcccagcgcccggccgcgcgtcgatggggagccgggcgcttggcagcgcgtcggggactggggtagtcagcggcgcgtcggggacttgggcggccggccttccatcgatgggagtcggcaccgcctcacactgggcagatcaatttggggcaggagcacggctacggttttcagccaactagtgctatagtgaaaggatattttagtcattaagaaaaaattcaatacatcaaacgggtgccaactaacggcttgtggacggcgatggcacacagtagaggttcaagaaaacacgatggcatattattcaaattgacaaagttagtggtagattatagaagtggggaaaactcagtggtactgagtggattctctcacgctagagacccaacatctcaatgtcatggttcttagcactaaatactggttataagccaatatctctgacgcttagccactactagaaaaactatttttttcagatgatagcactgtcgacgggggatacccgtagaccggatatagagagtattggggtccgttagtacgaggatctacatagtacgacaacaggcaaacaaaagaaaagaattatactggtttaggccccttgataggtaatagccctaatccagttgatatgggattatatgatggaaaccacaggttacaaagggaatagcggaactcaatgataccgatgagaccgtagtcgagttggttcaactagatctcctggcgacttggctcctgcacgctccggctccgtaggctgtggtggatgttttggcagtaatattcgatgccttaggtcctgccagggggtcccttatataccgcgggttagttgatcctcaagtaggactcggagatatcggacccctcacgatacagtaaagactcaatctcgaccgagtaggactcctcccatccgtagattatgtttctatcacgtgatagatttgcttaacgtatacggaaactatccgtatacgcgtgggtataccgtattagtatacagcgtacatccaagggtagagggtatatcttatccgtaacactgatagtagccccccgacttctgcttaaatgaactcatgttatcgatcgcaacttttgatgtcgaaattgttatcgttctcatctgatcgatctcggtgtaaaaaaccgtagagacaaagagccatcgacaacaccgcgtgaagttcaatggtcatgagtgaatttaaattgatgtctgaaaactaccgcgcgtaacagacctagaattttccggcggcaatctctctcctttccttgggatacgcaccatcgatagtgcgcttatttatagggatttcgggaatccattcgaagtccgtttgccagaaaactctcttgccttgtagcgctcttcgtcttctccgctccccgcaaagaaaaccctagcttatttccttcatcttattctccagcgatcctttggcggcgatggatcttgagtagtctaccttgaacaccgcattcctgaagaagctgtaggacgacggtgccctccctagtcgcgggactttgcaaagggaggctggaggtacagaacctgaactcatcttgggccccatgtttgtggtcgaggattatatttcttgcggttttctcccttcgccttccgaatttcttcttctagtcttgaatttctacggcctttctttgtttcacttgaaccccaattccttcgcatttcttagcatcttctctcatcttttagaggcctacattggggtagtgccctttcttgacctcttttgcttctattacgaattgcgtttgatggaatccaacagggtgtctggatgcatcggattccgacttcggaatggcctgaagtcgcgttatatccccttccagtgcccttcttattgtagcaagtggcggacgagatggttctatctctagatagaaaactcggaacccgtccttgttgtccctaaggatcagccagaagaaatcccagagtggaccgcaaaaccagccctgactccctccctccaatctttcatcgacatcattgatgatctccgaaaacggcggttgtcgggatacgaagtcgctgtcgacttcgtaggtcggtggattgagccgctgcaggcccgtgcccatccggcctttgaatactctgggccagaggacacgacccgggtctctcctcagggtattttttctcgcatttctaattttgttccgagtgcatctgtttctcctgacttatcgagttctcgttctcgatttataggtctggacagcgacactgtgggacgtcacgttggtcagataatgatcagcgcatcctcgaaggcggacgatatccccatcgcactctgcaacaaggacgcgaccgaacgcgccgccgcgattaatgtaagtgtattcgatgattcctttacatctctcttctcggggtcgcatcgtgacttcacgttgtgcaggctctccctctgacgtacgccatcggacctctcgtggatcaccaggcggcaacatcgttgaaggagggcgttgccaaggaggcatctgacgctgttgctggtggcagtgttccgaagaaagggaggatattctcgtccgtggtcaggacccgctggaaagcgacaagctccgcggtaagcctctctctcgttctttagtgcgtagtcggaatgacttgacctcacaccatttcatcttactcatgactcggacgcatctcctccacctcagcaaagccagaggttggtgacgatcagcaagaagtaagtaaacgttcttgaggtcttttcattctcgaagttttgattgtctaccgtcatgaagtaaaggaaaatcttcgcagaatggcgcaggcgaaggtggcgcaaggggggactgatgctgcttccagcgtgtaccctgtggcgacttcgactggagtcgtggtcgctactaaggaccaagaagcagcaccgagtagccctgccgtagcctcgtgcctacccggggtttgtccaccgatgccctcaccttggggggagctccaagcggagatggagcgcatcctctaggtcggtgctcgcggcgtaggccgcgagatcaaagaggtgaggccggcggcgtcctccgcgaatcagcgtaccgatcagctggcgcgcgatctggcggaggcccgcgaggacctcttaaagatgagggagttggtagccggaaatgagatgcagcggcacggacacgagcaccggatgtcggagctcgagggcgacatgatcgacatccgaggttcgctgtgaatgtcgttcactagcctgcaccaacttgccagggagtgcggcgccatgactaccatcccggcgaacctgatgagttctcactgacgtcatcactcacggaactggctacgacgatgggggaggtttgtaaggagctccgagttccccgtggagaacccgaggagtcagcgactggttacatctcgtggttgaatagggcctgcacacagctcgaagggattggcaagcgcatcgatgaggccctgaagcaggagtgccgtcgagcgagccgctatgccggaggacatgtgatggcctgtatccgagatcaccacccgcagctgcacctcgagttcctttgtgaagggttctcgcattctcggaggacgcccgcggagatcgacggtcttgtgtagtcgatggcgccgcttgccgagaaggttttctgctccatgcattggcgttggccgtcctggtagcttttgtatcctatagaaaaatatctcaaggaagcatgtaatatactttgaagtatttgtgacttgtaagaaatacttgtaaaatataaatggaatctatctaagttttcttactctgggtacgctgtgaacgagtgttttctcactttccgacttcagccagtcacttgagccatacactctccctagctttgtgaattgtcgcgaccgagaaaattgccttttcccgaacgctagtgtattaatccccatcccaggaaaagccggggtacaccacacaaacatgatacaaaaggccaacctttattatatcgataatatttacattattacaaagacacttcaggcctgacaaacaaaaataaacagcagcggactagcgggcctatggctccatcttcataggcgctcaactggggtataagccaggactccacctaggatttcttctccaaagcttctctttctgaaggggggagagatagagcaagaatgagtacaaccaccgtactcagcaagtcacaccgggagatgcatgattaatgcaagggagtacaaggggtaataatataggggttaagttttgcagtaaacaacatttaaaagtcacttagttgcccaaagctattttataaagacgattctagagctacacaatattattaatcaaggccgtggatctacacgaacctgccttaatccaaggcctacgatgattcagaccgaactggcaacccgccctgggtcccagctcgtcccaagccaacccaggccaaccttttcacattttagttgttaagcaaattttaagaattaaaccactaacttgggtacattgctaggattgcccatatccgagggcacggctattcgaatagatttactctgatcagaggtgtacatctttacccacaagacacatctttactccgcattccatggccttggaacccgtcgtaaacatgtgacataacccttcacccatcctagccgtgaacaaaagtaccgacccaaccctgcctacagccggtatcccgggacaggcaggccaggattgagccattagcaataggatatagaccgggtgcgccacacgcataggggtgagaccacccgcatactagtcaagtgccatggcatctcgactaacgggcatcgacccgtgtagtcttcatttgcctagacatctcgattaccgagtcatagctcgtgtagccttcatttgcctcagagatatccatcgtcgcaacgacttcatccatctctatccgtgtccttttgtttaggactagactgagcaccgagttaagccttacccattagacatgtggttagtacggtagtgctttgtaacagaggcccgaagaccggtccttatagtggccgaggtgttactggcaaaaccctgcacctcgagcccagcctaaaactattttgggagttttgaatagagggggaaggtgtgtgttcaattccaacataagccagccattccacagtgtccaaatgatatgagcattcccaaagtctaaagttataaaaccacctaatgttgcctaattaatcagcgaagcatctacctaaattcatactagtggaaccgttaatagagtacccactagttggggttttgtttatcctagggtgaacaaggtaataataaacaatagcaatgataaagctataacaaggattaataggaagtgctaaataaaatagtgataacgcaggaatttaaataaagcggtaatgcaataatttaaatcaaaataatttttaaactgggattcaatatgcttaagggtgatgtgacttgccttgctcagagagaacagccttccgaaccttcggcgacgaccgcaaaccacgcttcgagaacctccggaacgacagaagctacgcgaagcaaacaagcaaagctacaagcctataaagaagtaataacaatacataagaagaaagcacacggttctttaggttataacaaacattaggagacttgaacgggtcgattcgggattcgtatgataaagatatgatcatacgaagtttaatgctgttatatggagatttacggattattatgattaggttttgcaattataaaacatgtgcaagcgctagcctggaaaagacaggaaggctgcgctgctgacatgcggaccccacatgtcaacctaatggacgacggtagaccaagtacacagagacgatccacgggacgatggaagcagacgccgtgtgccaaccgaggcgagtggcagacaaacggactccactagacaccacgcgggctgcacacgtgcaaaccacgtggctaccgagtggacacacaaacacggtcaccacacgcacccacgaatgactaccgacaccggtacatgggtaccggggtcgacaaacacacaatgggcatggggagacaacgaaaggacgaggacggggcagtgagaggacggatccttactaccacgcgacgaggcgtgggaacgacgacgacaaacggcgcggcagagatggacaggaacgacggagacgaacggacgacacttctccggcgatccttggacgaaggcaggacgaggccaactcagggcttgacgatgtggagccgaggacgaagacaacgacgaggctgcagcagacttgacgaaacgcgggcgacgaacgaacgcggcttgacggagggacgaacgccacgacgatcgagaa

SEQ ID NO: 4958 - DNA, 1761 bp, Oryza sativa
cgagcgcgacgaagacggctcagggacgacgaaggcgaccgcgaagggaacgacttcggcggcgatccttgcacgaagccgagacgcggccagcacaaggcttgacgacacggagccgaggacgaagacaacgacggggctgcagcggcacacttgacggacgtggacgacagacgagaacggcttgatggagggacgaacgccacgacgaccgggaacgacgagaggacgacgactggaaccagcgaggaggcgatgagggcagccggcagcagctgcacggagacgaggacggcgcggaacacgccactgcgatgccgaaggtggttgaggtgcggccgaccggtgcacgggcgaggagggacgggcggctgaacaacttcgacgaggcggatggagaggttcgtggcgatgtgcggcggcttccgggcgaaaccgaggggtggacgaggtggagggctacgtcaccgtgccgagggaggggacggcagcgccggctgacgcacgggcatggcagaaggggctgccggaggagacgtcgacgaggaggaaggagaggccggtgcgggcaacggcgttctggcgaaattcgggcgacgccgtggcctggccaggaaagaggacggcgtttcggtgccgggagaggtggtggcgacgtcggccggcgcacaggggacgtggcagaagcggccggaggcggaacagtggcggcaacgccactgttgccggcagggatgcacttctggaggtctccgcgtgaaacagagggcaggccggcgaagaggaggcggctgcgacgctagaggaggccacggcacggccggccggcgtgctaacgcggcggcaggggcggctgaagatggccggcggcacgggagagaggggacgacggcgggaaggtggctagggacctcgggaagactcgggaggaggcaaaaacgagagaacgcaaggagggggttccaatttataggcgcgggtcgggagctggccacaagagagggtggaacggcggcggaaaaggcggccggcggccatggaaggtggccggggttggcgcgggcgttcccgacgattgggggcacgaatcaagggggaaattagggggaattgaagaggaaggaaaggggattaattccccctaatcaattttggaattcccggtttgaatcgcgtggattttggggaggaatggcgctagggttcacgggagagagaggaggaggccggcggctggaggtcggggacgcgcctgacaggcgggacccacgcgggaggcgtcatcagcgcacgcacgtgcgcggcacgggcgggagggcgccgctcggcttgggtggggcggcttgggctaggacgtggcccaggcgggaggggaggaaaagggagctgggccgagggggaaggggaggcccaagagaaggagggagagaaggagagggagtgaaagagagggaggaagagaggactttggccgcgggccgagagagagagaggactttgggccagacttggcccaaaggaggaaggaggattatttttaggcttttctttttaataaactttgatcatagttggtgttgcttaataaatatttccggtgctctgaaaatttaagtaaaatttgagggctctttttagaccaaggagaatttaacaaaaattctccgggccacattcgaatttttcttgaacgtattttagtggttgccaatttcttttcgaaatttaaataattcgattattctttttagaaaatgattt

SEQ ID NO: 4959 - DNA, 9096 bp, Oryza sativa
gtttggaattttggataaaaattccgggcgtgacaaagaatcatccaatttggagttcatatgattgagataaactagtttatttttgcagacggctccttaaaatgctcgtatggaaaaattgattttttcatgtgggctcttaagtaagccgcatgcaaaaatgagctcatttttgcatgcggacctcttaagaggcccctatggaaatattaattttcccatacaggtgtcttaaagagtcgtatgtgaaaataaagatcaatttttgcagacgctgtcacttacggtccgtctgcaacctaaaggggtccttgtacagaaaattctttttttagtagtgagattattcaaaataacaacgaggataaactgtgttggaagcatacttctaatggcacatgcaacacaaaaagtgcatacaaggagatcattaaaaaggggagaaactgtgttggaagcatacttctaatggcatatgcaacacaaaaagtgcatacaaggtgcatacaaggagatcattaaaaagggggagaatcaaaatctgcagcaggtaagtgctcaaactacttacgtaatcaagaaaatttagaaggatgaactcacccttccaaaggtcaacgtctttgcttggagacttatcagagaggcccttccaacagctcaatggctaaatctcttagaatttctgatattttggctgctgcttgttgtagacgtggtcaacctgaaactgatttccaccttctctttggttgtccctgtagtaaattaacctggagaatttctgaagctaatctatctgttggcaactttttgtgacaagtcgaagcacgatcgcagcaccaaaacgccttgtggtgatatggagtcgccaactacctcgatctagccaaacggccaaatcaagatgggttttgtagaaaaatagctaaaccggcaagcggagccgatttagatatcaaaatcagcctctaggccgatttagatctatatgatgagaactatccgtctcgtgggcaaaacagaaggttttcaggacaaacctacaaataggtgtcgcactctcgcagcggcagcggacgatttacggcgcaaatcgacaaaaatggactacaactagagtaaagtagaaaacgtgattcaagtagattgtgtgttcggggtattacaattgaaccggccttgtcccttaaataggggttggtcttgccctctataggcccttctccacgtccaactcgggatagaaaccaaaggaatcccgaaacatgctttcccgagcaaggaaacccgagacccgacgaaaacagactcagactcggaccctgacagtctgaccggccatatacctacagtcagaccggagttcaggccgcggtcagaccgcctacatacttgcggtctgaccggctctgtgaaggaaacccggcactttccaaactttggcaattttcccctattttgtcgatagatgccaaatttggatgtaaacactatctactgacatctttactgataatttccctctggctcatattattgcttatattgcctctaatagctcacatcagttgggtttaaatagaactctcatcttaatgtggcagatgtggaaagccaggaatgacttgaaatttcagggaaagctgaaagagccaactaaagtttgttttgtatctgaagctatggcaaatacatacaccattttctctgctcataagtctttgcaggatgatcatcaggatatggagcaagaaagaagaataaaaaacattcccaatggaaacagatgctatgtggatgctgcatgggaaaatggcttcaccggcacaggaatcttgtttcacatgttgtcttcacataatgctcttttcatgctttgtggctcattcatctttgcaagccgaactggtgggtttgcaactgacaatgcactactacaatagctatttttccgtgcggttgttttgattttggcgtgcggttgttttgcccgtctggaacattgcgtctgggaaaatcgtgattttcttgtgcaggtggcgcaaccgcacgtgaaaaatccgattttcgcgtgcggctgcttatgcgaaaataaaaatccaaaaaaaaataaattttcaaaaaaacaaaccctaaccctagatctagatccggcaccccaccgccgtgccggccaccaccgccgccggatccgggcgggggactgccgccgccgccagatccgggcggggggcagtcgccgccaccggatctgggcgcggggagggcggcgctgctcccagccctgccgggcaccgcctcctcccgctcccggacacgtcgtcggcccgctcccggccgccgccttgccgccggtgtcgtcgcgcgcacgccaattcaggccaccacctcgtcgtcgtcgtcggccgcgtgcacgctgctccgagccgccgcctcgccgtcgtcgtcatcgtcgtcggccgtgtgcacgctgctcccggccgctacctcgccattgtcgtcgtcgtcggccgcgcgcacgctgctcccagccgcctccccacgtccgcccgccgctgccgtgagcccgccgcgagccctctgcgcccgctagccaccgtcgacccctccgccgagagccgcccggaggagaggaggagaaggtgagagagagagaggaaaatgagagaagaggaaactgagaagataagggggagggagagaggagagaggtgggcggggggagagagaagaaaagtccaattttttttgaataggatgggagggaagtgctattttcctatgcggttagattagaaggcccgcatgtgaaaatagagctttttttgtgtgcggccgtgttaagtgacccacacacgaaaatcaatgtgggcgacgctccccctatttttccgtacggtccaacgaccgtatggaaacaaaatagggtggcgtccagaaaagtcaatcatgtagtagtgatggaggtggccaattttctaaactttacagggattacctttctcacaaacgatgcaacaattactgacagtgccaaggatgattttgatacaggtcattggagtcttaggggctgtttggatgcttgcttcagtttaccaaagttctatagctaaggtgtggcatgccacaatttatgtggctaagaaattcttgaccacaagttaggtaaatgttggcaaaggtatgtgcctatgacaagtagggtcacaaaattaaaaagtgtggcatgataaagatgtggcaatcaagcaaacactaggctaaattggtcaaagtagcttgccaaagttgtggcaaagtatggtcaccatccaatcaaccccttagacttctttgaagccaaattaagagtgtgatcccagaaaatcctatgcatgtggtttggatctcaagaaaaatcaacagtgtagctgataaaatggcctaataagctacttcctccgtttcatatcataagactttctagcatcgccaatatttatatatatgttaatgaatctagatatatgtgtgtctaaattcattaacatctatatgaatgtaggcaatgctagaaagtcttataatatgaattggagggagtagaactcagcataacactgatccttctcaactgtaacatctcgcacattgcatctcgcacattgcttatcctaatagagattgtcatgctagaaatcttcaaaatgatttcgtttcggtgaactatactattaactatgtactacctctgaaattactattaactatgtactacctccatttcaggttataagattttctagcattgcccatattcatatatatgttaatgaatctagaaatatatatatgtgcctagattcattaacatttatatgaatgtgggcaatactagaaaatcttataatatgaaacggaggaagtactatgtttcttaaaaaaaaaggggagagacgtgagaggtggttgaacatagcttatagctatgttcccaacccctctcccgcattttccgcgcgcacgcttttcaaactgctaaacggtgtgttttttgtagcaaaaaaaagtttctatacgaaatttgcttaaaaaatcaaattaatctatttttgaaaaataatttagctaatatcgctccgttttccgtgtgggagggtaaggttcccaaccatgcccagcaaacacaggcatagacctctagagcgcggcggacgaccccatccacgtggtaggttccatatattgccttaacaccctcagaatgttgggattcaaaagattaaaaagaggtgccgccacacatgattttttatctaacaaggagaacttttacctctaagaacttttatctaataccggcctaattacggtgtaaaagcacaagagaacttttgaagaccgcattttcgccattgtagatatatcacctctatatttttaccacgtgtcatttaaccattgggagccatttaaactgcctgcaaacaacttttgcctcttgtatacaatgatatgggaccatactgcaaacagcaaccgtctactatgtacatgccacccctaacaacttatccctaaaccgaacagaatcctatcatataactacaagaatttatttaatctatgacgaaaaaattcgtcatggatcactgaaaattcgtcacaggaattttcccatgacaattatacttatcgtcatctattgagcgtcaaagattaaatttgctgacgttttctccgaaatcgtcacagatcagcacaatctatgatgttttttaaccgtcataaaatgcttatgggctcgtgtagtccagcccaggcccaacctttgtgacgaaattaaacgtcatggatggttgccatgtggcggctaacatggcagttgacgtggtcgtttggacacgtgtgcgatgacatgtcactgatgacgtggcagctgacgtggttgttttgacacatgtgcgataacgtgtcactgatgacgtggcagctgacatcagcaattgttttatacggcccgttatttttttgacggcccattaatttttaaacagcccattaatttttttaactggcctattttaaaataggcccatttcagaactagcctattttgtcaaccaactatcagatcaaagcccactaaacagacccattaaatttgagcccaccaaattcaatccaatttatcatacaatctcagattcaaaccaacacatctcaacaaacatccaatacaacacaaaatttacaacacagttaacagccaaatctagtcacaatccaaatacaatcacagtaaccaaaatttcaccggatgtcgcatgaccaagatcttccaagtgagcttagcagcactgcatatgcacaagataaaacatcaataactgccatatcatcctagtttcttctactgttcaagcacttaatagatgaataaaaaatattcatgcagttactgatgtcacggacatgctgcaatgtcaggatcgggaggagctgtctccctctgtatgttatctccacctgcacttcgcacatttctgaaattttcagttcatctcagttcagcattttgtaacaaagaaactaagcatgctcagagatcaggcaaaacaatatatatatatttaccccttttcactgtggaaataatggttttcacgcatgagggagaggcaccctcaaatttccttactaaagtaacagttataggtgaaaaaaacaaccctacttccgatcctgctaccaaataaatagcccagttctttcgtgaactctgaaaagatattgaaatgcttttgcacttgtacagtggaaaaattggtaaacaaaaagaactgccagccctggtttcttcctattatcccttaatttaaaaggaaaagactgacatcatgctcacaaatttccaaaaattgggtataaactgaggcatcttaaactgcaatgcaactgcttagcatagtataacatgagaaagcccagccaaaagtttgctagatagccaaaaaaaccacttcacatgttaggaagaaacatgccactacagttttgacattcctgagcaccacatatggtggcaaccaatcctttttacatgaataagataaaaggagtcatcagatttgacattcataataggatttcacttattactttctaaaaaaaggtgaccataggactcataggaactcaccaaaagtgaccatgggaaggatgaaagttgaagcaaactcagcaattcgcacaggaaaaacagcctcatttcaatttggagcacatccaaaacctctacacagcacaccaatacatctctagttgcatctgtagcccatctaccgcagcaagaacagcaacaatcacgagggggaaggaagattagggaagcgagtagggtggatataccttgatgtagatgttctctgtttactgatagtttgctattactgtttgttaaaaggaaaaggaaagatggctagtcctgtttttgtagaatatttttgcagcatgcacatgtttaattgctaattgcaaattgcagtacataaaaaagtggtaatcttttatttcaggtggatatgatccagatatatatggactattggagattagtacttttgatttcatcttactgttaacatttatatatttcatattttctgaaagtacgttgaagtagagtttaccattcgatatataggaattgtgaaaactgctcaagtgatggataaataaaacactacataatgcaagtctcttgttcaaaagatcatgtcttacagctatatgatattatattggtttctcattctgcttgcaggtcagatgataattcattgaggttgattgccatagattgataattctacaggttaggagtagtacttataacgtatagatgcaattcagtttcaacagtcatgaagtgttgatgaattatgaagagctcaagcaatacatctctagttgcatctgtagcccatctatcgcagcaagaacagcaacaatcacgagggggaaggaagattagggaagcgagtagggtggatataccttgatgtagatgttctcggcagccttttcctcctcgccgagcaccttgccgccggaggagaggagccgccacagtgtgagccacgccggcagcctcgcctgaaccccctcgcattgactcccttgcctgaaccccctcgcattgactcccttccgccgccgtaccaggtcaccgtcacctccaccgaccccattcacgccggcccgcctccgcggctccgccaccgcctcgctgccggcctgcccgacgggccctccgtctctggcgcgccgctgtcctccgcctctgcgacggcgccaccagatccgccggagcaggctgtcactgtgcccgccgcccgccgccgagagccgagctccttcctagggcggcggatccggccttccctaggacggcgccgccaaatccaccgccgcaggtcgttgccgccgcgcctccttgctgccaccgccgctcccgctagagttgggacgccggcgagattgccgaagaggggggggacggaggagcggcgagaggagcggagggggaggcggaaggggcggcgagatccgagggggctgtggatggtgggcgaagggaggaggacgatgacgacggcgtggtagccggcggtgtgagggtggggaaagagaaggtgaagaatggatggctagggtttggatatatgtataagaagctatgttgatgcgattttaccagaataaccctggtatctggaaacctattatacaagttacttggacaaaatggtcatttaacgtggaaatttcaaaattttgaaacttcaaatcgaattttatcataataaatgaacttatgtgaaaaagttgtttgaaacaaagttgtataacttactgagatctaccaattttattttggttatttctccatctgagtttcattggcctatataaaatttgaatttcaaattatgacaacttcaaacaatattttcaaaaactaaatgatctcaaatgaaaagttcatcaacaacaaaattgtataactcatcaatatctataacttttattttggtcatttttctatatgactttgtttcaacggtttgaatttgaatttcaaattatgacaacttcaaacaaaatttacaaatactaaatgatttcaactcaaaaagtcatcaataacaaagttgtataactcatcaatatatataacttttattttgatcatttcttcatccgacgaagtaatttgtaacattgttcacaaaatctacatatctctcttattttttataaacgtataagagatatgtacattttgtgaacaatgttacaaatcacttcgacgaatgaagaaatgacccaaataaaagttatagatcctgatgagttatacaacattgttgttgatgactttttcagttaaaatcatctagtacttgtaaatgttgtttgaagctgtcataatttgaaattcaaatttaaactgtttaaacaaagtcgtatagaaaaatagccaaaacaaaagttatagatattgatgagtactacaactttgttgttgatgactttttcagttgaaatcatctagtacttgtaaatattgtttgaagctgtcataatttgaaattcaaattcaaactatttaaacaaagtcatatagaaaaatggccaaaacaaaagttgtatatattggtgagttatacaactttgttgatgacctttttagttaaaatcatttagtatttaaaaatgttatttaaagttgtcataatttaaaattcaaattttatataggtcaatcaaactcagatggagaaataaccaaaataaaataggaagatctcaataagttatacaactttgtttttgacaacttttttacataagttcatttagtatgataaaattcgattcgaaggtttaatgttttgaaattaattgaaggacggagacaaaatagacttattggcgagggaggagcaaaaggcctgttacgggccagcccttttgctcatcccttgccgagaagtccattttaccttcctcctttcatttaaattcaaaatattaaacctt

SEQ ID NO: 4960 - DNA, 7676 bp, Oryza sativa
  unsure (1)..(7676): unsure at all n locations
nnnnnnnnnnnnnnnnnnnnnnnnnnnnnnnnnnnnnnnnnnnnnnnnnnnnnnnaagtgaactgaaatcatttgtcaactagtatttattaacaatcaagatatctcttgtcaggtgctccctccatccacaaaagttacacctatttcacatttgagttttttccaaataagttgtttctatttgtagtctttatgcattcaagacttaaatgaagagataaattaaatgttttattagaacccaaggagtcatctaaatactcattggttgcatgtttacattcactctttgatcttgtaacatccaaggtgatttaatttcttcttggtcttggtgagggagtacttgcaggatgctttcaaggtgccgcaggtgatacagctaactgacgatgaaaagtttatgtggaagaacttgactattgccgaatgtaaaaggcttgcccatgaaaatgccaaagacattatcacctgtggatttgacattgaaaaaactttcatttttacagatttcagttatgttggagggtaagattactagtactccctccgtttcacgatgtaagtcattctaccatttttcacattcatattgttaatgaatatatatatatatatatatgtatatatatatatatatgtgaacatatatatatatatatatatatacacatatatatatatatatatatgtatagaatcgttaatatcgatatgaatatggggaatgctggaatgactttattgtgaaatggaggaagtacttcctaactgtcgattaaaatataaatgtctggctggtcttttttttttcactcagctagcttctattctatgataaagtagtaaccctctatctttttttacagggcattttatgaaaggggcaattgtgtttttgcccttgctttacgattcaattgtgattttacccctgttttttagggtttgtgattttgcccctgtttttttaaatgaaggagccgtctgccccagttttgacagaagtttggtgggtccggaatttcagaattaaacaaagatagaaaatgttattatcatttatgaatgaccattctacccttggttcaataaaagagccaaatccccaatcccttactgtcccgattttcactccaaaaccctagctgggttgcaagcggcggcggcgacgcgcggccagcgggcggcatggaggagtggcggtggggccagctgccgcggaacagcgcgcggcggagtcggggcgcgggcagggaggcgctgcggcagcgcatggaggcgcggcgtggcggcctcgcgggtgcacgcgcagggaggcgcggcggccggcggccccgtggccagcgcggcggcggagaggagcggcggctccgtcggccagcgagccagcgagcagcgagcaggtagcttggcggcgggatggcgctgttaaaggatgtaggcaggcacggcggcgtcctcggtctggagcgcaggctggggaatcagggaggcgcgacttgccgccggcgggctggcgctcctaacctcttgccggcgcagggacggaggcctaacgctattgcaaatacaggattaggagacataatggagtaaatcttgtgcatggtggaaatctgctgcaaatcccctgttttctttcccattttcatgtcttgtatctgcgacagatttgtttggtgaatggtgatttcttcctggtaaatgtgatgaatctttttggtgaatttttgcacccgatgcaagttctttgaaaatgctgcagaaatgatgttaaattcttccaaaatttgtcaaagtttggtcaaattcgaaatatatgcacattatatcaagaaaggagaggcaaatgtgtaaagggtatacaagtccttctactgctaagttgacgctgttaagtgatgctaacagaataggggcaaaacagggacagaacagagcttcgtttcaaaaaagtgagggaaaaatcacaaaccctaaaaagttagggtaaaatcacaattgcaactcaaagtgaggacaagaacataattgcccctactaaatatgcttgaagtttccaaccgtgtgacatataacaatgtgagaactattctattaagattgttctctgctcttggtgttcttgcttaaatatttgtgaacaccatggagattcattacttatctttaagcgtcatgttttctaatactcttactcttggatgacagcttaaagggatatttggaattagtccggaagatcaaattggcaaggtcagctttcctcctgtgcaggctgctcaatcattctcatcatcgtttccacatctctttcatgacaatgatgaccatctgccgtgccttatcccatgtgctatagaccaggtatgatatctctggtctgattatctcgacagtacaacataattgcttttgtatctacttgctagtatactgataatatatagatttttcagcacaaaatttggacttagtttgtttcttcttgttcttttccatctctaaatttgaatttgacccactcccatacgcaaaagccaagtttagagccttgacttgtaaacatttgcatttaaagataccaaaatgttctacatgtttgtatatagccgtatcatccatgcatcgaatatgactgtcaacattcggaaatatcaatcattaatgttggaaataacccaactagcgttataccacatgtaataaaccagtaaaaagaacttccacgcaaggtggtgtctgagaaagggaatttctaggcagcctgcccttatctgacataattggttgtatatcttcttattggcattaaaatatgtagagagatttatctggcagctctaaatttgtactgagtgcttgtcaagtaaatatttttccaatacttgatttagtgatctactatcatgaaagcatatccgatatttctcattaaaggtactggagtgttggtacatatatgtatttagtttggcatattttgagttgcctatttaatcttaatttatatttatgcaggatccttattttaggatgacttgtgatgttgctcccaaacttggttttcagaaaccttcactgattgagtcaagatttttccctgcacttcaggtatttcttttagggagagcttggatgtaggactgaacattagagctggtgcaatttgacgacttgtaattaacttgctcagaattttttttggttttacttcgaataatcataatttcacgtgcattactttatgtcgattgcttgatttccttttaacagggggagagcactaaaatgtcggccagtgacccaaactctgcaatatatgtgacagataattctaaacaaataaaggcaaaggtttcatctggaatatttactcaatcacacgctttagttcggccatttaaattatggtatcttgtagttctattatttcataggcttataaaagctatttccattattttccaggtgaataaatatgctttctcaggtggccaggacaccgtggagctccatagggaacttggtgctaatcttgatgtaagctctttcccaagtattgaccactactgaacaccaaactactatgctagaattatgcactgtattctgagttttgcttagaaaacagaagttagatttaagaatcaacacgatactcgaatttgaatgatcagcagaagctaccaattctaatgcatgtagttagaagccctttgtgtttcttgaagaagccttctatgtccacatttcagtgctaatatgctgaatattgtgatcttcatttctataatctgcctgtaatattccagttaattcctgtatttctaaagaaacaccaaagtgatctgtgaattcttgtgttgttcaggtggatgtctcaatcaagtacctaaacttcttcctacaagacgatgatgagcttgagcacataaagaaggtgcatttcttattgtggaaaactaagttgcactaccattatatatgaaactcattatccattataaaatttatttcccaataccaggagtacaaggcaggaaggatgttaactggcgaagtgaagcaacgactcatcgaagttctatctgagctggttgctagacatcagagggctagagctcaagtgactgaggaggtaatgaaaataattcatgttttgtttgatcttgtcatgctttacaattgggttggttgcaagttctaattcttgtttctattgtacacacacatacatccgtatgcaaagattataaccaagtattctgaacgggacacatacaaatttccttgtttgtgtagatggttgatgctttcatggcaataaggcctcttcccaacatgtttggctgagcatcaagacaagaagagcatgacattttcgttgatcagcacatgtgtgtccccctggtttacttgttgctggactcttgtgaacataatgacaaaaagacaagaagtccttaggtttagttttggaggtatcactacaagaatctatttaatcagtgacgaaatttgacgaaattttcgtgatgttttcagagatcgtcacggatatgcaactatggatacaaggcccataatccgtgacagtttatcgatttcgtcataaaccggcccaaaacctgtaacgttatagcaatttcgtcgcgatttaaatacttcaaaaccatataagagatatgcaaattttgcaaattttgtgaagaatgttactatcactttatcggatgaagaaatgaccaaaataaaagttatagatattgatgagttatacaactttgatgttgatgactttttcaggtgaaataatttagtatttgaaaatgttgtttgcagttgtcataatttgaaattcaaattcaaattattgaaacagagtcatataccaaaatgaccaaaacaaaagttgtagatattgatgatttatataactttgttgttgatgacttttacttgtaaatgttatttgaaattgttataatttgaaattcaaattcaaattattgaaccagagtcatatagcaaaatgaaaaaaacaaaagttgtagatattgatgatttatataactttgttgttgatgactttttcagttgaaattatttagtatttaaaaatattatttgaagttgtcataatttgaaattcaaattttatatagttcaatcaaactcggatggagaaatgaccaaacgaaaaatggtagactaaatgatttctacaactttgttttttataattttttcatacgagttcatttagtatgacttttgtgtgttacttcacaatggtataataaaaaaaagaaaaaaaatgttaaacagagaaggaatgaaaaaaaggcctgttatgggccagtccttttgctcctcccaagccgagaagtccattttgcctccctcctttccattaattttaaaatattaaacctttgaatcgaattttatcatactaaatgaacatatgtgaaaaagttgtcaaaaacaaagttgtataacttattgagatctaccaattttattttgggtatttctccatctgagtttaattgacctatataaaatttgaatttcaaattatgacaaatttcaaacaacattttcaaatactaaataattttaactaaaaaagtcatcaacaacaaagttgtatgaataataaatatatacaacttttgttttggtcattttgctatatgactctgtttcaataatttgaattgaaccttgctatacacacgaagaaatctatacgaaattcgcacgaaaactacctgcttacgtgatttccatggctagaacactagaagcccacacaagatcacaggcctacaacactctagattattcaataagaaaagcccatatcaaattgacaggttcaatatcatgctactcattcagacttcagagcttcgtttgagtggagatgcagaaagcaaggatagaataaattcaatcagttctaaaaaaaatcaattcaatcaagcatatgagctaggtggcggctatatgtctaggccttaccgcctcagctgccgccacaatcagggtttacgattccgacaggcccttctatttcgggcactggcggaatttggaatttcgcgaaatccggtggaaaaccggtaaattccgaacaaatttcataaaccaaaatttgaatgcaaattccctgagtttgttgacaagttctcgaaaacctgtcggttttagcgaaattctgatcaaaatttcgatctgtaacctgtaatttggaccaactactaactgggcctagtacatgcaattcgggccatgtaagtgttttcttttttttaattctttattcttttctttcctggtgtaagttttagtaaatacacacaatacatcattttttttagaatatttatatcccaatatgttctatgaatatcatagtatttataagattttatttgtttttttcttttttttatcaattcaaatttgaatttggatgaaactcctcgaaatctcatacggtttctactttcgagcctcgtcggaatgtcgaaatttcgcgaaatccgaccggactttgttggaatcgtaaaccctggccacaatacgagcagtattgctttgcttcctgcataataggtacgatctaccatgcccacactaataataaaggcaaattttgtctacaggacactgtaatttcgtggttttagccgtaggacactgcccgaactcacttttggaggaaaacactctataaacatggtaatttggcaatagacatcgtgctgattaaaataataatttttggttgaagaggagagagaaatggcatgaaagttctaaaatacccttgggcccatatgtcatatcttccatctcttatctctatccccgctgcgccgccgcctcgatcgaggacctcagcgctgacgtcttccaggaacagcttgggcatcaccgcgctgcccaccctgaacgacgacgacccatcctccttcctgacgtcggcaaagctcaccatgaccatgagcttggtcgcccggccatggccgagcaggagcagcacggggtagaggctgtacagcagcagcagcagaagtccgcggaagagtcccccgacctccagcgcgacgagtatgaagtacgggaaggtcgacggcaacatgagctgaccgccctccaccttgcacaccgtcacgtccgccgccgccgccggcagctcgtaaacgacgacggccgcctgacgacgcgtggcggcggagacggaagatgagcatggaggcccgctgctcgccgacgacacacggctgccgctgctcgcagactacgcgctgctgcagggcgccgtcatcgactatgcggcagcgccggcgacgatggcctcctgactacgtgttgtgcggtggagaagaatgtgcatgcaggaccgctgctcgccgacgacacgtggctgccgctactcgccaactacgcgctgctgcagggcgccgtcatcaacgccgccgcggcgccggcgatgacgacagcctgacaacgtgtggtggtggcctgccgacggagaagtatgggcatggaggaccgctgctcgccgacgacacacggatgccgctgctcgtcgcgctgctgcagggcgccgtagtggacgctgctgcagcgctagtgtccgcggagtggag

SEQ ID NO: 4961 - DNA, 2061 bp, Oryza sativa
gcccggcacgactattggaccgtgcctggacctatgcctgggcacggtggcccggcccggcacggcacggaccgaggtcggcacgatgggccggcccggcacggcacggcccaacggtcggcacgaccacggcccgtaccaacggtaggcacgagcacggcccagcccaacagacagccaggccgcaccgcgtgcgcccgcatatataagccagcgaacgccgcgtcgccgcccctcccctccccagtcccctctcgcctctcgctctccgcctctccgcctaaccctaaccctagccgccaccgctcaaccgcctccgccgatccgcctccgacgctccaccgcccaccagatctcgtcctccaccgtccgccgctcactcgctcagggcctcaggcgcgcaccggtgagactcaccgagtcgcctcccttccactcttccagatccagccttcctcttcgtctccgatcgatgcctcgcctgactcgcatgaggggcgcatgaggatgggggccaccggccacgcatggtcgcctgagtcatcgtccttccactcttccaaatccagccttcctcttcgtctctttcccgtttgttcttcttcgccagatcccttggtcttctcgtagatccgtgagcctatcgtcttcaacggcaactccggtgctccggctgcgcaggtacaagcatggaaccattgtttttattttttttttctccatttccgaccctaaccttgagtgttgttggctgcttgcaggtcacaagcccgttgcttagcggcagccgccgttgagggaccagagtgcctgcgatggatgacgatcctacctctgtcaactacgagttgaggactatggggatgcgcggtgatgacgatgatgatgtggaggaggatcgtgtggaggtgttcggcaatacctccgacatcccgatccatgtgaatgtcgatgacgacgacccgccggtcgacgacagtggcaatgggacgtcgactggctctagtgcgacttgtaccaacaagaagaccaaaacctccaaggtatgggatgactttgaggaactttatgaaacgaccaatggtaatagggttcgagtctctactaaatgcaattactgtcataaaactttgagtgctcgttcttctgctggcactggacatttgcttaggcatattaagtcatgcaaacctagaaagcttgggtctaatgctttgcctcagtccatgcttagatttagtgcaaatggttctgttattccatgggaatatagtcctgaagatgctaggtttgaattgtgtagattgattgctagagaggatcttccaatcagttttggtcaatctcctgcttttgtgaactatattaaggctgctcataaccctagatttgttcctgtctctagacaaactactaccagagatttttataagttgtttaaggatcgtcgttctgttattattgatcgtctcaattctgctagctctattgctttgacatctgatatatggggtggtcatgctaagcaagattatttgagtgttgtagctcactttgttaattctgattggcaattagaaaagagggtcttgggtcttaggcttattgatgagtcacatcctggtgctaatattgctgagcgtgtaattgctgttgctaagaatatggtattactgataaggttttctctattacattaggcaatgcttctgctaattctaaagctatgatcaccctagctcgtgctctgtctggttatattggtgatttatttgtgcatcaacgctgggcatgtcatatcatcaatttaattgttaaggctgaacttgtcaagttctagcccatgctaaatgacattagagctgccatttcattcttgaatgcatctaatcagcgcattgcttcatataaaaatgtttgcattgctgcgggttatcgtcctcgtatgtttggtttggacatggatgttatatggaattcaacttatctaatgcttaagcatctcataccacatagggaaccattcacagtatttattagtacacaacatccttttgttaa

SEQ ID NO: 4962 - DNA, 742 bp, Oryza sativa
agcaaaaagctagctgctaatgacaagaccctggaaaatataaatgttaagctagatggttttgcttatgcattccaaaactagcttagttttaataaaatgatcgaaacctagcaggcacaattagctgctttagtacctgctaatgaatctgggaggattcttggacaacggacccctccgttaaaaatgttaaggcaatcacgacgagggaaggtaagtccacttgcgatctgacatatcctaaccttgtaggagctggcaacaacaatagggaagcaccatctagcgatgcggctgaagaaaaggtttagcaagagaagaccatgccgcaggagtactgcgacacaaggctgctgccattcccccagagatacaacaagccattggtggactagcagttcgcttgttttgttgaggtgatccagaaaatccatattcacgtgccactgttggacgccatgcaagtgcccacctacgcgcgttacctcaaggacatactcaataacaagagaccacttccgacgaccgaagtggttaaactaatggaggaatgcagcaatgcgatactcgacaaactccctgaaaagaagaaggatccggggtgtcccacaatcacttgctcgatcgggacacaaagatttgaccaagacctttccgacctaggagcaagcataagcgtcatgcccaaagacgttttcgacatgctcaacttcacggtgttggcaccaacaccgatgcg

SEQ ID NO: 4963 - DNA, 6372 bp, Oryza sativa
cttggccatttgaactcggaattggaccgttcaagtctctaatttttccttaagaagtcaagcccccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctaggataaataaaaccccaactagtgggtactctattcatggttccactagtatgaatttaggtagatgcttcgctgattaattaggcaacattaggtggttttataactttagactttgggaatattcatatcacttggatactttggaatggttggcttttgttggaattggacacacacctccccctctattcaaaaaccccaaaatggttttaggctgggctcgaggtgcgtggttgggttttgctagtcgtacctcgggtactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgagggagatgtgtcttgtgggtaaagatgtacacctctgatcagagtataatctattcgaatagccgcgccctcggttatgggcaagctgagcaatgtacccaagtcagtgttttaattcttaaaatttgctcaacaactaaaatgtcgaatggttggcctgggttggcttgggacgagctgggacccagggtcgggttgccagtttggtctgaatcatcgtaggccttgggttaaggcaggttcgtgagggttcacggccttgtttaataacattgtgtagctctaggatcgtccttataaaatggctttgggcaactaagtgacttttaaatgctgtttactgcaaaacttaaccccaatattattatccccttgtacccccttgcattaatcatgcatccgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaagctggtatcagagccatctcaactgtaggataagccaagtggataaaacctaaggacatattttataaataaaactatttccgaaagtccctttttcctcctttcccctgtgctatttgcaaaaggtttactcccttcttccttcttcagatttcaactagtactagttggttagttttgcgaagaagaagatgtcgccaattgttcgccgaaggtccggaagaccgcagggtccgctagcgaagtggaggaagcagtgaagccagctgtgaaggagtgaggatcttgggaacccgtcgcagaacctaagccaccctctagtgtttcgtttgttgtgtgtttccttgcttgtgtgtgtagtgtgtggtttgcatcggtgggttgtgatgtgaccatgctaggttgtttgcttaatcaacttgcagaataagtgaaacaaataacacatcagcaagaagagttagttcctttaaggtcctgtctctagttctggtctattctttcctggcttgtttcctctctcacctcaatccctgtaacagatgtttaacagagaaaaaggaaagaatgtcagcgggtatgcctcaagtaacccaagttttcaactcaatccaccactggcctcaagagagttaaccagggcatacccttggtccattccaagcatgctgcttagttcacagctaccattagttggaagtcaagaccaaaatcagtatgtgtttgatcgagcatttgccacccaggtcaatgagcttccaatgctagaagaggatgtccccttttgtcacgattgtagagagcaaggacactatgccctgaattgtccatgggtatatgccaaagaagccccttcctttggtttagcagggcagacatcgctaaaccagcctcctcgcaccaagtcaagcttgcagcctagtgtacaaaggagagagcctaatggagagaatccattgaatcccgggaattgctttcctcctagcccttcgtaccacgtggggtcacgtgctaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggtggcagagtatctgatagtgaagggtcagatcaagtctcctcggattatgaagatgagtctctccgacatctcggcgaggaagagatggaatcaaaagcatgcccccgttgtggagaaattggacacgttgctagcctgtgtttcacactctgcccttattgtgaggaagaccatccaccaggtaaatgtcccacccgcaaggtcacatgttttctgtgcgaaggtaccaaccatgtgcccaaggattgccaactcagtgtgttgttgaccaagaccgcagaaatccaacgaacaaccctacgattgtctcatcagctagtcagctccaacatcaacatcgacgatatcatccccagcaccaatgctcctcctgctgcacctgactctgcagtaaatcatagcaataataccttcaacaccaaccattctctgcaccgacggcctcagcaaagaattgtcgtcgatggaagaagttgtgtctctccccgacctactccaggccgagcgaagggcaatcaatctcaggagtgcgataccaagcagaagaccgttattcgcctcaatcagcaatcagaaggaaacttctcttgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaatatattcatgattataaacaatgagtttgttatgtttatggaagattcatgttgaggatgcaaggtaccgatgttaagcaccttccctttttgtttaaggcagtgccttgtattcatgtaataagggagaaatgtgtaataaaaacaagttctatgagggttattttggaagatgctgatatggaattatgtgtataattgtttactgtcaaaggagacctagggtctcatttcagaggaactatgttctaacctcgagttaaaaaccaacctgatgatagaaaagaaaatgccgagtccgggaagatatctgttgcttcaattgtcaaggaatgggtcatttcgccgacaagtgcccaaaaccgagaaacatagctgccagcacgtcagtccacgcaactccttgcaatcagaagcttgctcctcagcgaattgtcatccatgcatcccgaagcagtcctatagcccgcattgcaacagctccaactccagcgagtgcattaccacaaggtgtcaatgctcaatttcagccccagccatcagttgacaagacagaggccagtatcggcattgtacctttggatgttccagcacagcagccaagaaatcaagtacaagatgaagaacccgaacgtaagaaagttattgtctgttacaactgtagtaccggttaaggaagcagacatgccaatcgccaagtggtcactggagcaaatgcagtacctgataagcctaacgttagtcagaagcaaccataatactcttatatcagtgttcaaatacttttgttttatagttgttccccgtcaatcatgtaataacagagaaacatgagataatgaatgagcttgataagcttatgaaggacccatgttaagattgcaagtgctgtgagttgtgcacgttttgttgttgattagggagacctagggtctcattttcgtaaacccatgatctattaggaatcaaatagcctagcgattgatggcgaagaaaatcaagtgatcaaccaaagagacatttgtttggactaagagtttcagatgtgtctcttcggatcaaaggcaacaatcgtcagtctagcttttgacgaactacttcaaggtttctctgagagacagcacgcccaaggacctcattgccccagaagcatcctcaacacccggagcgaagagtacctggttgagaaaggtcgaaaggtgattaatggaagagatcggaaaagatgtttggttactgggaaaagaagtaggtcgaaaggtgattgataaaggataacgagaaccatgatttgtgtcactcgaggaagactcccgatagcaaaacaaccctacaacagttgcccggtcattaaagtaggtgaattcacgagtaagagagatgaccacaggtagaagtacttctatggggacaaggatggaaacttttgtgacatgaccaagaagtcaagaagtaaaacctgaacagtggaatctaaagctcggttcaaccttgggctttgtatcagatgctactagaataaaagcacttgcactagcatcgttcaacgcactttcctagcaatcgatccatcgagaaagaacacatcaaggctgaaggtgcaaaggaatacgttgaatgctaaatgatgacaacatgaagagaatagtggaaagtaaactgaacataaagaaagtgaatccgagttgcttgttcgtgagagctattcccagttatgaatcaagtgatatgttcgaagataatctacagaggtcagattaaaatcacatctaacaacgaagcctcagatttggcaggataatgattagacaataacaaatccagcagtaaagccatttgggaagacgtcaaagtatgtcaagtgggataagttggttctctggtgaagcataattcaaaggcaaagttatcgacccttgcatcaaatagcagaagtagctatcacccggagaccaggaaagctaatatgaggcagttggtggcaagttagaagtaaatgacaagcatgatattcttatgatgacaaacatggtatcctagtaatgacaaagctgatgtcgacgcatgtcacgaaggtggtaacttgtatgaggttgacgccaaagatatgaatgataagaagttctagaactgaagccccatcctcaaccaccgcagcctagtctgagtcagttaaaggtgcaaccagggacaagtcgggtgaagagaagattccatctgcaacaggagatcgagccaagcagtccagagtggagaagtttagttagacaagtttgttatagaagacagagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcgaacactaaaatacgtacaagaaaaattcaaatgtggcccggagaatttttgtaaattctccttggtctaaaaggagccctcaaattttagtggattttcagagcacaaatattattaagaagaaataaataaagttaaaaaggttttgttaaaagaaaaaccctaaaagtcttctttccccccctttccttctt

SEQ ID NO: 4964 - DNA, 2426 bp, Oryza sativa
ctgagtactgagggtgtactcattcttgctcaatctttcccctcttcagtaagagaagctttggagaacatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacactccgcgactgcccaacacatgagcctcgtcccgacacatgagacgcgtcacggcaaagcttttcgataacctcgcattggcagtacccgctccatgaacataaatcctcatgaactctaggcgtccatgtttctagcagtgagaggagttctggcgctcccgggaaagagaaatctcacatacatattatattagggttcaagttaagttctctctcacacacactcatggcagtcctaccaatggcgacaccgatgtagggctcgcctctcggccctacctcaacggctgttccaccgtagcgcacctgcctcactctggggtgaaccatctatgcagggatactgcctccgctcggctatctagtccgctaggtctatacccatacgagaagtgtggttgtacgggggtcgtttcatgcttaacttcatggctcagtccttaattgaccggggacggtactagccttttccagataccacccaaatcctccgtccgccccagtcgaaaacagttgttcccactttattttcctttcacaaatcatgtcatcaatttcatggcaatgtggcgctcatgtcttcacatgccgcatctcaattaccttcccaaaggtaattgcccaagcatttagcatttgataaatatgagtctgcatgatcctagaatagcatttctaagcaattgtcataattgactggggactcatacgtaaacatggttacgaaggaataagggataaacaataatcaaggcatggcataatcacaagtaggatgttcatcattgcatgcaattttatttataaacaaaataatttcgcaattaggatcaacatgttcaaggaatagtgatgacttgcctgctcatgataatccttattctcgatataatcttgatcaaccttcacctcctggaagttgctgacattgcctcacgactaaccgatacataaattctataatacgcaagaaaaaccaatattcaaacaacaaccaaatatgcacaacaaaatatactattcgtgtctgcttaatggattccaatcacgctaggggctaaggtttcttaatctttctattgtcaacgtggcctatttaggagttaaccaacatagcatttatgggatacatatatttttggctaatcggtggtttagtctatcaaatggctatggaaggattatggctatgtatgcatctatctaaataggacggttatatactagaggttctgttgttagatggatttaggatcaatcaaataattacagtgaatcatttgtattattattttattgatggaagctttactttaattatgaacatattttacttgtcacaataaattataaaaggttaataattatccatgctttgtatgttagatttgtttaggttaatcatattatggttacagattatcccatcacaaaattttacaatgaataatcctaatttacagttgaactataattataattatatgaggtgaagatttataactagtatttatctaatatacatgtttgtcatacactccctctaaattaatatatgcaacacgcaaattaatactataccgtacaactataatgggatgtatagtatatgtgtaagcaacaatattttattattagatcatatatttgagtatttgctttttactgtaagctatacaatacatgttgattttaagatggctctgtttggttaactaatagatatcaaccgactatatatatatattctacttcacatgacattgtatcaactaatttttaagtagtccaaatacaactagctctgtgattactctcctaaacaggttaaagattcatctatgtgtgtttatattttagttacaaaatatgaggctaaactttatgtaagtaatttataagtcatggatttagttatatttggacataggctagtgaatggcactaatattttcctttacacccattaatttgaaggattgattataactaatttatttggttgctacagtgacaagacatattaaagataattatgctactgtacaatatccatttttatttattggcacactatttaggttaactattatctaatcatttgatat

SEQ ID NO: 4965 - DNA, 3812 bp, Oryza sativa
aagaagtcctgggtgaagtcatggcttataccccagttgagcgcctgtgaagatgaagccgtaggcccgctagtccgctgctgcttatttttgtttgtcaggcctgaagtgcctttgtaataatgtaaatattatcgatataataaagatgtgccttttgtatcctgtttgtgtggtgtaccccggcttttcctgggatggggattaatacacttgtgttttggaaaaggtatttttccgggcacgacaagctaatatcagagacatctcgactgtaggataagccaagtggataaaacctaaggacatattttataaacaagactatttgcaaaagttcctttttcctcctttccctaatgctatttgcaaaatgtttactctcttcttcctccttcggattttcaactagtactagatggtcagctttgcgaagaagaagatgtcgctagtggtctgccgaagttctagaaggctgcaggatccactagcgaagcaaaggaagcagtgaagccagatgtgaagcaggagtgaagatcttggagaacccgtcgcagaacctataccaccctttagggttttgttagtcgtgtgtttccttgattgtgtgtgtagcacatggtttgcatcagtggggtgtgatgtaaccatgctaggttgtttgcgttatcaacctgcagaataagcctaacatatatcataacaggaaaagattagatctgttaaggtcctatccttagtttctgatctctttctttcctccaattttctctttccccctctctaaaccttgtaacagatggctgacaatgagaaaggaagtaggtcagaaatcaaaacaagggtgccccaagctccgagtgaatgaagcaccagacaccagttgtgtgacagtggtctaacacctgattaactagaacgaattgcttatagagctaccacagcagcatcagatgccaattctagacccgagtcagatgcaacctcaagtgcaggtggaggcagtccaatcactcacaccacaagttagcgcaccgccagcatcccaacaagcccatcgtgccatgccacatgtggactcaaaagaagcaagaatcatttgttttatctatgttgaacaagggcactatgcaaggaactgtccttagcagaaaaaaaaagcaccaatgcgaaccgaagatgaggtccgtaagatgaccattaccggcacagaatggcctccaccaggaatgacaaaacgtcaaagaagaaatttcttccgaggtgcaccatagttgacggaacatcttttagctaatggaggtagagtgtctgatagcgaagattcagatcaagtctcctcacgggttgaagatgagaagtctctccaaggtttcaaccagaataaaaaggaacatatggcatgctctcgttgtggagaaatcggtcactttgccagctcatgtgtcaccacttgcgttcattgtgaggaagaccatccacccgacgagtgtccaacaagcaggattacttatttcttgtgcgaatgagctgatcatgtacgaaaagattgtcaattcagttttctgctgatgaagaagatggccaaccaacccgccagttacaacagacagaagcatcaaggcaacccaaatcctcgacaagactacagtttcagcctaactccaatgccaggacagaggaatcaaaatgggaaaagaaaatgccgagtctggaaagatatctgttgtttcaattgtcaagaagtgggtcatttcgccgacaagtgctcgaaaccgagaaacatatttaccaacacgtcagtccatgcaactccgcgcaatcagaagcttgctccttagcaaattggcatccatgcatcctgaagcagccctatagcccaagttgcaatagctcccactccaatgagtgcactaccacaaggtgtcaatgctcaatttcagccccagccaccagttgacaagacagaggccagtatagggttggacctttggatggtccaggacaacagccaagaaatcaagtcaagatgaagaacctgagagtaagaaagttattggtttgttacaactggaaagaaccagggcataactccaggacttgtccctaaccaaggaaaaaaaatcggcctccacattttcgccaatttacaagaaacagacatgccaatcgccaagtggtcactgagaaaaaaaattttttttgggccccccccaaaaaagggggtttttaaaaaccccccccctttgggggtttccccaaaaaagggccccctagtgcttagtcagaagcaaccataacactcttgtatcgatgttcaagtacttttgttttatagttgttctctaccacccgtgtaataagaaagaaacgggaaataatcaatgagtttggcaaatgtatgaaggatccatattgagactgcaagtgttgtgagttgtgtacattttgttgatgattaaggagacctagggtcttatttccgtaagctcataatctgttatgaatcaaataacctagcgattgatggcgaagaaaatcaagtgatcaaccaaagagacatttgtttggactaagagtttccgatgtgtcctttttcggatcaaaggcaacgacagtcagtatagcttttgacgaactacttcaaggtttctctgaaaggcagcaggcccaaggactgcattgccccagaagcacccacaacacccggagtgaagagtacctggttgagaaaggtcaaaaggtgattgatggaagagatcggaaaagatgtttggttgctaggaaaatgtcacgtcccaaaacgactctaaaatatatcctttaaattatgcctagaataattaaaatccgtgtgaaagcctctaacaattaaaatgtgcaaagttaaaagtcaaataaggcttagaagatttttgtatatttcctaaaagcctaaaatgtgtaaataaattttagtggaattttcatagcacaaataataattgttaagaaataaacaaagttgaaaaagttttataaaaagaaaaacccttaaagtcccccttcccttccttgggccggcccggcccatctctccttccccccctctctctctcctctccccgcggcccactcgggctctccccgcgcgcgcgccgctgacgggccggcccgcccaccaccctcgctgacgggtagggcccacccgtcatccccgacctcccgccgctcccgccgctccgcccgcgccctagcgccgccgccgccgcgaatcccgccgcctcccgtcgtccccacgtgcaataaagtgggaggaatcactcaacgtgatcccctctccctttccccccattttttccctctctctcttgcgttcaaacgggcggatttgcccccgcaaatctcgccggcgccattgatggcggccgacctcccgcgccggtttccttcctccccagtcgctctctcccccttccaaccctatttaaaccctccccgcacctcctccgtccatttccgccgtcgccgcccttcctcctcgccggattcgagctcgcgacgtcgctctctctctccgccatcgccgccgagctccggtccgccgccgtcgtcgccccggaccgcctcccacctcggcgccgcctccttcggcttcgccgcatcctcgccgacctcgtccacccctccgtttcggtcgccgaccgccggagcgccgccgtccccgtcgacccgagccacgccaccgcctccttccgctccggccgcctactccgtcaccgccgtcgcctcggggtgagccgtggaccgtcgcctcctttcccccttccctc

SEQ ID NO: 4966 - DNA, 5701 bp, Oryza sativa
tgagttcaggctaaaagagttaaatacttacattagggccaggtaggccaacaactatcagagaacaacagcggaagacaaaatattataagggcccggttaacatgccacaggcagtcgacaaggacttaaaacaaaaccgcaatccgatcatcttcttggatacgcaagcgtaccgacaagggcttctcttcaacactctcctaaaagatatataaatagcaagggtgagtaccaaccgtactcagcaagccaccacaacaacaatgcatatgatagaggtatttcaaggaatggcttcaggttcctttgcgcaaagcaagttttgcaaatcttttcacaagcctaagacctagcatagactgattaagttttaataccagtgtttacattaaacaacgatggttctgtccaccatccattgtgatcccaaggatagcttcccgccattgagtcgtcatggttttctgaggacgtccaccttccctcctctcaggaagtggctccatcagcataaaattcatcatgcaatatcccatcccacacatgttaagaatttagagtctagccaagtgtaatacacgtcccggtgctcaataaccgcgagcacggctattcgaatagatttggtttactcacactgcagtggatgtacactttacccgcactccgtgtcacgtcctgataaattcatcccgaattaaaaatcattcgctaaaaggaataatagaattaattaaaattcgaaaagaaattggcaaacactaaaatatgtacaagaaaaattcaaatgtggcccggagaatttttgttaaattctccttggtctaaaaggagccctcaaattttagtggaattttcagagcacaaataataattaagaagaaataaacaaagttaaaagggttttgtaaaaagaaaaaccctaaaagtcttctttcccccccttcccttcttgggccggctcggcccaactccctccctctctctcctctcccccgcggtccatcgggccctccccgcgcgcgcgccgatgacaggcgggcccgcccgccaccctcgctgacaggtggggcccacctgtcataccctacctcgcgccgagcccgccgtccgcccgtgccctagcgccagccgcgccgacgaatccgtcgcatgccgccgtacgcgcgcgccataaagagggggaaatcactgcccgcgattccctctccctttaccccacgttttgcctctatctctcccttggattcgctcggatttactcccgcaatcctcgccggcgcaatcaatggcggccgagatttccgcggccgattccttcctctccggccgccctctctccctcccgacgctatataaacgttccccgtgcttccctcctccgtttccgacactcgccgctcactctccccgtcggattcgtgcccgcgccgtcttcctctctctccgccgtcgccgccgagctccggttcgccgccgtcgtcgccccggacctcctcccgactcggcatcgcttgcttcggcatcgccgtgtcctcgtcgatctcgtccactcctccgtttcggccgccgactgccggagcgccgccgtcctcgtcgacccgaaccgcgccgccacctctttccactccggtcgccgttttcgtcgtcatcgtcgacccggggtgagccgaggaccgttgtttcacttcccccttccctcccctctctcggccgccgctccgtcgcgccggaggtcgccgccggcgaccatcggggcgcgggcgcgccgcctcccgtcgaccgtgccggcgaggccgccttcgggcgcgccccgcggctgccaggtggggcccggccgtcagccgcccgcgccctcgggtgcggctgacacgtgggacccacggcgccggccggcgtcaggccgcgtgcgcccggtccaccgtggaccgtgaggctgccgcgtgggccccggtccgcgcgccccctccccctcggctgacgcaataaatcctttttaaattaaaatttaaatgaagaaattcgcaaatattcatttaaagagcatataaacttcaaatggccataacttggccatttcaactcggaattggaccgttcaagtctctaatttttccttaagaagtcaagaacccatttttgtgctttgttcctgcttgttatatggagtttattagagtaaaagccttttcttttccgttggtcgtggagacgctgcagcttcggaagatccgctcttcgtggaggttaaagccgacgtttgggaaagcgagcaaggcaagtcacatcatccttgaacatattggatcccattttacaaaattcttttgatttaaattattgcattatcgctttacttaaattcccgcgttatcactgttttatttagccatgcctatttacctttgttatgaccttattattattgtcattgatattattaccttgttcaccctagattaaacaaaaccccaactagtggacactctactcatggtaccactagtatgaatttaggtagatgcttcactgattaattaggcaacattagggggttttataactctagactttgggatattcatatcacctggacactatggaatggttggattattgtggaattggattcacacctccccctctattcaaaatcctcaaaatggttttcggacgggctcggggtgcattgttttgatagtagcacctcggccatataaggaccggtcttcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcacagggctggtgtcctgctgctaggggctcagtcctgcctgcctgtcccggtggttccggccgtaggcggggttgggtcggtactcttgtctaaggctaggatgggttggaaactatgtcacgtcttccgtctgtataccgtggtggtatgtggcacgtggttacacgtgagaaagatgtgtcttgtgggtaaagatgtacacctctgatcagagtataatctattcgaatagccgcgccctcggttatgggcaagccgagcaatgtacccaagttagtgttttaaattcttaaaacctgcttaacaactaaaatgtggaatggttggcctgggttggcttaggacgagctgggacccagggtcgggttgccagttcggtctgaatcatcgtaggccttgggttaaggcaggttcgtgtgggttcacggccttgattaataatattgtatagttctaggatcgcgtttacaaaatagctttgagcaactaaatgtctttaaatgctgtttactgcaaccctaacccttatattataacccccttgtactcccttgcatttattctgcatttatgggtgtgtcttgttgagtacggtggttgtactcagtcttgctcaattttttcccaagcccagaagaggagttccttgaagatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttctggtcgtgacagaaaagaattaggtcgaaaggtgattgataaaggataacgaggaacatgatttgtgtcactcgaggaagactcccgatagcaattaaccctacaactgtcaccatgtcatttaagcagaagaattcgcgagtaagcaagatgaccataggtagaagtgattctatgaggacaaggatggaaacttttgtgacatgaccaagaagtcaagaagttaacctgaacagctagaaactaaagctcggttcaaccttgggctgtgtatcagatgctaccagagtaaaagcaattgcactagtatcgttcaacgcactttcctagcgattgatccatctggaaagaacacatcaaggatgaaggtgtaaaggaatatgttgaatgctaaatgacgacaatatgaagagaatagtggaaagtaacccgattgtaaagaaagtgaatccgagatgtctgttcgtgggagctattcccagttatgaaccaagtgatatgttcaaggataatctacagaggtcagattaaaatcacatccaataaagaagcttcagatttggcaggataacgatcagacaataacaagtctagcagtaaagttatttgggaagacgtcaaagcatgtcaagtgggataagttggttctcgtgggaagcataattcaaagttagagtgatcgaccctcgcattgaatagcgttagtatctagcacccggagactaggaaagctaatatgaggcagttagtggcaagttgtcaatcatggtatccttggtaagcgggatatcatagtctaaagcatttggtggtaagttggaaggaaacgccaagcatggtattctcatgatgacaagctggtaatgacaagcatggtatcccagtaatgacaagttggtatcgacgcataacgtgaagttggtaacttgtatgagattgacaccaagggtatgaattatgagaagtcccggaactgaagccccgtcttcaagtgccgcatcccagtcgaagtcagctcaaggtgcaaccagggacaagccaggtgaaacgaagattccatctgcaacaggagatcaagccaagcagttcagagtggggaagttttgctgggcaagtttgttaaagaaaacgcaatggaagaagtcggaccagaagagaagaccgcccaacctatcttcttgctagccttctcgaatctcgggggcgagattcctgtaagggggtggatttgtcacgtcctgataaattcatcccgaaataaaaatcattttctaaaaggaataatataattaattaaaattcgaatagaaattggcaaacattaaaatgcgtacaagaaaaattcgaatgtggcccggagaatttttgttaaattccccttggtctaaaatgatccctcaaattttacttgaatttccagagcaccggatataattattacgcaacaacaacaattaagaaagtttattaaaaaggaaactaaaaataatcctccttttcctttgggccaagtccagcccaaagttcctttcctctctccctcggcccgcggccgaagtatcacttccctccctctctttttcctcccctctctctccctggcctcccctcctcctcccgggccacctcttccctcctcttccgcttgggccgcccctgccctatcccggcctagccgaccagccgcctccctcctttccctcgcgcccctctgcacgcgcggcgcatgtgcgcgcctcacgcctgaccggtgggtccacccaccctgtcgtcttcaacctccagccggccgctcctctctatcactctcccgaaccctagcgccaccatccttcgatcccgctccactgcgcaagttccggccaaataaattgcaaaaacggaatccccatcc

SEQ ID NO: 4967 - DNA, 6601 bp, Oryza sativa
tccggccaaataaattgcaaaaacggaatccccatcccttcctcattatttcccccaactttccccctttaatcccgcccccaatcaccgggatttaatccctcttctttgaccgccattgatgccgccggccacgttctccggcgtcgttcctgtcccctcctgtggtcggcactcccctccattgcctaaaaaacggagccctagtccccctctccttcggttttcccccttcccgagctccctagccacaccgtcgctgacctcctctctctcctacgctgccggccaactccagccgccctgccgccgcgtcagcacgccggccggccgtgccgtcgcctcccccggtgtcgcagtcgcctccccttccccggcatgctctccgtttcccgcggagacctccagaagtgcatccccgccggcaacaatggcgttgccgccactgttccgccttcggccgcctctgtcgcgtctcttgtgcgccggccgacgtcgccaccacctctcccagcaccgaaacgccgtcctcttccccgtccaggccatggcgtcgcccgtatttcgccggaacaccgccgtgccgcgccggcctctccatccgccttgccggaatttccccggtcggcccttcctcctcccatgcgctgtcggccacgccaccaccacctccagcatcgcagcggcgaaccggcgacgtcatcctcggcatcgcctcccctccatccgaaccccaccgctggtgtccgtcatcgtcttcaccgttcatcctcgccggctcgtcgtcccgcggtgccgcctccatcgtcatcatcacagcggcgtgttccgcaccgtcctcgcattcgtgcagctgctgccgactgccctcatcgcctcctcgccggttccggttgtcgtcctcccgtcgttctcggtcgtcgtggcgttcgtccctctgtcaagccgcgttcgttcgtcgcccgtgtttcgtcaagtctgttgcagcctcgtcgttgtcttcgtcctcggctccgcatcgtcaagcccttgagtcagcctcgtcctgccttcgtccaaggatcgccgctgaagtgtcgtccgttcgtctccgtcgttctcgtccgtctccaccgcgccgttcgtcgtcgccgttcccacgcctcgtcgcgtggtggtaaggatccgtcctctcactgccccgtcctcgtcctttcggagtcgccccatgcccgttgtgtgtttgtcgaccccggtacccgtgtaccagtgtcggtagtcgttcgtgggtgcgtgtggtgaccgtgtttgtgtgtccgctcggtagctgtcacgcccagaaattcacaagtaatttctgaactaatttgtgcattaaaaaccctcatccaggaattagccgagatacagaaactgacaatttaatatacagattcatcaaaataactaaagcgataaatacttacataagaggcacttagtcctcaccatgaagaaaattgcagcggaaaataaaatctagagaagcttcagctcccacaggcagctcaactgggatataagccaaaggtcttctccttctggatcatttttcttcaactgaagtttgatgattattgcaaggtgagtacatgcaatactccgcaagccacacaggaattatgcaagtgcacaaggataccaaaggatggcataatatagggtttatttgtgaaagcaacatttagcaaagatttaagagtagtaaaatagtagagtaattaatcatcaatattaatcaacactgaacaacacacccatgctgcacaggcccaaccaaacctgaacaaccaaccctggttgtacagatcaaacctccaaaccaggaattatccattccaaactgggagtcaaattaattatcacattgttatcattaatgagtagtgtggaactaatcacgaaaaatattgttagacccgcccataaccgtgggcatggctattcgaatagttttactctggccagaggtgtaccactatacccacaagacacgattccacacatgttgccatgccccgaagtaccaccacggcactgcaaagggggaaatcgtgacaatacccttcgcacaacacaactcaccacagtgcaccattcctggatcataatcaccccctcaaaaacaagaggcatggactccccagtgacccccacagacttctcgccgcttctcagtctggcaccctgtaatgaaccatgctatacaaaagataaagtcgttgcccacgttggcttgtggttagcacggttaatgtttcacaacagtagctcacgaaccggtccttaattgtcatgagcacgaccttcaaaaccatgtactcacaaccaaccattaatcatattttaattatcaattaattatcataacacgattgaccatcgtgagctaccattaactataaccataagtaatagtgaagcatgatttatcccattaatgagctaatgtttctaagcatgactaagcaactgtcataagcatctagctgaaccaaaccaatatataaggttcaagctaatcaatttattacccataggaaaataaagtcatattcggccataattaattgggaaaggctcactacccgatgacattcgaaaacaatgcataagttaaaataaaacaatagctttaaacaggttcaacatgctcaaagggttgtgtgggatctgtgtgacttgccttgcgaacaagcgtcttcgattcgtcttcaggaacttctccaacgaacgaacgatcctccgaaacaacggaaaactaaatctagaacgcaaaacgagaaaaaacactaataagaccaaatgaacagtacaattaaagttcataaaaaggtagagcttgaatttacatgaattatgagacttgaacgaccttattccgagttcgtatgaattagttatgaattttacaagacttaatataatttagccttatacagaaaaggaattacgatttatttggaaaggaataacagccgctgacgtcagcgatgacatcatcgccggcaacacactggaccacaaggttgcaggcactaggaagctcggccgggctatccgagaacaccaacgcggagaggacgacgagacgccctcaccgaggtcggcacgaccacggacgacgatgggagatggccggcgacgagattgaggcggcggcgtggctgtgtccacggtgactgtggcgtttcggcgaggggaggcagcaaccgaggggcggacggtcttcacctcgctcctgcgatcccgagggtagcgaccgcgagcgaaggcggcgatggacggcgacgagcggcacggctgaaaacgagtcgacggaagattgcctcgggttgacagcgacgacgaagctccgatggtttgcaccggtggcgaaggggtggacaggcttcggcttggcgttgcaatgccgacgacagcctcggggaggtccggctaccacgggagaagcggaaagcttcgccggagatcaaaacatggcgatggttcggccttcacagtgacggcgaattccggcggggttcggcgcaaaagaacgggtggccggggtagctctcacccttgcgaagccgatggaagtggcggcgcaagtcggcgacgaccagagaagcggaagacggcggctggaattggtggcggcggtggagagagaaggtaagcgtggcggcggctctagggctagggaaaaaaatcgggaaaaaggaggaaacggaagaggaggccgaggggctgctatttatagccaaaggaggaggagatcggctcggatacaggaagaatcggcgacggattagttagggttcgccggaaaaatggagctcgaaaccgcgtcgaattcacgcgatatacaacggtattcaaaggggtttcttagggataaggtagaggagatcgaggggactccgtttttacaaccaattttggaaacttgctctgtccggaggtagaagatggtactgtagcgaggggacgtaaaacagacttcttgccgggcttttttttctcggcttgattagaagagggaccaaaactggacttccgctaaataagagaaagaggaagagagggctgctgcgggctaaggaagagagagaggagaggagtgggctgaattcggcccagactgaggaagagaatttaattaactttttataatttaaataattgctgaaatgatgtttcatttattaaaaatacttccaatgctcaaataaatccaagaaaaatcccgaaaatacttgggcacataaagtatttaatgaaattttatctagctcaagtttaagttcaaatttcttatagattttattcccacacttactttgattattaagtaatttctaaaaattcctttttcacaacgatttataatttagcgattttcagggtgtgacagtagccgcgtggtttccacgtgtgcagcccgcgtggtgtccagtggagtccgtttgtcggctactcggctcggttggcacacggggtctgcttccgtcgacccgtggaccgtctctgtatacttggtctaccgtggtccattaggttgacatgcggggtccgcatgtcaacagcgcagccttcctgtattttccaggctagcgcttgcacatgttttataattgcaaaacctaatcataataatccgtaaatctccatataacagcattaaacttcggatgatcatatcttgatcatacgaaccccgaatcgacccgttcaagtctcctaatgtttgttataacctaaagaaccgtgttctttctttttatgtattattattgcttctttatagggttgtagctttgcttgtgtgtttcgcgtagcttctgtcgttccggaggtttcggaagcgtagttcgtggtcgtcgccgaaggttcggaaggccgttctctctgagcaaggcaagtcacatcatccttgagcatattgaatcccagtttttaaaattattttaatttaaattattgcattaccgttttatttaaattaccgcgttatcactgttttatttagcacttcctactaatccttgttacagccttatcattgcaattgttattatcacctcgttcaccctaggaaaacaaaaccccaactggtgggtactctattcatggttccactagtatgaatttaggtagatgcttcgctgattaattaggcaacattaggtggttttataactttagactttgggagttctcatgtcatttagacattatggaatggttggcttgtgatggaattgaacacacacctcccccactattcaaaactcccaaaatggttttaggttgggctcgaggtgcatggttctgctagcagcaccttggccactataaggaccggtcttcgggcctctattgcaaagcactaccatctaaccacatgtctaatgggtaaggcttaactcggtgctcagtctagtcctggcaagagtacacggatggagatggacaaagtcggggctcaatggacatctctagggcaaatgaaggctacacgggctacggcgtggtagtcgagatgtcatggcacagggccagtgttctgctgctaggggctcaatcctgcctacctgtctcgggggttccggccgtagtcggggttgggtcggtgcttttgtcatggctaggataggtaaaggggttaagtcacatcctttatgacgggttccacggccgtggaatacggagtaaagatgtgtcttgtaggtaaagatgtacacctctgatcagagtataatctattgaatagccgcgccctcggatatgggtaagcctagcaatgtacccaagttggtggtttaatttttaaaacttgcttaacaactaaaatgtggaatggttggcatgggttggcttgggacgagttgggacctgggtctggttgccagttcggtctgaatcatcgtaggccttgggttaaggcatgttcgcgtgggttcacggccttgattaataatattgtgtagctctaggatcgtgtttacaaaatagctttgggcaactatgtgacttttaaatgctgtttactgcaaaacctaacccctattattatccccttgtacccccttgcattaatcatgcatctcccggtgtggcttgctgagtactatggttgtactcattcttgctatatctttcccccccttcagtaatagaagctttggagaagaagtcctaggtggagtcctggcttataccccagttgagcacctgtgaagatggagccgtaggcccgcttgtccgctgctgcttatttttgtttgtcaggcctgaagtgcctttgtaataatgtaaatattatcgatataataaagatgtgccttttgtatcctgtttgtgtggtgtaccccggcttttcatgggacggggattaatacacttgcgttttggaaaaggtatttttccgggcgcgatagtcacttctctccccgagcaaaaccctagccgtgcgcgggtgctagcacatctgcgcgtggcgttccgtccatgtacgtgtggataccggtagaggcggcgctggtttgcggtgctgattggcttgggagtacggcgaggagaacgcacgaggaggaga

SEQ ID NO: 4968 - DNA, 723 bp, Oryza sativa
ccttgcctcctgggacaaggattaatgcacgcacgtaaggaatgcccgttgggttatttccggtcgtgacacaacccaagacggtttcagagattcgtagtttccttggtcttgtggggtactaccgcaggtttattgagaacttctccaagatcgctagaccaatgactcgactgcttcagaaggatgtgaagtataagtggacggaagagtgtgagtagagttttcaagaattgaagaaaaggctagtgactgcgccagtgttagtcttgcctgatccaaggaaaggttttcaggtgtattgtgatgcgtctagacttggtttgggttgtgttttgatgtaagatgggaaggtggttgcctatgcatctaggcagttgcgccctcatgagaataactatccaacacatgatctagagttggcagctgtggttcatgcattgaagatttggcgccattgcctttttggtaaccgtacggagatgtatacggatcataaaagtttaaagtacattttcactcaacctgatctgaacatgcgtcagcgaagatggttagagttgatcaaggattatgatatggaaattcattatcatccaggtaaagcaaatgttgtagcagatgctctcagcaggaaaagccactgtaatatgtcagaaggtcaacatctaccttgggagttatgccaggaattggaaaagttcaacttgggcatagtcatca

SEQ ID NO: 4969 - DNA, 846 bp, Oryza sativa
gaaaaagggatttattgcgtcatcaaaggcggttcccccggtaaaccgggttcaaagagacggtctacgaaaccaacggccgagatctaatctaagccgaacggacgggcgagatcgatccggtccaccacgggctatggatgacgtcagcaatgacatcagcgatgatgtcatcgccggcggcggctcgagaccacgggctcgacggcgaacggcagcgaggcggcgcaaacggaggacaccaacgggtagagctcgactcggcgaactcaccagcggcttggatgatggcaaacgacgacggatgacgacgttggcgaggttgaagcggcggcggtcttcgggtcggcggtgacggcggcgctccgaagggaaatggcagcaacggaggggtggacgaggtgctgctcctcctcgcgatcctgatggtagcaacggcgaccgaaggcggcggctgcaatagcagtgcggcgcggctgcaacagcggccggaggttgaagacgactgacaggtggaccccacctgtccgtggctgagagagaggagggagggcgcggcggattgggccagctgagccggacgcaagcaggccgaggagagggagggagaaacttgggccgactttcggcccaaagccaaaaggggacttttaaaacctttttcaatttaaattattcatgaaatgatattccattgattaaaaatacttccttggctcaaatagatcccagaaaaatctaggaactatagaaacaagagaagtatttaacaaaattttatctagcccacttttatgttgagatttaacaaattaaaattagatcttctcttttaggcttttaaga

SEQ ID NO: 4970 - DNA, 342 bp, Oryza sativa
agactaatcacgaaaaacattgttagacccacccataaccgcgggcatggctattcgaatatttttactctgatgagagatgtaccattgttcccacaagacacagctccacaacatgtcaccatgcacctctataccaccacggtaccttggaaaggaactttgacaatacctttcacacaacacaactcaccacagtgcatcattcctggatcataatctccccgtcaaaaccagaggcaatggacttcccagcgactcccacggacttctcgccgcttctctattttcatctaatacagaaaattattacgaattaaataaaagatttatgatgtcacg

SEQ ID NO: 4971 - DNA, 281 bp, Oryza sativa
agcaggagtagcaatgcagcaggctggcggcggcgcgcgcgggaccgcgctgcgcgagagcaggagcagccgagcagcagcagcaccgcaggagcaagcaggtctgcagggagcagcagcagaaaagtcaaggcatcttgatcaagtcgaaacaaaagacttgtatagtctccatggataggaggagcagccatgttcgaaaaatctctatgcatattatcatcaacgtttgcatcaaaagagaccttataaaaaaatgaaattattcaggccaagtgcag

SEQ ID NO: 4972 - DNA, 481 bp, Oryza sativa
caggggaatttacatggtgacccttatgatagtgacattattaagggcacgctatctcttttacatatatgggcttttagtgggccaacggactcggcccagtcatgacgaaggggctccttgagggcacgacggcccgccatgccttcctctggtaaggcccggctggcacgaagctcgtatacctcgccatacagccttcgcccatgtggccctcttttgatagggtccacctccggtgaagcccgtgtgcttcgcgacgtagctttcgcccatgcggccgtcttgggtgtggagcgcaaccgcgtccccttggtcttcgccgcacctcttcggcttgaatcctcgctagcgcttcggtttcggcaggtccgatcgaaggacctcgtggtatacctccaataaaagatataaaaataatactagggttgacagacaaagaaacccaatcaacgtgaaaaccgtggagctgccaggaccc

SEQ ID NO: 4973 - DNA, 5694 bp, Oryza sativa
cccaagaaggaaggggggggaaaagaagacttttagggtttttctttttataaacctttttaactttgtttatttcttcccaattattatttgtgctctgaaaattccactaaaatttatttacgcattttaggcttttaggaaatatacaaaaatcctccaagccttatttgacttttaaatttgcacattttaattgttggaggctttcacatgaattttaattattctcggcacaatttcgaggatgtattttagggtcgttttgggacgtgacaaacctaccccccttaaacggaatctcgaccccgagattcgaaagaactgtcgaaaagaccgggatgggctgccttcagctcgtcttcacgctcccaggtagcttcttattcggcatggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaagacatttcttgagttgtgacacatgaaacacatcatgcacgttgcccaaggaggcgggcagctccaactggtaagcgacttctccgcgtcgggcaatgatacggaaaggacccacataccgaggtgcgagcttcccttttgtctgaaacctgtgtacacctcgcaatggcgtgacccgaagatatacaaaatcgtccactgcgaattccaggtcacggcgacggttatctgcataacttttctgccgggactgtgccacctttagattatcccgaatggttctgactttaccttcagcttctctcaggatatcagtcccgaacacttggcttttccccaacttgatcccacattagcggtgtccggcatttgcgcccatacaacgcttcgtaaggtgccatttgtatgctggtttgatagctgttgttgtaggagaactcggcataggggagactcttatcccaggtcttcccgaaatctaatacaatgcgcggagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatatgattttcttgggaacgccatggagactcacgatcctagcgaagtagagctcggctagcttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactgacccaccagtatttctccttcaagtctaagtacatcttcgtactgccagggtggatggaataaggactttcgtgagcttcctgaagtatcagctgtttaagttctcggttatctggaacgcatacccgatttccgttccatagggttccgtgttcatcctctgtgaaaccagcggctttaccctgtttcatattcttgaggagtccatgcatgtccgggtcgttcttctgagccttgcggatttgatcgagcaaggtgggcttggcttccaacgcagtcaagaatccacgactaactatgcttaggttcagggcttccatctgttgattaagttcgagtggaatgccacggacgttaagagtgttgcagtggcttttccgacttagagcgtcggcaaccacgttggccttaccaggatgatagtgaatccccacatcataatccttgatgagttctaaccatctcctttgccgaagattcaggtccgactgagtgaagatgtatttcaaactcttatgatcagtatatatttcacagcgattcccaatgagatagtgccgccagatttttagagcatgaaccactgcggctaactccaagtcatgggtagggtagctgccttcatgaggccgtagctgacgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttgaaacgccttctcgcattgtgggctccacacaaatttctcttctttcttcaataactgggtcatgggtcgagcgattttggagaagttctcgataaacctccggtagtatcctgccaaacctaagaaactgcggacttgagtaactgtcttgggttgcttccaatcggggacggcggtcactgttttagggtccacagcaactcctttagcagaaatcacgtgccctaagaatttgacttcggacaaccagaactcacacttgctaagtttggcatacaattgatgttcccgcaactttcccaataccagacggagatggtgctgatggtcttcctctgattgtgagtatattagaatgtcatcaatgaaaaccacaacaaacttatccaagtattccatgaacactttgttcattaagttcatgaagaaggcaggtgcattggtcaaaccgaacgacatcaccgtgaattcatacaatccgtatcgcgtggtgaatgcggtcttaggaatatcttcttcacggatacgtaattggtgatatccggaacgaagatcgatcttggagaatacagtggcacctttaagctgatcgaacagatcatcgatccggggaagagggtacttgtttttgatggtgacttcattgagagctctgtagtcaacgcatatcctcttcgtcttgtctttcttctctacaaaaatcacaggagcgccccatggggaagtactcggacgtatgtaccccttttctttcaactcttccaactgtttcttgacttcggccagttcatttgctgccatacggtagggtcgcttgtacagaggagtggttcctggagcaagatctatccggaactcaatctctcgcttaggcggcataccgggtagctcttccggaaacacgtctccgaactctctgactatggggatttcggatagtcctatctgatgaagttctgaacttctgacagaggttgggggtgcaaagaaaacaaccggttgttccggcccttggtacagagtgacagtgcgtctcgcgcaatccactactccttggaattgagccaaccaattcattccaaggatcacatccaagttcttggtgtctagcagaatcagatccgagggaaagggaatcccttgaatttctatagggacggcagggctataatactttgctgtcataacccctccaggggtggtgatgagtagagggtttctaagcctttctactcccaactgatttctccccacgaatagcacagatataaacgagtgggaggctccagagtcgaacaaaatggtagcagggatggaatgaatgaggaacgtaccaacgatgacgtctggagttgtcagcacgtcctcggccatcacgtggttcacacgaccccgaatgacatccttcccaccgttgttggggcggggaggcgcttggccttgctgacgccttggcttcgggcatttatccgcaaagtgcccgggctcgaagcagttgaagcacagacgctgctgaccttgagcgtccctgcggccttgaccaggctgcacagtttgcgtaggaggacggggcgcacgagtcccttgttgattctgctgttgctgcggctgtgggacgcgcaccacgaattgaggtcgaggcgcggagcgaggttgctgctgctgctgttgctgctgcgaggaggatccccctggatagggattggtgtagcggaccctttggttagcaccctgttggttgcggaaattcgccaagcggcgcttgtgcgactccagttccttgtgcttggcttccaagcggatgctcttgtccaccagacgttggaaatccggataatccccagagactagacggacggacagctcggggtccattcctgccaggaacttctcttgcttctcctcatcttcccgcacatcctccggagcgtaacgggccaggttgttgaactcatgcaaatactccatcacggagcggttgccttgcttcaactctcggaattcccttttcttaagggccacgactccagcgggcacatgggtcctccgaaaagcggcggtgaagcgagcccaagtaataggctgtccctctggctgcgtagcctggaaatggtcccaccatagagatgcgggtccctgcagctgatgggcggcgaagatgactttctcctcatcgctgcactgcacagtgtctagctttttccccacggcatgcaaccaatccaacgcatccacggggttgttggagctagagaaggtaggtgggcggatgcggaggaactcggcgagtttagagtgttggggaggtggtggtggggcattctgttgtggcggattttggaggtggtggaggaaagcagtcatcatgttggcctgctgggcgaggatttgggtgagaatggcgttggtgtctggtggtggtggtggaggaggaggagaaggtgaaggtgggttgccttggtggttgtggttgctgccttcgggttggttgccatcaccggtaaccgcatttctcctggtcgtcaccatctgaaaaccccacacggaaccagcaaacagagaaagagctaacaattaaaactaaccacccacgactaccataatttttgaatttattactgctattaaattggttcattaatgttcaagttgcttaggcgaataaaataagacaggctccgacacagttatgccacacaccggcataaccatgccccacacgactcaaaaagacaaacgagaaagaacacacgcgcaagcctactaactgctcgtctactgctgcgacgggccaggacggaaggtgagcaacagcgcatcctccgtgctaccgacgccggaggcttccccctcctggggaaccacgggcgcgggctcggcacgaggggtctcgatgaagcaagtccacgccagggactgacgaacaagctcgggcctggaggtgctcttgcgggcggtgatcttctggctgcggcagacgcggcgacgcttggggcgacagacctttccctgggcgatcttgagctgatgcagctgcgcctccaccgcgtctaggtccttcttgagctgcaggttctcctggcgcagttccaggatcttcatgttgttctcgaccatcccgcgacgtaccatctggtggaagtcgatacgagccgcgttgtacgcctccaccatccgcgccaggtgcacgatggtagcgtcatcctctgagctagcatcccggaaggtggcgtagtcgcgggctcctccgcgacgagggtggtagcggtagggcgagtgttgcaactcgtacgggtagcgctggtgaagagtgcccatggcgaggagagcggggttctggcaagcggtggggaaggaatttccacccgcggtgactgccagtgaagtccgattgggagagccagagaggatc

SEQ ID NO: 4974 - DNA, 1355 bp, Oryza sativa
  unsure (1)..(1355): unsure at all n locations
nnnnnnnnnnnnnnnnnnnnnnnnnnnnnnnnnnnnattcagaccgaactggcaacccgaccctgggtcccagctcgtcccaagccaacccaggccaaccattccacattttagttgttgagcaaattttaagaattaaaacactgacttgggtacattgctcagcttgcccataaccgagggcgcggctattcgaatagattatactctgatcagaggtgtacatctttacccacaagacacatctttctcacgtgtaaccacgtgccacataccaccacggtatacggacggaagacgtgacatagttcccaacccatcctagccataaacaagagtaccgacccaatcccacctacggccggaacccccgggacaggcaggcaggactgagccccctagcagcaggacaccaaccctgtgccatgacatctcgactaccgggccgcagctcgtgtagccttcatttgccctggagaatgtccatcgacccccgacttcatccatctccaatccgtgtacttttgtttatgactagactaagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggaggtgtgaatccaattccacaatagaccaacaattccaaagtgtccaggtgatgagaatatcccaaagtcttgagttgtaaaaccacctaatgttacctaattaaaagcgaagcatctacctaaaatcatactagtggtaccatgagtagagtgtccactagttggggttttgtttattctagggtgaacaaggtaataataacaataacaataataatatggtcataacaaaggtaaataggcatggctaaataaaacagtgataacgcggggatttaaataaagcgataatgcaataatttaaatcaacataattttataaactgggattcaatatgctcaaagatgatgtgacttgccttgctcgctttcccaaacgtcggcttcaacttccacgaagagtggatcttccgaagctgtagcgtctacacgaccaacggaaaagaaaaggcttttactctaataaactccacataacagcagaaacaaagcacaaaaatgggttcttgacttcttaaggaaaagttagagacttgaacggtccaattccgagttcaaatggccaagttatggccatttgaagtttatatgctctttaaatggatatttgcgaattgcttcatttaaattttaattaaaaactcatttattg

SEQ ID NO: 4975 - DNA, 2109 bp, Oryza sativa
aaggaagggggggaaaagaagactttagggtttttctttttataaacctttttaactttgtttatttcttctcaataattatttgtgctctgaaaattccactaaaatttatttacgcattttaggcttttaggaaatatacaaaaatcttccaagccttatttgacttttaaatttgcacattttaattgttggaggctttcacatgaattttaattattctcggcacaatttcgaggatgtattttagggtcgttttgggacgtgacaggttgcttccaatttagcactgactcgacattgcttggatccacagcaactcctccagctgagatgacatgaccaaggaacttcacttcgggcaaccaaaattcacaattactaaacttggcatagagctgatgctcacgtagtttctctaaagcaagacgaagatgctcttcatgcttttcttttgtcttggagtagatatggatgtcatcaataaacaccatgacaaacttatccagatattccataaacactttattcatcaagttcatgaaaaaggacggggcattagtgagtccgaacgacataacggtacactcgaacaaaccatactgtgtggtaaaagcggtcttaggtatatcctcctcacggatttgaagttggtgatatccggaacgaagatctatcttggagaaaactgtagcaccggaatcaaaaagcacagttgcgggtatagagttaacaggaaacgtacccaaaaccacatcaggtgcattctgggcttctgcagctacaacatgattaacacgagccttcggtgctggagcattggagtcattctggacaggagcattcttcacacgtcgaggatttggacacttatcagcataatgtcctggatcaccacaattgatgcacacccctggcttgcttccttgttccttcctgacagactgattctgtgttggagctgctacaggacgagtgaccacattacgattgttgttgctgcgattaccagtgttgttgttgtagaactggcgttgagggcgaacaactgaagaggatcctccctgtgggtatggtgcagcttgaggtcccataccaatgtgcggcctctggctactaccctgttgagccttgaattgagcagccctacgcttcttctgttccatcctattgtacttgtcttcttggcgactcgccttgtccaccaactgctggaaatcccggtactccatagccatcaatgcataagacaactcatcattcaatccctctaaaaacttctcctgacgctcttcatcagtgcgaacatcttctggggcataacgagctaagcgattaaagtcatgaaggtactctgtgacagaacgggatccccgattgaatgctctgaactctctcttcttaagtgccacaacacctgatggtatgtgtgtcttcttgaaagcagcagtaaactcccgccaagtgataggctctcccgcggctctgtttagacgaaagtgatcccaccactcagcaacaggaccatgcaactgatgcgaagcaaaggaaaccttctcctgctcggtgcactgaatcaaatctaacttcttttccacagcatgcagccaatcacctgcctctactgggttagtggtgcttgagaaggtaggtggtctcacacgtagaaaatctgccaacttgttttgtggaggtggtggttgattgttgttatttgcctgctggttctgcgcttgctgcactaatagattaatcaactaagtttgttgagccaagacttgggcaagtgtgggatctccttcattgtgaccacttccacttccacttccagtgcgggtgttcaccatctgaagaaaagcatgggcaaaaggaaagaacgacagagagataccattagaacggagaactttaattaatttcaattctatattgctcttaactgtgtatgattacatttaaattgaattaacactatctcaccagctaacttactctctgacaagcaaaagaagtaaactcatgtagttacataccaccaatgatgtaagcaacacgctaaacccacacacacacaagcaaacttaagcaagcaaactaacacagggaact

SEQ ID NO: 4976 - DNA, 5326 bp, Oryza sativa
ttcctcatcacttaagacatggatgacaggttcagcatgatcaggcacagcatctcccaccacatgagtctttgaagctaactggagacgaggtggtggacgggttctcttccttgcggtgaggcgaagcttgggtgctggcggtggtgcttctcccttaagctcagctagttccttctgcagacggtacaccttgctctccaacttgcaaatcctggcacagttccagttttccctatcatgagctgctttctcccgctccacgcctactgcatccatggcgctaagcatatacacagcatgtatcagagtggcactaccttcgccttcaggacagttgtaagttccatagtcttgaccatgaggcttgtgtggatgatactggaaagctaatgactctaactcctcatcaaagcgatgacatagctctccaatggccaccaaggctgcttcctgataagcatggctgtactttcttcccccagcttcaaactttatcgacggaaggtcttcatgatcactagccaacgtcacgcgaacacgacacttctccttgttggggtcatggggaatctggcgatactcgggggcaacctcatagcctacttcaaatgccatcaatctcagctccctgacgaatcctagcacatcgatcaagcttttcggtggatggggcggcatctaaaggaacatagaaaggaggaatttatgcatatatttaagttagctgcacatactagacttaattaatttgacccaaaaagaaaaagaaaagaaaaggaggaaacagaactaattaaatttcgaatttttcttttctgaccgaaacataaattttcagaaaccaatttgtttttctgaattttttttcgaaaatttttatttatacaggagcacagacttcggaagtaaacaaaaagaagcaaatatattttcttcctgtacagtactcgtggaaacggaactaaacaaagtttttgtttggaaaatgaaatcaactttggacagagacaaattgctttagacaaatgaataaaacaaaactaaaatacttaggatctaccataagcacggtatagtgtcaccattaacagggatgagtagtgctggtgctatcttgattgaatcgataccataatagatgtacagtgccgactaaccaatgaaattcagaaaattaaactatttaataccctgaacagtaaagtttttttttaaataaaagaacatgtttctgttttggtaaagtaggatttagtaaatttggtacataaccttgcatgtgctgccaacttaattaatttgtaagagaatagagaagagcagtcctatttttcaaaatattttgaaggctacttaaggtttaccatttggcttatcgtaaggtcaaggtagctctgataccaacttgtcgcgcccggaatttctatccaaaattccaaatgcttacacgtgcgttaaatcctcgtctaggaatcagccgaggcacacaataacaaattgataatagagtactatcaaacatctaattaatactcgcgaaataaataattattacagaggtggatagttcctctcaaaagaataaaattctacgcagcggaaataaaaacaaaagatggaacagctatggcgactccactccacaagcaacttgaccagaacaaagcctaatcctccagatcatcaccttcaccgaagtactcctctgatgaatgaatattgcaagattgagcatatgacatactcaacaagccacacagcaaatatgcaagtgcacaggataacaaaggatggcataatacagctcaattgcataaacaagatttaataaacatttgagagaatagtaaaacagttaagtaattaagcaatattaaataaacactatacaacacccccgtgttgcataggcccaaccccatctgaacaaccaaccctggttgtacaaattaaacctccataccaggaatatatcattccaaaccaggagtcaatttaattatcacagtattatcattaataatgagtagtgtgagactaatcatgaaaaacattgttagacccacccataaccgcggacacggctattcggatagttttactctgatcagagatgtaccactgttcccacaagacacagctccacaagatgtcaccatgcgcctcgataccaccacggtaccttggaaaggagctgtgacaatacctctcacacaacacaactcaccacagtgcaccgttcctggatcgtactctccccttcaaaaccagaggtaatggactccccagcgacccccacggacttctcgccgcttctcagtctggcaccccataatgaatcacgctatacaaaaggtaaagtcgttgcccacgctggcttgtggttggcacggtaaatgtttcacaacagtagctcgtgaaccggtccttaattgtcatgagcacgaccatcaaaaccatatgctcgcaacccacctttatgcaggttttaattatcaattaattatcataacacgattaaccatcatgagctagcactaaatataaccataattaataatgtagtatgattcatcccattaatgagctaatgtttctaagcatggctaagcaattatacctatatagcacttagctaaaccaaaccgatatataaggtccaagctaaacaatttattacccataggaaaataaagtcatcttcggccattaattaattgggaaaggctgaccacccaatgacattcaaaaataatgcataagttgaaataaaacattaggtctaaacgggtttaacatgctcaaagggttgtttgggatctgtgtgacttgccttgagcttcttcaaccactcctgaaccttcctcgacgtaaacgctctcctctggaatgtcagaaactaaagcaaataaacaaaatcaacaaaacagtacaaaaacaagcataaaaagtacatgtggatatttttaacatgtagatcttgattttagatgaatttagcagcttgaaccactcgaatccgagttacgatgatttagttatgaatttccgaagtttaatcaattttcatctaatacagaaaattattacgaattaaataaaagatttatgatgtcacgatgacatcatcgccggccatggcacgggacgacgcgaccaccggcgatagagggctcggttgggctatccgagaacacccacgcgaagaggacgacgacgtgaactcaccggcgcaagaaactacgacggacgacgacgaacgacggccggcgacgaggtccgacggcggctcggctcgggtcaacgtcgacgacagcgctctgacggtcttcagcggctgcgaaggggcggacggggtgctcctcttcctcacgaacccggtggtggcgacggaaggcggcggtgacggctatagcggcggcgcggcgcggctggaacggcgtcggcggcggcggcgctagggcaacgtggcggcggcgctacgagcaacggtggagcttgggacttgaggagaaacgtagaggacgactaggggatgctttatataggcttggattagagagatcggactccaaacgagaggatttgagccggaaaaatctagggttagtttggagagataaactcaaaacgaattcgattcggtttatccgggcaaaattgatctccgaaacattaggggaaagggagaggataaggatgagatgatttcccctcaagcaatcgaactcggagatggctggctagggcggaatcgaaggggaggcggcggcgcttgggctcggctcggccggccagaggtggaagatgaccccgacatgtgggccccacatgtcggcggcttgagaggagagggtggggcggcggctcggcttgggccgcacggccgcgcgcgaagagaagagttgggccggaaacggcccaacggcctaggggatggttttaaagactttttcaattaaaataatttgtgaaatgatgtttcatttatgccttattaaaaatactttccttgctcaaataattaccagaaaaatctagaaaatagataaacaagcaaagtatttaatggaattttatctagctcaattttatgttgaaatttttcctagattattagagtttaacttgtaggcttttaaaaataatttctaaaaatgcattaaaaattgaattattaaattaggcgattttcagggcgtgacaaacctaccccccttaaatggaatctcgtcctcgagattcagaagaactggcaaaaagatgaggatgagctgacttcaattcatcctctcgctcccaagtggtttcttcttctgaatgattgctccactgaaccttacagaacagtatgactcgattccgggtgtttctctcactcacctcacaaattctgactggcttctcaacataagttaaatcttcttgaatctctatacgctcaggatctgcttcctccgtaggaacacgcaaacatttcttcaactgcgacacatggaacacgtcatgtattcccgccattgacggaggcaactctagttgataagctacttcacctctccgactcacaatcttaaaaggtcccacaaaacgtggtgccaatttccctttggtctggaaacgatgaactccccgcagcggcgtaacctgtaggtatacataatccccttcttcgaaagtcaaatccctatgacgattgtctgcatagctcttctgacgcgactgggcaatacacgacctttcttggataatcttcactttttcttctgcctctcgcaatacatctatcccaaaaacttgacgctcaccagtttgatcccaaaggagcggtgtacgacacttccgaccatacaatgcttcgtatggagccatttgaagactagcttgataactgttgttataagagaattcagcgtacggcagattcttatcccaacttccaccgaaatctagaacacaggctctcaacatgtcttctaaaatttgatttactctttctgtctgaccatcagtttgagggtgataggcagtactgaaattcaaatgagtacccatctcttcttgtaacttctgccaaaacttcgaagtaaactgactacctctgtctgacactattttcttgggaacgccatgtaaacatacaactcttgccatatatagctctgcgagcttatttcccgtgtaggttgttttgacaggtatgaaatgagcaactttagtaagcctgtcaaccactacccaaatagaatcatgcccttctgatgttctgggtagatcggtgataaaatccattcctatttcctcccatttccactctggtatc

SEQ ID NO: 4977 - DNA, 4838 bp, Oryza sativa
cccatgtacatcgcctcttcacgggtttctaggcaatcgttcccagaatgacccgtgcctccgtagacttcgcacgtaacgtgggagtccaaggccttgacggtgccttggggttttttctcgtggtcgttcaaacgattcatgaggaggtccagttttgcagcgagcaactccatctccttgacggtgtgcattcctcgctgatgggtctatagtcgttcctcgctccagcccatgttggagaccatcttttctaaaagatcgacgactcctctgaccgtcttagaaatgaaggctcctctagctaccgcgtcaaggtgatcatgtgacgtgggagtgagtccattatagaagttttgcaggattaactagtcgtccattccatgatgaggacaggcggccacgtactcctgcagtcgttcccacgcctcgggaatagactcgtctctcgtctgctggaaacttgaaattttgccgcgtagggcgttggttttgcccatcggaaagaactttgataggaatgttgttcagcatttgtcccaggtgttgatcgtagcgcggttggcatagaaccactgcttcgctttcccaatgagagaaaatggaaacaatcagagcctgacgccgtcaggactgatgcccttcatcgtgtacgtgctacagatctccaagaactgttgcaaatgtgagttggcatccttgtttggcttgccacagaacgggctagcctgtgcttggtctagcaatgctagcaggctaggaaattgaagtttcaatttgatcaggatgagaggttgatgctccaatttcaacaggctgggaactggaagctacaatgttgttagctcctcccttcatcaatgttgctagccggctctaagcaatggttgttcaataaattagtaaatgccccatatccaaagtatagtgagggttttttagatgatcaccttcttgtgattcttcttgggctttattcaagtattgtctgcatagctagtcttttgggactaggaatatctgaagtagttggcagtgttcctccttggcttcctcttcctgcaaaatactagacaaaataatgcattaaggtcatcaaactgtattattgagaacagtattatggaggtcaagcagacttgcctttttttggttccattaagggaacacttgtagcttgtttgaatgtggcaaaatttccacaacccttacaccttctcttgcctcttaccagcaccctcttccctgaatcattgtcaattgaagcagttttggatttggacttcctaccaccttcaaggcaagttttggtcctaagctttccgtatcttccatttgtcttcttaggtaaaggtgcacctaacacccttggcaattcaacctatggccagtatgggttgtcacccaatggctttataatcccactataggccttcttgaacaaaatcctcaatgttcacatccatattttgttgggaggttatcaaagccaatgcatgctaacatggttttccagtgtgctgccagtactggttgtaagctttcaccacatgcttaccattactgttgttattgttaacaacttctgcacaaaagctatcagatttcactactgagaggtgacccaaacccggagttcttgccttcagctgctgtgttacagcaggcaagatcttcctactcaccttctctacaattcttctcctcttattccatagaaccataaccaacgctctgtaaatttccgcatggtcacaaattagcaatgccttgtaatccttaatccagttgttaaaactctctgcaagattgttagtaatgtaatcacactttattgttggattgaaaccactcctcatccacttcaatggatgataggtttcaagccaaggaagcacatcactgcaagcttcaataacttctttcatgtgctttttccaaatctccttcctataagccgtttgctgctaagtgcacacatcaccaccaaacctcttcacaaagttcttcattagatggcagaagcattccgtctactcagcatgctcaaacacagtatgtgcaaccttttctaatccttacatgcataggtacaaacagctagtgggttaacatctcctatagctttatgaagttgtctcataaaccactctcaattatcctcagtttcagcatttatgaacccaaaagcttagtggatacatccaatgatgcccatctacggaagtggcagtagcaaagtgaccattccatttgacattcaaagtagttgaatttatactaatgtatggcctacattcctctaagaaaccatctatacagagcctcagagcacaaaaaacctatgaaaatatactttcccacaaacctccacggtatctatctctatcacactccctggtgaagttctcggtacctaagccctccacctataaagcatatgcaaactttcttcccaggtccaatagagctcaaccatagccttttgtctacccctaaatattgtgtcatagttaattgtgcacttctgatcttcttgtagttggctccgcaaggctttagggcccatacctatattcttcctaaggtttggaattgcctttgcagctacccaactgatgtgtggtaattattctcctactgctagaacggcatgtatggaagtctattaacactttcacattcaaaataaatgcaacaatccatcaatttccaaccattatgaaaatatcaaaatgaaattactgaaattcaataccatcactatcttctaattaattaggttgcttatgtccaaccatatgccaagggtaaccatcaaatttacaaccacctatattttcagggtcagttttcaccaacttcaactcaaactccttgattatagcacattgtctcatggctagactaaactccttcatgttaggatacatagtgccaaccttcatgcaaggattattagggtcataagccatgaccatctcccctggtacttcatcatgtacaggtattgatgccccattaatatcttcaacattagtagtaggagctgcagctgctactgcagtaacaccagcacccgtagttccagcaccatcagcagctccaacttcagcagcagcatgtctagccatctcagcctcatcctcagcactcaaaccctatagctggtagaattgctcatcccaatcattttgacaatatctagcctaccttcatcatcattttgagcaagaatctctagcctattccaatcgacaacatcggtactagctgggtcaaaagcaccgtagactggaacttgttcgactactcattcaggcacaatgaggaaaacgaaatcgacggcatgatcagattcgggttcgaccacagctaaaataaccttaggctcttctagcctgaagaaaaataatttggaacacttgttagagtattctctaacaagcaaaaaaaaaagacaaatcaagcttcacaaactaaggagaaaaacatattcttaccccatgactagctcatacctggtacacccaatcaattccaccttattcctagcaccagcattccgtcgggaagtaattaagatgggaacaacggcttcgagaggctgcccttggcgtcggcggcgaggaggggaagggggagggtggcagcagtgagtaggcagaggcggcggcgggaatggcgatggtgacagctaaatctggggcgccgccacgagctataacggagtacgataggggaggagcgactgcatctcgatcccttttcattcactgacctaaagaatgagccaagggcaatttggtcagaacacaactcatttactggcttaatcgagtgaaattggaaaaacgacgaagtagcatgttgcgcgaaggtggcgatggcattttaacaaaacaagttcgcggtgtggcattacaatgaaacccagccttgaatgtggcacaatgtcaattttcttgggcaggcccacactgcagaggcgaggcaacactaacgacgcggcctctacaagcaaactcgagttccaccactggctcacctccgctcttgatgtcaagctgcagccatggatctagagcacgtcccccgggggggctagagcacgtgaccggggagtcctcacctccggagagactggatgctcattctcaactcgtcaccggctgggtcaccagccccaactagcttctctgagaccaactcctccagatccactgcgtgtgatgccacaatgatggggtagccggcgttgccactcttgcctgtgtcgctcggataggctaggtccttcgctgccgccatggaccaaagaatgggagaaaacaaagaaagtggcatggtggatgacatgtgggcctagttagttttttttcgattggattgccacatgtgctggctcggatcaaaaccgctcaaaacagtgcttaggtggttatttgtcaggattgaaatgttcgggctgtaaaatatccagttttgttgtttagaaaagtaattcgtaatgttgcgttcagtggcggaggactcagtaggataaggttttgcttgagccatacctcgctttgaccacaagtaaccccatccactcctcgccttgctccagcactgcagcacgaccaccacggcggcatcgccgatgccgagatatgtaagcgcgaaaggaggaaacaatgctctagcagtaagagcttctgtatttcattccatatgctgtaattttgggatttttggtcaaaaaccgtatccaatcgattccctactagcgctcccaatagatcgagttcccttattcggattattcgttccccacttctagccactcggtttca

SEQ ID NO: 4978 - DNA, 2542 bp, Oryza sativa
tgccgagatatgtaagcgcgaaaggaggaaacaatgctctagcagtaagagcttctgtatttcattccatatgctgtaattttgggatttttggtcaaaaaccgtatccaatcgattccctactagcgctcccaatagatcgagttcccttattcggattattcgttccccacttctagccactcggtttcattcccaaacccttccctcgccgctctctcgcgcacgtccggcgaaatgttcccgcgcagcttttctcgcccacctcgaccgccgccaccgtcctttttctcacagccgtcggtgttggctttgctccagggggcgacacatggtgtggcaatgccgaccatgccgattggtggagcaggaccatcgctgccaccgcaagccccaccgccatctcgattcggggtgcttccacgatatagcaagaattggtccaacgccccgcaccgccgcctggccgtcgcgttgtaacaccccgaaaattttgactctaaaatacaaaaacgaaattcagaataataaaaataatcttttccaaaattcatttatgctggaatttgttgttttcctcctgtgcttggaacaaaggatgggtgtctgagaatatgcttgtattttagatttcaaaatattatttgttgaaagaaccatgattatgaaatatgttaattaagaaaatatttgcaaatactaacagccttctcacaaatccttttctatggattaaaacccatgggttgtccttgttttgccaaatagtttctatttggagaaaacccttcttgaaggttaactccctaaggaattattttaccaataaaatgtaatattgattatttcctaagaatcctttcctttaaaaggattacgtcatttggcagttatttttcaaataacaattattaataaagtatttcctggaaatcctatttgcgaagtaaatcccaaaaaggttatattaaaagaaaagactttctcagataaagtctagattaccgccttaaaggcctaaacgagcctgcataatagaatttcttatttgagagcatttgtgtgtttgtgccaagatatcgattgaatcaatattactaagccccaaaggatgccttttgatcgacatccttccttgtcctctctcctctcgtctgttttatttagcacttcggtgcaaaactaatccaagttctgaaactctttccttctatcgcgttgtgatatctctctcgagctcatggaattctatgattaaatcgaaacccactccgttaatttgaatcggcctttcccttgaaaacctaaaatcgttcgacggatttatttctcgtgcatcgacccgaatatcctcggttctatctctaaacttgaaacccaaccacgtcgaatggatttgtatgccatacaccgctcttaaacccctctttgttattgtcatcaattcgttctagtgatcgcaaaggaaattctaaatccaatcctcgaacaaccaaattagccaaataatattcgaaagcctaatcaaatgtcccatcatagagtccttttacaagtttcgaatacaattccaaattccaaaccccctagcaaattataaagttacctagcaattatccaagtcccctattacagttgggccacccttctctcttccagccctacccattccacaacacaagtccattatccctctctctgcatgccgagctctctctccctctcagcccgcttccaggccagcacatcgagccgccgtattcatccaaaatgcctaattggtgaacagttgcacgcctccctcttcacgcagcaaggccacgtggtgcgcgcggagagggggcggcggaacggcgcgggagggaggggtccaggtatgatttttttttcgttttttcttccatatgttcttcagttttcgtgtttttttatgtttttttctttccgtatctttttttagtttttttcgtttttaataagtacgtatacaaactatgtatacgtataaatacaaactttgtatatgtgtatataaactttatatacatgtatttttttggttggtatacgtatgcacgtatacaaagtttgtaaacacgtattttttgggcttttatacgtatgcacacaaactttatatacatgtgtatattttctatgcaccccgagacatgggcaatacagtgagggaaatccacaccccgagttcacaaaaccatgcttaccttgcccttcccctcctgtggcgatgtcgacatccaggtcctgcgccgccgccgtccaacctgtgggcgcgtgccacatcgcctcagccctgtgctttttcccccatgcccatgccgctctgtgccgctacacttggttcaccaccccggccaccccgctccctcgcgctctagccgccgcccttgttcgtccacgtcgaaagcgtgagccgagctcacagcgctgcgtcgccgtcctctcctctcctgtgccgccagccttctccttgaaggaaggaagaaccaactcagcaatctccctcctcgccgtggatata

SEQ ID NO: 4979 - DNA, 5633 bp, Oryza sativa
ccagccagcacccctccctcttcctcctttcccgcgtacatccgccgacgaccaccgccgatcccgtcatcgtcatcaccacacccgagtccagctcgagctcgtcgccgaactacaaccgccccgcacagccaagtcggctgcgcgggagccgcctcagcgtacggccaagtcagccgcgcgagcatcgtccgcagcggtttccacctagctccgggccagtgcccagccgagcatggtcgagccactggcactagtacactagtacagaaccttccatttgtgacggcctctaacatgcttgaaattagtggccgtcacaaggaagtcatctcaatcgggccgaaaaagcgcccgattgagataacttaggcccgtcacggatgacacatatcagtgacgggtgccaacttggggcccgattgagatatgaaatgttatctcaattgggcctaaactacggcccgtcacttatatgtatcatccgtgacgggcctgagttttatgcccatctaacatgccttcgagaccatatctcaataactaggcctgtcatagatgactcatccgtgacagactctatactaatgcccgattgagatgacttagtatttttccattttcatatgaaatgtttatatttgtgagttgacatgtagcaaaataattaactgcagtataataattcattttattagtcaaaaataaaatgatttcaaatgaaaaattgtcaacaacaaagttgtataacttatcaaaatttacaagttttattttggtcatttttctatataacttttttgaacaatttaaatttgaattagaaaatatgacaacttcaaacaatattttcaaatattaaatgatttcaaatggaaacaaagttttataactcatcaagatctataacttttattttggtcatttttctatataactattttttgaatagtttgaatttgaatttaaaaatatgacaacttcaaaacaacattttcaaatactaaatgatttcaactaaaaaagtcatcaacaataaagttgtataactcatcaagatctataacttttattttgatcacttttctatgtaacttttttttgaacagtttgaatttgaatttaaaaatatgacaacttcaaacaacattttcaaataataaatgattttcatctaagaaagtcatcaacgacaaagttgtataactcatcaagatctataacttttatttttgttatttcttcatccgataaagtgttagtaacattgctaacaaaattgacatatctgtgttatagtttataaaacaaaatgagagatatgtgaattttgtaaacaatgttactatcactttgttggataaagaaatgaccaaaataaaagttatacaattttgttgtgatgaccttttcaattgaaatcatttaatatttgaaattgttgtctgaagttatcatattttcaaattcaaattcagactgttcaataaattttatatagagaaattaccaaaataaaagttgtaagtcttgataagttatacaactttgttgttgatgacttttctatttgaaatcatttagtatatgaaagttataaaagttatatcttttataactttcatattttcaaattcaaatacaaatagtttaaaaaatgttatatagaaaaatgaccaaaataaaagttatacgtcttgatgagttatacaactttgttattgacaattttcacatttgaaaccatttactacccgaaaatttatttgaatttcttatattttaaaattcaaattttatatagttcaatcaaacccgaatggagaaatgacctaaataaaattggtagatctcaatgagttctacaactttgtttttgacagttttttatatgagttcatttcgtatcataaaattcaattcaaaatttatttttgcctaaatgtctgatttgactcctcatcatgttaatacttgctaaatatatatttgatccaattaacttggttttgctggtgaaatatgtgaaatatgtgataaaatggatgttatgtgaatgtggttgtgttaaatatattgatagttgtgtatgtgaatgaatgtacaacttcttcttcagaagccgaatcccaaagtgctctgaggttaagcgtgcttagggtggagcaatctcaggatgggtaacccgactgggaaattcttccctagaagagcaatttcgggatgggtgaccaaccgaccagcccacgggcatggctagcaaaggcctaaggctagcaaaaaaataaaatttatttatttttagattatactcatctgtgacgggctataatttaggcccgattgagataagagtcatccgtgatgggctatagttcaggcccgattgagatgagagtcatccgtgacgggttatagtttaggcccgttagagatgagagtcatccgtgacgggctataatgttagcctgattgagatgtgtgtcatgcgtgacggccggatgcccgattgagatattttatcacatcagtgatctttgcttagtgaaggggcgttacctgatagagatgaggctttaggcccgttacacatgaccgaacctgctctagtgtggatgccagcgccgtcaagccggccaccccgtccaaccagtgccccgacctcgtcctgcccggtgccgttcccttcctttcctcctctgcccggctccgccctgactcctcccctctgtgccgcctccctctccctacgcgcaaccgcgccgccacgcccggccgccgcccgcgccgtcgcgcgcctgccgcctctcgctcggacgcacacgcacgtgagacgatgggaacgagagagagacataaggcagacaaattgagaagaaaaccatgagagaagaaaaagaaaaaggaagtgggacccacccttttgactcctcaccgtgagccctttttccctctaaaagtctacatcaagtccccctttctcccttgggccacccgattaacaagtctacaaggcattcttcttggccaagcccaggaaatcaattcctacaaaagtctgtattatttccctcctccaaacctcggaccgtagcccatcagcaatcatcacctccaccaaagtccatccctcctccatttcataggataatcttgggaatatttcctccaaattctgggaaatccttttcctccatttataaaaccatttgaacttcggaaatttgtatcttgcaaaccgtaactccgattgggtccattcaacttccaggatttctctaaaatcgacatctatcaaatggcactactgaattggggggttttgtactttatttgtaggattttggatgtttatctcttattgaccgcataggtgatatttttgatatttaacgaacgtggatttctcaaagatattggattctaaaagcaaggcaaatcactacacatccctccttgagcatgttgaacctatctttataaatgtggtgattaaaaataaaattgcatgctatttataaactgcgtacctaaacttgaatgtaacccacccttgatattgttacatttatatatttgtatatccttgttgcatgagtctattatttatacgcggtcaattattgacattgctagcattgcattgtacagacaattatagataccatgtttattatatggatatggatgtgagatcactcgatgcgagtgattaatggtttatggctagagacatgagcgccacccgcgacacaaaaaccttttgcgaaaactaaaacttaataaaacaaaacaattttgactggagtggcatggatagaatatgggtggatctatgaaacggctagtcgccgaccctggtcaattaagcaccgagtcaaaaagctatacagtaaacaaaccgagtacgaccgcacttttcaaatgggtaaacccgacggactaagaaattctcgtggggcggcaccctagtcatggtggttctataggacgttggttttgttgcagtgttgtgatttggataatgtcaacgaaaccaaaaatgcgcctaactatatttaaaatgtaactgcctgttatcccgggagtgccaggactcccttcacttctggctcgaggtagggatggtttgccggggtgaaatgggcgctcattgtccttggagcgggtgccgtaacacgagggtgactgaaaaaccagaccatgacaagtctcatgtgtggggactaggctcatgggttgggtatattatggagtgcgggattaaaataatacatccactgcggtgtgattaaaccaatctattcgaatagccttgctcgcggttaatgagcgccgagacttgtattactctagactagccccataagtttttaatactgcttatattagaaatggaaaggaatgtgtgaccttgcccgatgtgtgggaaggtcgatatggtaaagattttataaaacaggaggcttggggaaggtggatgaaccctcgataattaatgacaacttcaacttaacgacttaacgtcgataatctaagtcatagatttgtgaaatgaattgtgaaaactagctttatgcaaataaaccaagccatccttgaacccctgtgtgcactaaatgcatcctgtagtggtggcttgcttagtatgattggtactcgccattgcttaattaaattttttagaaggagttgttggagccaacatgtatgtatgctatgcaaacaaagattttcaaaaaaaaaacaaagcactgctacaaacctgcgtctaaattgaacatggagatatgtaggttcttcagaaaatagtcattatacaatctccaatgactagccaatctatcctgatcaattactgcatgacctaaaacagacccaccacgcactgtgcactgcgtgacctaaaacagacccatcgtcgaactcactgtgcactatatcaaccgccgaagaaataaattcttcgtcgccattagatgaagactcttcgtcgcatttggaggagggtgctttgatgactcatctctttttttttaccaccaagttggattgcaagggagagacggccaacagagggaatggagaggtggctagcagcagtggggggatatgagagggtgttagtatttcttaacgacattactagaaatataattcccagcaatagcgcagaaatactcctggtatattatggttacagagttcatccgtaagcgcacggatatatcattgtagcatttcacccgagagtattccaagggtaccatatttatttaatcctgcgggaagatcatagtagagaaaacatgactaataatttatatgttatttgtagtaatcatattctaagtagaggttaagaaaatccaagggtagagtgacacacaagcatggaactactcattctcatattaaaatatctaagctaaatgaaaaaaaaatagaaagagaatctattcctatacttctagtatacatagtatacatacatcctagttatctgatatactagctaataccctctatccgatacccttctagtacttcgagaagccacccctaactgccgagtaccttacgacagcccgtcatgaccatacaaccggggctaaatacggatgagtacccgc

SEQ ID NO: 4980 - DNA, 3124 bp, Oryza sativa
aagccttgtgctgcccgcgtctcgccttcgtgcaaggatcgccgccgaagtcgttccctcgccgttcgcctccgtcgtccttaagccgtctccgtcgcgctcgttcgtctttgtcgttcccacgcctcatcgcatggtggtaaggatccgtcctctcactgccccgtcctcgtcctttcggtgtcgccccgtacccgttgtgcggttgtcgaccccggtacccgtttactggtgtcggtagtcgttcgcttatgcgtgtggtgaccgtgttagtgtgcccgctcggtagccgcgtggtttccacgtgtgcagcccgtgtggtgtctataggagtccgtttgtcggccattcgcctcggttgacacatgggatccgcttccgtcgacccatggaccgtctctgtgtactcggtctactgtggtcccttaggttgacatgtggggtccacatgtcaacggcacagccttcctgtcttttccaggctagcgcttatacatgttttatatttgcaaaacctaatcacaataatccgtaaatctccatgtaacagcaataaacttcggatgatcatatcttggtcatacgaaccccgaatcgacccgttcaagtctcttaatgtttgttataacctaaagaaccgtgtgctttctttttatgtattgttattgcttctttataggcttgtagctttgcttgtgtgcttcgtgtagcttctgtcattccggaggtttcggaagcgtgattcgcggtcgtcaccgaaggttcggaaggctgttctctctgagcaaggcaagtctcatcatccttgagcatattgaatcccagtttttaaaattattttaatttaaattattgcattaccattttatttaaattcccgcgttatcactgttttatttagcacttcctattatcacctcgttcaccctaggaaaacaaaaccccaactagtgggtactctattcatggttccactagtatgaacttacgtagatgcttcgctgattaattaggcaacattaggtggttttataactttagactttgggagttctcatgtcatttggacattatggaatggttggcttgtgatggaactgatacacacacctcccctgtcacgcccggaaattcactagtaatttccgaacttatttgtgcataaaaccctcgtccaggaatcagccgaggtacacaaactgacaatttaatatacaaatccatcataataataactttacataattacaaaagaaaagaaaacagcagcggaattacggtctagcgaagctccagctccactcccacaggcagctcaactggggtataaaccatacgtcttctcctttgcaacttgtcttcaactgaggtttgattgattattgcaaggtgagcatatgacatactcagcaagccacacaacaaatatgcaagtgcacaaggataccaaaaggatggcataatatagggctcatttgcaaaagcagcatttagcaaacatttgagagttgtaaaacagtagagtaattaatcatcaatattaatcaacactgaacagcacacccatgctgctcaggcccaaccatcctgaacaaccatacccggctgcacagatctatctccaaaccaggaatgtaccattccaaaccaggagctaaattaattaccatcaattaccacattattattaatgagtagtgtgggactaatcaagaaagacattgttcgacccgcccataaccacgggcacggctattcgaatagttttactctggccaggggtgtaccactgtacccacaagacacaactccacaatatgtcaccatatcatcatgtgcccatgctgaacatgtcaccattagtgtagttgtgacaagacccctcgcataactcaaccaaaagcagtgcaccgttcctggatcgtagtcaccccctcaaaaaccagaggcatggactccccagcgacccttgtgggcttatctccgccacttctcagtctggtgctccgtaatgagccttgttatacaaagtgtccagccgttgcccattctggcttgtggttggcacgggtaatgtttcacaaccgaaactcgtgaaccggtccttaattgtcataagtacgaccatcaaaaccatgtgctcacaacccaccattatcaagttttagttggcacattaattaaccaatcacgattgaccaacgattgaccatcgtgagctatcattaaatatccatcattaagtaatagtgaaacattagttatcccaattgtgtgctaatgtttaacatctagctgaaccaatatataaagctcaactagtcaaattataataacccaaggtatgaaggaatagagtaattaatgcaaattggccatacaaaggaataattcacaccacacggtgacattcgaaaataaatgcacagttgaaataaatagagaatttaattataggatcaacatgctcaaaggaattgtgtttgggatctgtgtgacatgtcttgcaataacatgtcttcaattaatcttcttgaacacttctggcgcactcgcgaaccttcgaaacgacggaaacgacaagctaacacgcaaaacaaagaaaaagactaataaaaaccaaataaacaatacatataaagtaagcaaacatgtaggtcataattttagatgaattatgagacttgaacggcctcattctgacttcatatgaattaattatgaattttacaagatttaatctaattaaagcctatttaaaaaggattaaataaaattaattcaatttatggataatttaatatgtagatgtttattttatacaacttttgcaacttgaaccacattaaaccaagttacaatgattatgaatttataaagattaaactggattaaagcatttatatggattttaattgaattatgacgcaataaagaattatttttgaaaggaaaaagggatttattgcgtcatcaaaagcggtccacggtaaaccgggttcaaagagacggtctacgaaacccacggccgagatctaatctaagccgaacggacagtcgagatcgatccggtccaccacgggctatggatgacgtcagcaatgacatcagcgatgatgtcatc

SEQ ID NO: 4981 - DNA, 1951 bp, Oryza sativa
  unsure (1)..(1951): unsure at all n locations
nnnnnnnnnnnnnnnnnnnnnnnnnnnnnnnnnnnnnnnnnnnnnnnnnnnnnnnnnnnnnnnnnnnnnnnnnnnnctgcaacagcggccggaggttgaagacgactgacaggtggaccccacctgtccgtggctgagagagaggagggagggcgcggcggattgggccagctgagccggacgcaagcaggccgaggagagggagggagaaacttgggccgactttcggcccaaagccaaaaggggacttttaaaacctttttcaatttaaattattcatgaaatgatattccattgattaaaaatacttccttggctcaaatagatcccagaaaaatctaggaactatagaaacaagagaagtatttaacaaaattttatctagcccacttttatgttgagatttaacaaattaaaattagatcttctcttttaggcttttaagatcatttctaataattccttttaaacaacaatttataatttaaggatttttaaacaagaaaagcacttaacataattataattagatcattaattgattaactaattactgaattgttctttgtattattaaaattagaaattgagctccgaaaaatccgagaaaattccagagagtataattaaccttggagaatttaataaaaattaaatccatccatgctttatatttaggaaattttatttcccacatttaacttcacttgtaaattaatgaacatttaatataaattctattaataatttattaaataaattataaatcctaaaacaaaaaatcaggctgtgacatccccctctattcaaaactcccaaaatggtttgaggctgggctcgaggtgcatggttctgctagtagcacctcggccactgtaaggaccggtcttcgggcctctgttgcaaagcactaccgtactaaccacatgtctaatgggtaaggcttaactcggtgctcagtctagtcctggcaagagtacacggatggagatggacgaagtcagggctcgatcctgcctacctgtctcgggggttccggccataggcggggttgggtcggtgcttttgtccggctaggatgggtaaaagggttatgccacatcctttatgatgggttccccggccgtggaatgcggagtaaagatgtgtcttgtgggtaaagatgtacacctctgatcagagtataatctattgaatagccgcgccctcggatatgggtaagcctagcaatgtacccacgttagtggtttaatttttaaaacttgcttaacaactaaaatgtggaatggttggcatgggttggcttgggacgagttgggacctgggtctggttgccagttcggtctgaatcatcgtaggccttgggttaaggcaggttcgtgtggattcacggccttgattaataatattgtgtagctataggatcgtgtttacaaaatagctttggacaactaagtgacttttaaatgctgtttactgcaaaacctaacccctattattatccccttgtacccccttacattaatcatgcatctcccgatgtggcttgctgagtactgaggttgtactcattcttgctatatctttcccccccttcagtaatagaagctttggagaagaagtcctaggtggagtcctggcttataccccagttgagcacctgtgaagatggagccgcaggcccccttgtccgctgctgtttatttttgtttgtcaagcctgaagtgcctttgtaataatgtaaatattatcgatataataaagatgtgccttttgtatcctgtttatgtggtgtaccccggcttttcatgggacggggattaatacactagcgttttggaaaaagtatttttccgggcgcgatagtcacttctcttcccgagcaaaaccctagccgtgcgcgggtgctagcacatcttggcgtggcgttccgtccatgtacgtgtggata

SEQ ID NO: 4982 - DNA, 468 bp, Oryza sativa
gcttgcaggtcagatgataattcattgaggttgattgccatagattgataattctacaggttaggagtagtacttataacgtatagatgcaattcagtttcaacagtcatgaagtgttgatgaattatgaagagctcaagcaatacatctctagttgcatctgtagcccatctatcgcagcaagaacagcaacaatcacgagggggaaggaagattagggaagcgagtagggtggatataccttgatgtagatgttctcggcagccttttcctcctcgccgagcaccttgccgccggaggagaggagccgccacagtgtgagccacgccgccagcctcgcctgaaccccctcgcattgactcccttgcctgaaccccctcgcattgactcccttccgccgccgtaccaggtcaccgccacctccaccgaccccatccacgccggcccgcctccgcggctccgccaccg

SEQ ID NO: 4983 - DNA, 245 bp, Oryza sativa
caaaacatgaattattttcattacctcctcagtcacttgagctctagccctctgatgtctagcaaccagctcagatagaacttcgatgagtcgttgcttcacttcgccagttaacatccttcctgccttgtactcctggtattgggaaataaattttataatggataatgagtttcatatataatggtagtgcaacttagttttccacaataagaaatgcaccttctttatgtgctcaaagctca

SEQ ID NO: 4984 - DNA, 904 bp, Oryza sativa
gctctctccatcccctctcctttcccctccggggccttatctctccctcccctactctcccagcgcaactaccggagggcggtgacggcagcggctaccggtgatggcggtgagttcgcaaagggtggaggaggcggctgcggagggtggagaaagaggtggcggcggcgttaagggctttcctccctgggcaggagggaaggcagcacatctacaaatagtggcggtgccgagggtggctgatgcggttgcggcgcggacggtccaggcggtggcaccggtggctccctccctcccaaatatggccggagggcggtggcggctcccctctcacatcttcggtggaggcagcggtggagggaagcggtggtggcgcgaagggtcaaggtggtagcaggtcctggcagtggcggcttccctctcctccctccctctcggcggtggcaacgcggctccaggtggtgccagctcccagcggcagcctccctccctcccagatcaggccgaaggggggaggggctgtagcggcggcgatttttttggtagcaattttttttgttcacgtaaactattttcgcaggcgggccgcgcgtgcaggcggaccttcccctcgccaaggaaaatctggaaagacaatttttctagtagtggtagatagttcaaaagaaagatgttgtcgaacgacaactgcgtcacgtcgaagggtgtggttctctcaatagtagttgaaagtagaaacaactgtattacctggtaaaaatttttcagggatcccccattacatggccataagaggctattataactctattgcaggctccctctcttaggttttaggcttacaggggaatttacatggttacccttatgatagtgacattattaagggcacgctatctctttt

SEQ ID NO: 4985 - DNA, 912 bp, Oryza sativa
tcgctggcaagtccattgcctctggttttgacgggcagatcatgatccaggaatgatgcactgtggtaagttgtgctgtgttacaggtattgtcaaagttcctttccaaggtcccgtggtggtatagaggtgcatggtgacatgttgtggagctgtgtcttgtgggaacaatggtacatctctcatcagagtaaaaatattcgaatagccatgtccgcggttatgggtgggtctaacaatgtttttcatgattagtctcacactactcattattaatgataatactgtgataattaaattgactcctggtttggaatgatatattcctggtatggaggtttaatttgtacaaccagggttggttgttcagatggggttgggcctatgcaacacgggggtgttgtatagtgtttatttaatattgcttaattacttaactgttttactattctctcaaatgtttattaaatcttgtttatgcaattgagctgtattatgccatcctttgttatcctgtgcacttgcatatttgctgtgtggcttgttgagtatgtcatatgctcaatcttgcaatattcattcatcagaaggagtacttcagtgaaggtgatgatatggaggattaggttttgttcgggtcaagttgcttgtggagtggagtcgccatacctgttccgtctattgtttttatttccgctgcgtagaattttattcttttgagaggaactatctacctctgtaataattatttatttcgcgagtattaattagatatttgatagtactctattatcaatttgttattgtgtgcctcggctgattcctggacgaggatttaacgcacgtgtaagcgtttggaattttggataaaaattccgggagagtcgacctgcaggcatgcaagcttagtat

SEQ ID NO: 4986 - DNA, 688 bp, Oryza sativa
gaggcagccattgcacaatcacagcttatataaaccccttttatattctaactttctaaggtttgtgattctgagatggacttgatggaaaatagtagatgacttgatgtatgcatttgatgaattgatttgaactgattgtaaatctgtgagactgtgacttgatgaattggtgacttgaagaattgttcatttgtttgtaaatctgtgcttgtaaatctgtgacttgatgtatgcatgatttgataaactggtgacttgatgaattgtttgtgattctttgacttatttgatgaattacatgtgaatttcatgaatttgatgtgttatgtcaatttgttgtgttgaattgaacctttgaaggggttttttgccagggcgtgcctgggccggcacgggcacgatgggcttgccgggccgtcgggccagcccggcacggcccgaggctacttgggccgtgcctgggccgtggttgtagcccgtgggctggcacggcacggcacagcttgttcgtcgggccgtgccggcccgactgacctcggcccaggcccggtcgtgcctgggccgtgccgtgccgggcggcccatatggccaactatagatggaagatatgacatgtgggcccaagggtattttaaaactttcacgtgatttctctcccctctttaaccggaaaatattattttaa

SEQ ID NO: 4987 - DNA, 675 bp, Oryza sativa
  unsure (1)..(675): unsure at all n locations
tagaggccctcggcattgatgacgcgcgcacaatgcttgccgcctcgccccttagcgcacgccgggtagccaagcgaggaagctgggccacgccgccgcacgcgcatgttgaagggagacgggtcacgccgctgcagtgtaggtggaggagaggcgaggtgggaggaccgtggtggtcgccggtggcgagcggaggtgctattgcggctggagtgtgagagggagtgagatgtgggggaagaatatgacaagtcgacccggggcatttttgacctttcatgttgtttatctctcctattcaatcggaatttaatattttagtgtatgcggtgcccatcaacaaataaccacattttgagagtgtcttcccctaaagatcgacttttgacgtgtcctagagttaaaaccacaaattgtagtgtcctacaacaataattgtcttttctttttgtaaaattggtttcacgtcattgaaagttttcgaatgttggtttgcaccatcgaaaggttccgttgcactttaatacttggaaactttcgatgccgtggaacctattttacctattttttatttattgattcccaaagctattcacataacgacatgcagtggnnnnnnnnnnnnnnnnnnnnnnnnnnnnnnnnnnnnnnnnnnnnnnnnnnnnnnnnnnnnnn

SEQ ID NO: 4988 - DNA, 675 bp, Oryza sativa
  unsure (1)..(675): unsure at all n locations
nnnnnnnnnnnnnnnnnnnnnnnnnnnnnnnnnnnnnnnnnnnnnnnnnnnnnnnnnnnnnnnnnnntttagaaaaatcagcacctatatgcatggaggtgtaggcaccggttcttatgacagaaccatcatttataagtgggccccactaacggtccaccaatactttcggaaggtgggcccacttataggtgctgatttttgcttgggggtattgggtctgtttttaacatagaaccagtacctataatagaaaataggtaccggttttgtcctaagaaccagcacctattgtgtgcagtataaatacctcctacttacctcaagctggccaggagtagacagagctagtggcgcctctattctactcgtctagctagaggaggggaggttttgccttaaattttttatttaaggttaatttctctatattctatctccgnttcttttattgatgcatgtgttttcactagttgctagattttagcattttggatgtagattttagcactttggtagaaattcttgcaagtgcattattaattaattttatagtaaaataatagtggaaatctaaataatcttgtggacgataggagtatcccatgcgggtccgtattggtgccgccaaaatggtaccgacttgaaaccaagatcccaacccgtacccataag

SEQ ID NO: 4989 - DNA, 726 bp, Oryza sativa
  unsure (1)..(726): unsure at all n locations
nnnnnnnnnnnnnnnnnnnnnnnnnnnnnnnnnnnnnnnnnnnnnnnnnnnnnnnnnnnnnnnnnnnatttagggacttgaacggcctcattctgactacatataaaatagttatgaattttacaagattaattccaattaaagcctattaaagaaaaaaaatattccaaattaatttaacaatttataaataatttataactgagatataataagatataagactaaaaactggaatgaatttagttgacgatatttagtaaaaagacctaatatgccattaaaaagagataggtgactaactggacatatgacaaggcaagcacacgcactgccatgcgagcacgagggccggcgaccctaggctacgacggcgatggcgaacggctgcacgacggcggaaaccgagagcacaaggaggaataggaggacgcgacgattcttaccaacacgagaaaaaccagcggacgggcttcaccttggcgctacgttgccgaagaaaacgacgacgatgtccagcaaccacgaagtcgacggcaaggctcggccggaggtggagtagatcggcttcacgtcgacgaggggattccagcgggttacaacgaaaaggaacaggtggccgggctttttcttcttgcgaattcaacgacggcgacgaccacccgaggcgacgattgacgacgacgaccggcgcgggtggagacccaaaaccagtggcaacccact

SEQ ID NO: 4990 - DNA, 743 bp, Oryza sativa
attgtggtatgcctcattgccttgtgcttgtcgtactgatgagtgtgaagtactaaactactgcactgaacactatatttttaaattttaagcaatgcagtgaactgctgaactgaacacttatattatatttttgatggatgtgttatattaagcaaaattatattattgatatgttttagttggttttttctagagaactgagatcatgttcatatgttgttttgccatcgtattgcggctaattgtattgccgctctcttgttgtatggattgaatacaaacttgacatccgacaactttttatccgtttttgaactgagtccgcaccgaatccgacgtccgaaaaaatccgctccgcatccgtatccgcacgtcatccgcatccgtttaaaaaaaatggtttaggatatggtatagctattatccgtccgaatccgctctgttttcacccctatcttgaaccctggatctgctaacgtgctagagctttggtccgtccggagttgaagttctaatttaactggtaataaattttaataatttcagtccataataattatacagtagctaggaaagatattagtaattactacataaaaacgagcgtgtagcgtgcaatgggtaattttcacagatagcgtgtgtaacaaaagactatattcggatatcctatgttaacaaattggttatcctctcctcgcagttcgcttaaaaattgtctcagtttaagttaaattgat

SEQ ID NO: 4991 - DNA, 1424 bp, Oryza sativa
ttctctccaccacacatgcttctagtggctaggagggcatacttccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagctaacctgccttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacaatagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaaagtaaatcgctcaacttgctcacagcaaaggagatatcaggcctagttgcactagccaggtacatcaacgagccaatgatttgggagtattccagttgattcc

SEQ ID NO: 4992 - DNA, 4993 bp, Oryza sativa
cctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaagtcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggtgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacaatgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttatccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaacaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgcagaataacatgaacatatcaaatatgcgcaacatattgaacacgtaccgaggtgatgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgtaccgtatttttcggaacgtttccaaaacaaaaacgaatccgaatttgcagcaaaacaaaactgcaaaaggaggctgcatctgcgcaagggtgctgcatctgcgcaagggtgaggagccaatttttcggaccattcgacgcgtacgtcgtgcacgcgcgccgcctgccctgccctgccaggccaggcgagcgagcgcgcgcgtgtgtttcccctcttctctccaccacacatgcttcaagtggctaggagagcatcctcccttttaaggaggtccccctctcctagaataagcaaggtggtactaaactccacatgcatgccatctcatgaggtgggcttttgtgattttccaaagaattaatcttcgagtgggctaaggcccattcattaattccaacacacttcccagagtctttccaccgtgcatcttcggagacgtcctagcgacagctgcaaaaacaaaggtttgatcctcttttccctcaacggttcaaacgaaataacaactcccagtgggcatagtcgacggtgaacatggaagatagacgcgatatcaatgcattccgagtgatgagaaggaactaaaggtaccctttctaaaccaacacctttgatgttccacatatccaaaaagtcgagaagccccccatcacccttgagatcggtcaacaacaaaaaacacagaatcaacattcaagaacaaaatcaacatccacatatcaaaaataaaatccaagaacacagaggggaggacaccgaaggagagaaggccactgccactactgctcattgtgggtgaagtccactcttgagcgccgcatgatgggagggcagcaccattcgttgagggagtcgccgtgccagggacaattgagggagccgctgccggcatcaagtggtccgtccctgagctcacagcgatggatccaaccgcccccgtgctcgtggcggcagatttggccacccccttgctcacaacaacaaacccagcggagaggaggagggacggcgtttgtggcagagatgaggggcggtggtggcaacgtagataggagtggtggcagtaaccaagagagagacggagaggctcagagagagtggcgagagagagagagagagggagagagaggctggactctagagacagagtcatccatatataaaaatccaggtcggctcgattgtcggcttgactacctgaggagtgttggttttctaaaagattacccggttgaagcattagcttgctttagatggtatacgggcggcaatggaatgggttcacatgcccattatagcggataccagattaccggtaatataatccagatgtggcagttagccttgtgaaggactgctcccgccagatatattcacaggcaacggtgattactgaagtaattaataagcacaatgcagtgttaaattttactaaataaagagcgaaccaaataaagttggcggatccagcatgggggcggcggggtc

SEQ ID NO: 4993 - DNA, 10551 bp, Oryza sativa
atatatggaatggcgtttctgtgctcccgaaggaaccccattctcttccaaactgttcagattcttacccagaagataaattttgctacggaacacctcaaattttagataatttgctgatagatatggtaaaaacgtgttatggctgaaagacaccataaaaaactgataatttgctagagaatactttcgattcaattgaagagagaattcttttcaaagacgagaatgcccctagggccaaaagcttctgagttgaggctggagtgaaaatggaatatgatgtacgcttgcgatgtacttaaggtgatcacaaatttaaagttgcataatttctaaactttcactctaacatcatgtgttaaagcatgtggtcctaagggtattcttgtttttcttaagaatttatctccagcaaagtgttctacaagaatttatgtgcagcaaattgttctccaacaaattactattttttgggtttttttttcagctatcacatatttttgtgatgtctacaagcatattatagaaatttcgggcatcatgtaacaaaatttgcctacccaaaatataagaaaaggaaatatcctggggaaatgagctatgtgttgaaaactcatgaaaaccatactttaatattttgtaaattcatgaaaaaatattagagataggtgtaaataagaaataaattctcactaaatgttaagtccaaactcaacttcatttgagagaaagaaatgacaaacttcatatgaatataactcacaaaataaattagaagctagaaattaagaaacctaacttccccaaactttatatgagtagaactcacaaaataaactagaagctagaaattaagaaacctaacttccccagatttttatgagctgtttatcataatcgcaacttctcaaacaagatcttaagctcaactaagatagattttttaagagtgaattcagaaaactattgatacatcgaccaaactatatatcatgaaactatagttttaagaggtatatcacaaaactatagatttaataatcaatttgttacaaatttacaatttattttaaggtgatgttctaaggtagatttatgtgctataatatcggtgcagaaaaactgaaaacgaggagagagcgagagaagagctgggggcagctataaaaaaaatgtatatttaacttgtactcatatataactattcaaaaaaatgtgcacgacatagttggctagcgccacgagcgagactgcaatcaataggttgcgaggctgattctttctttagctagtgcatgtgttagacaatttcttttaccaaccccggacgaatgtcaatgcaatccgactgttagaagggaaattcactgtttaatttctagcgattccagaagagtttggtgctgcaaaattcgcagcttttctgatcttctttctcctttatttattgatctcctcaagtgggagtttgttacatactacaaacttttcttctttttcttttttgtttcatattacacacaaacatgaccgattaaaacgcacgatgcaacaaacgcgctatcccacgtcgtggcacatccgacttcggtcagaaaacgagctgaagaaacgcttaattcttggcttcactgaatataattccggtaaccccggattatatccaattaaccactacatgaaacaaaattaattaacttaattcacatgagaggtggcgtgcaacagcatcgcatcaacggtcatccccgggccgaacgccatcatcactcccaactccggccattcacccgccgccgccgcctccttgcgctgccggcgcagctcgtccagcgcgaagatcaccgtagcgccagacatgttcccgtagtcgctgagcacacggcggctcgccgccagcttgccgggctcgaggccgagcgccgcgtcgacctggtccatgatcgtcgacgagcccgggtgcaccgcccagaacaggtcgttccacccgccgccgccgtcgccgccgagaagtgggccgaacatgtccaggaggcaccgctcgacgttgtccccgatgagccccgggacctgccgcccgaggacgccgtccaagcggcgctccgtgaaccgcatgttcagggcgtggtccgactccgggatgatcgtctgcgccgccgacactatctcgaacagcgggcgctcgacgtcgtcggcgtcggcgccgacaatgacggcggccgcgccgtcgccgaacaggccctggacgaggagcgtcctgaagcagccctcgtcgggcccggtgaagtacatgagggtgagctcggcggcgacgacgaggacgcgcgcgccgcggctgttctcggcgaggtccttggcgaggcggagcgcggcgcagccggcgaagcaaccgttgaggtggagcatggtgcggcgcacggaggggcggaggccgaggagcgggacgaggcggaagtcgacacccgggacgtgggcgccggagttggtggtgacgacgaggtgggtgatgtcggcggccgggcggccccactcggcgatcgccttcttggcggcctccgccgccagctccggcacggcgtccgcggcgatgtccagccgcgcgtcgagcgacggcgcgtcgcggtccacgaactccgggtgtgcggacagcatctcctccgtgtggtgcaggtaccgcctctgcacgcccatttcctgacctgcgaccgaccatggacagcatgctctcgcattgtcactactcactaaacttgcaaaaacatatactacatccgccctaatactttgaattttaatttgtagatttttttttataatttgtagtttgtaagagttctaatttgtatatattttttataatttgtaatttgtaaaagttgaattttaacatgtatatttatcgactgatacatcacatgctaatacatctttttttttgcaaatttattttgtaaccatttgggtgatatatgtaaacaacgagtggacgtgtgaacgttttctcgagggtttaaaatccattctcggtggaggttgtatatgcaaaattaatatatcgactgagaagagttggatagtagaaggagagaggctgtcgtgtgtttacacgtacagatacgcttgaacttgtccttgagggcattgatgtggtctcctgtttgtgacgcggaagtagaagtcggggaactcctcctgggtaacgcagttgggagggttggcggtgccgatggcgagcacggcggcgagcccgtcggcgcgctgcgaccgccgcatttcgccgagcgggtataaggcgcttcccatggtcgtcgtcggtgccatgcaaacaattaaatcactgcaactaattcttcgatctcgatcgatctccgcccgccttgcttggcacgtctcgcacttttgttttgcagaccacctcacacacttatggtgtttatatagcagtgcgctggatatatgacccactgcttgtttgtcagttgccagatttttcaaaacatctacgtgtgctgttttgtgtatctatctattatctatatatctatctatctataagatatatcttaaggctgcgttcggcagctgccgattaagagaagacttatctcttcactttccgagtaattaaacggtgtgtttaattttcttcaaaaattttcaataagagttgctttaacaaatcatatcaatctatttttaaattttaaaatagttaatactcaattgatcatatgttaatggctcacctcattttgtatatctcaatcttctcttttcatctcctttcaaacacattaaagtccattaaacatcctataaacgctccacgtgacacttctacaaacgctttcagaccatcatgtgacgctctaataaattagagaaaatcatatatattctgagaaaaaaatctatccatttagttccactcaaattagtggatccgttattttgaaccactagattacgtctattaaaaattaattccgtcctaattgatttcccgtgtaagtaagagataaaatacctacgcatagcttcacatgaaaataaacctaaaacacattaccccttgaacttcttagtattaaaaatcaaccaaatctaaatagatagccacatataatgtcaaattacccgtagcaaagcatgtgcattcaactagtttacatttacatttatatgctcctaattgtcttataattaagtgccttatatatgtcgccttccactttggcgtgcagtgtaaagtttagttctgacttgattaattaggcaatttcaatattaccaatcaataattgtatgttatacttgcattggtttaaaaccgcataaattttagtgaaattcaaagttcatcttggagtcctcgtttagtttttttatttaataactcaaattcaaaattaacgattctagctagatgtacactagatgtagattgaattgttatgattcgattagggcacattatttttctagttacgttgtttaaattatcaaatgtttctcttttagaacattagtatcaaataactacgacatgttctttcttagcagataatggataatccggctttgacttaagaacaagctacccccacttcctatgaagttttcaactgaatcaacagtaaatatgcatactaatgaaaaagatgacaagaaggagaaacattattaggaggcttcctattggtgaatcttcatccaatgttagtgaagatttgcatgaccattttctccaaactctggcgtacaatacatatatgagttccttgtttttatcacacttttatagttgggcccaaaactgcagccaataaatataaaagtacttgcatataagatttaaaagtagctctgtcaaacaccatatcactcatggtaaaccaaagaacctaacataaaatatatggatctactaaaataagctttatggttcttacgtcaacggcactaagctaactcccccaaaatgtgaaacattatttggtggattcaagccaaaataaatacggaccaatctccaaagaaatttagcaaagtgacaatcaaagaatatatgttggacagtttcaatatgcatacaaaagcaacatttttttagtactagcccaatttagtcttgctaaattatccctgtttaagatatcccctttaattaagcaaatatcacataaatatttttattttaagaggaatcccattttgttcttctcaatatatataaccattgttgattgcagctaagtacataggatggatagagaacataccattttgatgaagattccatcaaaatatatctttatcctcatttagattaatatcccaaatcattggttcattgatgtacttggctagtgcaacgaggcctgatatctcatttgctgtaagtaagctgagccggtttgtctcaaattcgggagatgatcattggcaggctctggaaagagtaatgcgctatttaaagggcactatgagctatggaattcactataccgggtactcaaaaatactggaagggtatagtgactcaaactggatatctgatgctgatgagataaaggccacaagtggatatatgttcacacttggaggtggcgctgtttgctagaaatcttgcaagcagaccatcttaacgaggtcaacaatggaagtagaacttacaacactagatactacgacaattcaggccgagtagcttcgtaaactcctgatggatttgccggtggttgaaaaaccagtgccagctatcctaatgaactgtgataatcaaacaatagttattaaagtgaacagtttaaatgacaacatgaagtcatctaggcatatcaaaagaagactgaaatctgtcagaaagcagaaaaactccggagtgatagcattggactatgtccaaacggctaaaaatctggcagatcagtttaccaaggggctaccatgtaatgtgatagacagtgcattgagggaaatgggcttgatacccacctaaggtcacacaatagtggaaacctgtccattgtgatcggaaatcccgtgaatttggatggcgaaacaaactattgtgtggctgagagaagagacccttaaaaatggctcattttcatgatgtacttctcttctattctgcatggtaggatggcttatgccttaatgtggtccaagtggcttttctaagcagagatgttgacctgcagaacatctcaaaaggaacacacctatatgagttcgactgctagccacagtctatgagatttgggcgatctctagatactcatgaaagggccttgagtttgacttatatgctccaaaaagaggggatgcaaacggcaacccagtaccaatcaagggtttgagtgaaacctgatcacacaagactaacaattcaaggcatagtccattgtttagttgtggtctgatgtagctcattttctaggtggaagttcaacttaacagtctctaccaaaacattggtatatcaaacaggttcaactttgagaacatttcttatgagccatgaaatttggtggggattattagaataaatgggctaggccctaattttctattaaatctcaaggccccataataaatgttaaggataataataccaccctgagaattaaaagaggagtatctcaacttaaatagggagttattggaggctcgctgttgaccggttgaggtggggattagaaagccacacgcgcacgcgcgcgcgccgagccaagccgagccagccggggcgaggctgtgggcgaggcgtggcgtggcatgcgttgcgtctctctctctctcctttttgcaacggaccggaatccaatcccgcgagattgcctctgtaatggatagttgattcaatgcgattgattgcatcgttactgcggcaacgggcggattcctctcctgcgctattaggaaatagagcaccccgatcagatctcaaggcttagtttccaaacgctggttcttcctcctcgcgcctgtgctgcttctgtttttcccggttctgatcgcttgcgcacacgagagatcgggacgaggagggcctctaaaaccacacattcgcctaagatctgcaccgggtaggcgggtgatcaggtttgcacgactgctcttcttctgttcgtcgtctgttcatctgcatcaccatgtctggagttgtcgcacctagagatggcacacctggagcgggagccggagctggcgccccgatcgacaataccaacggaggcagttctgccacataatccagcggagggactttcacagtgtataactctctaccgctatttctgtttttgttacttctgttagtcgcaatgctattgcgttctctacatgatgatgatgcttattctatcttaagcacgctcctggttatgtttaattttatcactagatcacctcacattgttcatgccatgattattgtcttaatattttggattaaaatatgccgatatatgactatatttccaacagttacatgattacatccttacaaaatataagaatttacatgttattaagcagatattaaggttttaaaaacactttaacactccttatatggatggttaggggtgggaaaatggtaaagatatatatatatatatatataggtcatggttaatgggaccctttactctaaacaatgccacatgcaatcagttatattttaatatgttttaaatgctataagtgcttacctttagcatcaagcatgtggtttccccgccgtcgtgcagctaaagatatatacacatgcatgacgccatcgtgcgtgaaatttcttggtacagactcgcggtggcggatttatgaatttttttttagcctgcacaaacctaatgatagaaaataaatttacaagcaaatacaaatccatatagcattttatcatgaatagaagtaaattggctatcatcatttatatactaaaagtccattaaacttcctacaaacgctctcaagccgccacatggcctcctacaaacactcctatgtcgccacgtggcattttataatctcaccgtcgattttcttttaaattggtggacccgttaattttaagcgttagatctcccttagagaaaaatcatccccactatttttgagaaaaattaccgtatttgctttaactaatagatagaaaaaaaaagagaataccataataggacaagaggccagtgaggatcgggcagggtacatacgttctttttttttctttttctggtggcatacgttctattttttttcctggtggcatacatacgttactacgttagtatttttttcgcctttttttttggcaaacaatactttttttgctttacacattcggcaaacagtactattactacgatacgatacgtacatgtacgggagtttaggggggaagtgttaatagatataaaatcacatgttaccaatttaagggaaaatcgatggtttgattttttttctcataatttttaatatttattttaatttagagatatgacatgtagtgacctacaagcatttatacgagcgccacgtgccggtttaaaagcgttcgtgggaagttcaatggacttatatatactaaaagacaattaaacttcatatagacgctcatataaacgctcatacatcgtcacgtgacattctataatcacaccgtcaattttcttttaaattggtggacccgttaattttaaccattagatctccatctcaaagaaaataaatctggtatccccactactaacaccttacatacatgaggtaaaaaaaagctgtacatactctttccaccctccgaatctcccctcctctcctattttctagctaacttatcctattttataattaacactcaatatatcaaaaaaataattcagacatctaaataatcataaccctcaagttacaattttattctcattttttgttaattgttgtgttatttataattaaatataaaattcaaaatccatattgatcatattttgttatctaaatattagatcatgcaaccattctaactacaaatgtctaggcctaatggtacacctataaacgcttctaagtcatttgccacatgacactattaaattaaaaaaaatctataagtgtgacaaatgaaaacaaaacatctaaccatcagtttacacttgaatcaatggatgcactatcttatatggttagatctatctttaaaaggaaatcccaaaactccgtcccaaccgtttgtcccgttcctctctccctaccattcattatctgttatttttatctccatagcaactaaatcgaaaattatctttacgagaaaaaaaacacacccacaaatggactccgtctaacaagtctagcgagcttttcctttgccatgtgcttctcttctctttctccttaagctagcacttatagaaacaacctaattagaatttaaaataatcgtaaatttttaaatcttatattcaatttatgacatttttaaactattgtaagtttcaattaaatcaataatttaatacattgtggacccatctattcaccttgaaacctccaataaataaaataaaataccaaaatttctaattaaaaattaaaatatcccaccttatgtttttaatagcagtcaacccattatttataccatgctaaatagctaatggccttcttccaactccttctgttttagattacaagtcattttaaattttgtctatgtcaaattacttgaattagtttataaaaacatagtaacattttcaacacaaaacaattatattataaaaaacatattcaattttgaattcaataaaaataatttggtgttgtaaatattgatatatttttcgtcaacaatggaagtagttaatttctcttaacattcaaataggggctatttacagatacttagatgcgcttttatgaataaatgatcttttttagagataaatagacgttcctaagatcatcatcacatctaaattatacatattatatctgatgtcactaatagattagagtaaaagcttttaattatatcttttttcttgtcataacgtgtaccctgtctaggatctatttgtcatagacaatagattgaaaacaatcaagggatacttttatcccatgccaagttgtatggccttaacccacttatatttccataccaaattgcagagatcaaaacatttaagggatgcttgatggaatggaaatctagaaaaaaaatagaaaaataacatgataaaaataattgaacactgaactttttttttcttctaaatttaactttttttgaatttgaaacccattctaaatagcaatgttcaaatattttaggagtactgatacaatgaaaataactaaaattttaaataacatataatagaaaatagaatttttggcattatgttggaaacaaaatctaacataatttcagttcgaagtatacaactctaaactacaacttgagagcgataaaagtctcattttttaatatattttctgatttagaaaaacttttactgctaaacc

SEQ ID NO: 4994 - DNA, 13150 bp, Oryza sativa
  unsure (1)..(13150): unsure at all n locations
cgtgtaccctgtctaggatctatttggcatagccaatagattgaaacaattcaagggatacttttatcccatgccaagttggtatggccttaacccacttatatttccataccaaattgcagagatcaaaacatttaagggatgcttgatggaatggaaatctagaaaaaaaatagaaaaataacatgataaaaataattggacactgaactttttttttcttctaaatttaactttttttgaatttgaaacccattctaaatagcaaatgttcaaatattttaggagtactgatacaatgaaaataactaaaattttaaataacatataatagaaaatagaatttttggcattatgttggaaacaaaatctaacataatttcagttcgaagtatacaactctaaactacaacttgagagcgataaaagtctcattttttaatatattttctgatttagaaaaacttttactgctaaaccatagtttcatactgcaatactatataattacaattaaatcattatttcaacatattcagctcatttaattagatcatgtaatcgtattagccatatttttaatagaaaatatcttcaattgatatatcctaaaattcaaaaaaacatatatagtgcaaaaaaagatgctaaatattaaaaaaataaatgcattatgtacaaatgcattatgtagaagtgatatatagtttcatatatatatttcttataaaaccaaatttgcacagttttaagtaattttagtttagaatttatacgccagcgatgtttactagcattcaaaaaaacaccacacaaattattgaaaaattaaacatgtttacaatagagtaatcataaaaattcctaatcaaatttctaacccagttaaataagatgcccgcgcatatgcgcgggctaccttcctagttatatactaaaagtccattaaactttctacaaacgctcttaagccaccacgtggcactcctacaaacgctcttaagccaccacgtggcactatctaatctcaccgtcgattttcacttaaattagtagactcgttattttacaccattagattagatctattatttaaaaataataacttcctcatatattatataacatagaaacgttaatataacatagaaacgttactgttcagccatagagtttatatacgatacagaacgttacgtacgtattgaaaataaaacaataaaactttcccaatgttacggtatttatttaaaatatgattttctacagtataaagataaaatatatttacttcacaaatataaatatatttagtcaaattaagatctattataaatatccaatcaatgttctttaaaacatcttataaatctatctattatctatcaactatatatatactaaaagtacgttaaacatacgacgaatgcatttacgctgctacgtgtctctctaataaattagagaaatcctagaaatttatttatatactaaaagtgcattaaacatcctgcaaaaactattacgccgtcacgccgtgctataataaattagagaaatcctagaaattcagagaaaaaagaaaggcatatgatcctttaatttttacttaaattggaggacccgttatttaaaatattagtttagatctattaaaaatcccatgctgctaatctctatctggaaaaaaaacataatgtgcgtacgtcgtacgatcgtctccatcctaaaaaaataaaacttaaatacctacaccatatacgataaataaaacagataaagccaaataaataaaagaaaacatgcacacgtacatagaatcggaaagaaatactaatcgtgaaaaatcacactgatgtgttgtcaacatcctttaaactattattttattaaaaataacactacacagatatgcacattaaacttaatctctgatagataaaatgtcaaagcaaccgtctgacaaaacctaacattgtgttttaagtacatctgttttgggttatttaattttggagatcagattctcaaaatatttggatttgttcaaaacttttttattcttatttgatgagtgagaagcacaaataatagatagatgagaaaaattaaattaaattttagacagtggttttgcgataataaaactacagaatttagctttggtttttaagtggatcattttatgtttattttgggtgacattgagattttaagtatctgaaattttttttattgctatttgaggagagagaagcatacatcatagatagatgtaaataaacaaataaacaaataagaattaggcagttattttgctacaatacaatccttaattcatcatgagaattatgattatccatgtatgttttttctttgccaagtagtattggcaaacatgaacaatccagtaaaacacgtataaaactataaattctatatactgagtataattgatggacgaatgttatacacctctgaacccaattttgtcaattctttacctcaaatcaactcaaaacttaaaaataatactgtttttgccacctcttcctttctgtatatatctgtccttcaatgttgggtgtattacttgctatgccatcataaatattgtagagacatgtaaatggttgagttaaggtggtgtcctaaaaggccaccataaccaatgtaactaaaatgacatacttaccaatgcaatcatttgtgagtgtgccaatagtgaattgagtgttaaaattgtactttaagatggtctttaagggcacagttacatcgatgcgaaacccgtgtttcaaggcattatgtaagaaagccttagttggctgctacggtcgacttcatctgttagaaaatcattcatgaatatttttaacggtgttatcgtattatctggtagatatgatatttttagacaatttatacatagatgtgaaaataagttatgcacactgggttatgcagtgtagatgatatttttagcgtataaataatgtatcatttattttagtggtacaaatacagtttcttttattaaaagtgcacctaactttcaaaaacaatgatagtaagtagtggtgacaaaagacgagtttatatatgaccaggacaaagggatttttacttaaatctaataaacattctatcacatttagtaatctataccatctattttacggcaaatatatttgttttttttatttagggtaatctatattcccttacaggatatatgtattaatgtatatactaagatatgatttattttagcattctttttcttgaacaacaaataagatgcccgtgtatatgtgggggtttcttttccgatttatattctgaaaatatcctccattttatattttgtccttacattggttgaaacatagcctatgatacatgcatgcgcgcgcgaatgcgcgggctaccttcctagttagtataataattagtgctaatctaaatggtgcatgtatggagctcatggttagtttctaatgtatggatacatacggtggagcccggatgcctatccgtgctggctgggccttggctccgtcgctggtacagagaatgaggttcaaattagttactactttcgtcccctaaaatatagtaatcagaatatttcctaatacgacaatatatagacaggagatctaccccgattcataatattaagatgtgtcatattctacaaatggagaaaacaactcatgggacatgtatgtgatgacaataaataaactatggccatgtttactttatgtgccaaaatatttttgaagtatatggacacacatttaagtattaaacgtagactaataacaaaataaattacagatttcacctataaactgtaagacaaatttattaagcctaattaatccgtcattatagcaaatgtttactatagtatcacattgtcaaatcatggtgtaattaggctcaaaagattcgtctcacaatttacatgcaaactgcgcaattagtttttttttcatatttaatgctccatacatatgtctaaacatttgatgtgatggaatttttgaaagtcggaaggaaacactgcctatgatgtaggcccccacctagctaggttaagagctgatgtgaaagggatcgatccctaggttaagagctaatgtgaaagggatcggagtgaggttgaacctgccgacatctctgccaatatggtcactctcagtgagagagtttcattctcactaaatagtgtcatgtcaatatttatatgacgtctcttaaaaaaatatttatatgacgtggcaagtaattaataaaaaagagatgaaatgaatttcatctcgatgaaactatttatacaccgttttcaatgtgacttgtttctacatgtgttgcctatgaaacaacaaaaataaaacagtatattgtgttagctatttcaaccatcaattaaatgtcttactacctccgtcccaaaataagtgcagccgtagatatccgtgtccaacgtttgaccgtccgtcttatttgaaaaatttatgaaaaatttaaaaatatttagtcacacataaagtactattcatgttttatcatgtaatagcaacaaaaatactaatcataaaaaaattttaaataagacaaacggtcaaatgttaaacgtgaatagtgcaaaactgcacttattttgggacggatggagtattctttatatgacactcttttttttttactgaactttatatgacactcttagaaacataaaaataaaacgtcccactaggaatgacgttaggccatttttcacatagagttccaagagtgacacgtgcatcaaacaaagaggttcggattaataaataaaacaaacgcttctaacgcatttcgtgatttcatatgctactcataacatttagttgttgaattgtgttgttaaaagagttgataccagtacgatttcatttttaatttcaaggcacgaaatgaaatgattctgttgctgtgggttttattttgtttctaagcattcctaatggataaatgcatatatatgtagtttcatttcttgatttttaggttgagattcctaacagattcaagttgatgaacaaaactaatatatccaatgcacaattttatttcgtggtttgatatgtcgtccatagtattttattattgaattgtatcatgaaactatttggttataatagggttttatttctgttttcaagacacatgagataaaatgaatagggttccattctgtttcgaaggcataggtaagtatgtaaaacaagttttttaaaataaaactcatttcttctcacttgtaaatttcttggcatgtcattagtttagcctatgtgatatcttatttaataacatcgaaactcttgttaaacatgcattggaaatgacctaggtattaaaatttcacctaaatgaaactcattcattttctttatattttttcagtttagccttatcgtttaataagattgaaactcttacgcaacctgtcctgaaactggccttaggttaggtgctaaggagactattagagagagaaagttgagagttcttttaagactatagagaggagagttgacgttgtccttcaataaacatccatgtggacaggagtctgactttctccatagctgtgccaattttatatgttcggtgtacgtgaatatagaagagagggaagcgagagaggacacttgacttcgcccaatgagaaacatcggcatgccgattttgtgacgaggttcggtgttgacgagaataggagggagggagaaaaaagaaacacacatgtagatggatcggactttttatatcttacccttttttaaaaaaatcttattttacaaatatactcttaaaaaaattgttctagaaatgaacatttttctcgatgctagaattattggtctgagattcaatgtctcggtgccaataacattgacatcgatatcctcgcttcttgctaaagctaagtcaccgatacgaaggatcggtgcaaatgacattagtgctaaagatctatttgtaagaaaaaatatttgaattttaaccttttctgaaattcttttataaataaatccttagtgtcagttagtagcagagccaagcctgatcagcatgggctagtggcctagtgcccagtctccgccaaacgaacgcgtgactttccagttagaacattaggcaaaacagtgattacccttgctagattatttggcaaaccagtaaagaatgcatgacagcatgagtgctcgaactagattatctaggcaaactatcgaagcaattaagggcaaagcatcacaattcatgtattaacatatagcccactaattaagtaatacataattattgtccaatcaatctaatctattgatcaaaatggtttttctcttctaaaccacaatttgatagcgttaacttggctttcattaatgatggatagcccatagagttgtatgaatatgtgtgttcattagaattgcccagattttagaaaatatatagatccgccactgctgccagtgttattgtaactaaaaaggattaaaatataaaaaatgcagggtaagtgaagataattaaacaattaactgttagtgtgtagtgttgtttccaaagggcgatttttgttgaaataagacatttatctcaaagttgatacaactatcattagattgcacagccaaagcaaagtttttgggtgaatacacactaataactatcagtttgcatactagattgtgttagattaaataagctggaccaatttaatcctaataaattctatgtgcccataattaatgttaaggaattaatatcacgttgaaaatcaacgtggagggatctcaacttaaatagactgctattggagagcaattgttgagcggttaaggtggtggtggggctgccacacgcatgcgcgcgagccgggccagggcaagggctggctgctctatttcccaaacattatgttttaactaaagatgtaactgatggatgcactcgttactccaacaacgaaacgttatggtttgattgaagacataaccaatggaggtgctcgttactctagcaacagatggggaattcaatcggattgattcgggcgctctcattactccagcaacggacatttcaatctcgacttgattcctcctggaacattactctcttgtacactatataactcccaccttctcgttactccagcaacggaacgttatgttttgattgaagatataaccgacggaggcgcttgttactgcaacaatagacggagaattcaatcagattgattcgagcactcccgttactccaccaacagacagagaattcaatctcgatttgattcctcccggaatattactctctcatgcactacataactcccacctctagaatagacatagtacacacaaatgcccagtacatcttctctctcgaactctgattctcttgttgggaaaatcttgttttctctgttcctacgcttcttgtgtgtctctggttccgatcacctacgcacacaggacaatcaattttttggggagcgcattctagagcgactgctctcatcctcttcctcttcatctactctgcactgctagttcttcttcctatcaaaaggcagcaatggtggaggtggcggcatcgggaccgggcaccggcacatgcgagaacagcaacaccaacgtagacaacaacaccaacaatgcctcatctagtaccggagcattctccaagtaaccatgttaaccatgttattagatgatacttattttgttattgccatgttctgtttagcactatcactagatcattctacacatatgtcatgtcatgttcagtatgatgtttttctgaaaattaaaatatactgactaaatttccaccacatgcgcttgagtgaaacaacctctagctaccttctccgatattgctaacttgccgctgcaaccaaaaacctgtaaacccgatttttttggaggatagcccaaagtatggacccggtagcaaaatattacggctgccactagcaggactagcaggttttcgaattcctccctgacacatgacgaggttgaaccatatgatatggagaacattgcgtgagcagaccggcatagccctatgtatgtacctgatcacgtgacctagaacttgaattaattattctttttcaaccatatattcaacttaatgacacgaaatactattaggccaactatatggaaggtggttgattccaccggacagtgaaattctaccatgacaaactgattacgtttagctttgacggccattaatttttcagcccccaacctgattacagaaataacgattcatctagtgtcagctaaccgacgtgagagacttacgcttagttcacaatcgctatgttttttcaaacaaatttgtcaatactctgaccataaaagttctttataacttaataaattataagtggaaaattgctaatagtacaacagagtcaataatctgaaaagagaaaggtattacgtcgtttgctctgttcaactaaaaccaaatcatactaaggtacgtcgttcggagcgtcacattttcacgtccagttgtctgccaatatcgagcagcaggcacggagcaaattttcgacaagttgaataaaactgcgggtgcaaaacagcggccggccttatgctgaattatttgacgttattgcaacgacagatttttttttaatttagtcattattgccggccggtctaactcaatataggttattttatatattcaagttggtttcattattactgtccctgatgctacaagtgtagaagaaaactgtgcacagtgaattacacttcttagaaccaaagccaagtatcttttattttactttcgataacatagttcctatagatttttacaaaagttcatttatattatcgtgtagaatattttctatttcgtatttaagttggataccataaaaaaagtggtggagacttgtgccatacatcaattcttttatttatcattttagactgtccataggtggaagatgttataaataaaagaaaagcagtggcgagcagattgcctgaagccttaaaactgagtataagcacattgcgcttcaaacaagagtttacaaaaataaatttcagaagactcgggtacatctaaggtgcaaaagactataggtattttagcatgtgccatataatcccgaggattataatactagtgttttataaaaaccacataatttacgtgtactgtgtgacataacttattggttattttatatatcttagatcataatattgatggttttctgcaatttacttttttttgaaatgattatattgctcctcgcacattcgtaactgctggcttattattgaaaacaaaattattaagctaaaaaaattccatctataaaaatttgaatcagacaaaattgtttgacacaaaattggaaaaccaaatttaaaattgaaattggaggggaaattacacaaatcagtacttctccgcttcttagaatacaaaaagtagtattcttttaataattaacttcaaccaaattgagatgaacataccttttagaatttcatcgaatttgtttaagattcatttcaggatttattaattttttgtttcaaattttggggccaaataattgtacacccttctatttatacccaaaacatgattgtccataatcacgaatccaacaagcattacagaatcctaattacttaggaaatctctcaaactagggaatttctatacaactccaaactccaatattttcaaacatgaactccaattttcatgccgtgacaaattcatcccaaattaaaaaccattatctaaatggaaaaaagaatttattaaaaactaaaaagaaattagaaacaacaaaatacgtacaagaaaattttaaaatttaaatgtagcttgcagtattttcattaaattatccatagtccaatacgtcctcgtgttttacttgaatttttattccaatacgtcctcgtgttttacttgaatttttagagcaccaaaaataattattacacaataaaaacaacgtacagagttttctaagcatagaaactgaaaataaatcatccctcctccttgtgccatgtctagcccagtcttccatcttccctcctttcatgcggcctgcttcggcctccctttctctgggcctcctccacatcatggcccatcccgcctctcgtccccagcccacctgcactgcctccctccctccgcgcctgggccgcctcgcctcccggcccagccgccggtcgtcttcctcctctggccgaccgttcctctctcgctccttccttccttcctcctccattgaagccgccgccaatccgccccttcctgtggccggctctccctccccgacctataaaacggagcctcctccctcccctcgctccattttgccacctcccaaattcctagctgcctccctgtctccaccgcgccacccgagctccggcaacccctgccgccatgctcgttcgccgtcagacgttgtcggttccttccccggcaccgcgacgtcaacctcctcgccggcctctctgcctccctgcccgaagctcgttggatccgcgccctcgccggctcccgtgcctccaaccctctgccaggccattgctcctcgccggagtaccgcccggcctcgccgccactcccgtttgcggttgcatgttcctccttggctgccacctcccgagcccttttgggcgccggaacactgtcgacgccaagttcgtccatccttcaccgtgtcagctgtcctagtagcctaccaaagatccctgatgcgtccataatggactctagcatgatacttggcccaacgggcctaaagatggtgacataacacccggacagattctggatgcccattgtttcgatgattttcattgacttcaaaggggttttaatatgagactagattcattagaaaggcggtctagttagctttccatacttgtacagaacgtcgaaaatagagttcagatgagataagggtgatgattttagtgcgggctgctccagtatttttgagatggacttgaatttgatatgagatagacctccatcttgacttgaacgcccatcttgaccttctccatctcctagtctctagttctctccatagttcctaatcatatttaaatcattatgtaataattagtcctcaaaatcatataaaagaaatacctaggaacgagctcacatgtaatttcaattgttgggcatgagctctagtgattagatcttgcatagcaacttgaggaatattgtgtgtatccaaattgttgatgtctccatcatcatccccctcatgaagtagagtcgtcctcgacccaagcttatcttcttctctcaaatatagctccaaatcgaaaatgttaaatgtgggactaacctcaaactttagaggcaattcaagtttatatgtattatcatttatcttttccgatattctaaaaggcccactggctctagacgccaagtacaggaccgctggttagataactctacattgaaatgtcatttttgggagttaaattgctaatagtgttgaatgatgaatatattaatttgaaagcacgtaaagtttttatgagagcttcggaagttagagaagcatgttgattgaaacaatacaagcaatatgattttacatgccaatttgacctccctttatagtatgtctgattgtggcaacatttatttaactgtaaaattattgtagtgaaccagcgccgctacggctgggaaggaaaccagaggtgcatcgctgtcagcactggcgtcctgtccctgcatcatttgtccgcatcgcgtgcctgcagcctgttagagatagaggtttgttacatagagttgttacgtgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatatggtatcagagccaatcatgcacgcgtgagatcgcatctaccaaaaatggcgagttcctccaattccaccaccaatccactctccggccaagttgtcccagagaagctcacaaggaataatttccttctatggaagacacagatccttcccatcattcgcggtgcccgcatggaggggtacctcaccggcgcgactcgcgctccgtcggcagcgatcgacgtcaaggaaggcgacaaggtcatcaccaagatcaatccagcctatgaggaatgggttgtcgtcgatcaacaggtgcttggatttctccttgcatctgtatcaaaggacatactcacccaagtcgtcaatctggaaacggcggctgcgacatggagagtgatcacaacgatgctctcctcacaatcccgtgcgcgtgctctgaacacgcagcttgcactgttgacgacccgcaagggcgatctcagtgtcacggagtacatcggcaagatgaagacgctagctgacgagatgtcatccgccggcaagcccctcgatgacgaggagatgatgtcgtacatcctcgccggactcgacgacgattatgagcccgtcgtctccactcttgtcggcaaggcggaggctgtaccagtcgccgaaatctacacccagctcctgagttttgagagccgagccaagctgcgacagcaggctaatggttcctccgtcaacagcgcacgacgaggaggcaagggaggcggcggcggcttcagcaacaacgtcaacaccggcaacaccagcacgtttcgcggccgtggcggtggtcgcggcgatcgcggaggccgggggcgaggaaacggtggcggcgcgcgcttctccaacaaaccgcgccccacctgtcagctatgtggcaagattggacatgtggtggcagactgctggtacaggtatgatgaaaatttcattccagattcaaaaacagcagctgcggcttcctatggtgtagatacaaattggtacatggannnnnnnnnnnnnnnnnnnnnnnnnnnnnnnnnnnnnnn

SEQ ID NO: 4995 - DNA, 633 bp, Oryza sativa
atgaagagtgatcacaccgatgctctcctcacattcccgtgcgcgtgctctgaacacacagcttgcactgtaacgaaccccaagggcgatctcagtgtcacggagtacatcggcaagatgaaaacgctagctgacgagatgtcatccgccggcaagcccctcgatgacgagaagatgatgtcgtacatcctcgccggactcgacgacgattatgagcccgtcgtctccactcttgtcggcaaggcgaaggctgtaccagtcgccgaaatctacacccagctcctgagttttgagagccgagccaagctgcgacagcaggctaatggttcctccgtcaacagcgcacgacgaggaggcaagggaggcggcggcggcttcagcaacaacgtcaacaccggcaacaccagcacgtttcgcggccgtggcggtggtcgcggcgatcgcggaggccgggggcgaggaaacggtggcggcgcgcgcttctccaacaaaccgcgccccacctgtcagctatgtggcaagattggacatgtggtggcagactgctggtacaggtatgatgaaaatttcattccagattcaaaaacagcagctgcggcttcctatggtgtagatacaaattggtacatggac

SEQ ID NO: 4996 - DNA, 1545 bp, Oryza sativa
  unsure (1)..(1545): unsure at all n locations
nnnnnnnnnnnnnnnnnnnnnnnnnnnnnnnnnnnnnnnnnnnacctattggatgctgaagctatcactggaatacttaaggtggagcaactctgtttgcaagctctctgtatgaaggaatacctgggggcacccatcattgatgttcctgtcgacattaattttcccattaaagatctggaaattggtcgactgaacagaaagggacctagcacacctgtggcctccaaatcaatttcaggctctgacttgccagaatttgtaagttgatggtatgcaatgaaatgacaattttcttataaactcttatttcaagagttcctactaaatcatgctgttatgcaggtaaaaattatttcatcatgcccttatgggataggcaaattggtggagtcattgcgtgtgcaatttccttgtgtccctaagttgcaactgaagaacaaaatttgggagatagctgactttaccaataaccgttggcaggtctttaacattccgctcattattttaattgatgtgtagttatgcctatattacataataatggtattttcgagcaggttaagaaagatatcttggactggtgtggtctatctcttccaccaggtactaagccatcttatagtgcctttgctgcatttgaacatgaagtgttacttgtaactgagaacagtgatgtgatgttgctaaaagaacatctcagaagctactaatggagtttttttttctttactttaaatagaatcgatattgcatgcttttaatcaagtatgtgttgcggatgctgaattgatgaatgtggattgattaaaaaagtgcatctaactgtctaattgattatgccgtgtatttcttagattctgtgttatctgcaattctggtttgctttcttctatagataaaggtatacagtaatacactgctttcctggtacagatagaggtatccaacagatgcagcctgatgaatcgggagattcagttcaaccctctcctcagcctggcgctaaattggaaatacacaaacaccaaattgatgcctaaggatcaggttgcagcacatctcccttctggcccttgagaatcgagacacactgcttaaaacaacaccatagactatacaccagtgtatatacttagcttattaggttgtacagaatagagagttttaagattcagtcgttcagagactacaagtattgggcttcagttgtatagtgtaatgcagcaagtcccttgtagaaatggtggtcatgggatgagtctcatacgtagtactgccctctgtctgggttactagcatgtgggcctgctgaatgtggggctcatatatcagattatcagtccctcgaagtcagatggcagtactgtagaggatctgttgccgtggtcatgtaaactgtcttgaggcagaaataggctttttacacctcgtgtcatcttcgaaacaaactatggtgctccatgtgcttgtttaatgcgttaagnnnnnnnnnnnnnnnnnnnnnnnnnnnnnnnnnnnnnnnnnnnnnnnnnnnnnnnnnnn

SEQ ID NO: 4997 - DNA, 2539 bp, Oryza sativa
  unsure (1)..(2539): unsure at all n locations
nnnnnnnnnnnnnnnnnnnnnnnnnnnnnnnnnnnnnnnnnnnnnnnnnnnnnnnnnnnnnnnnnnnnnnnnnnntctggatcagatctgatgacaagaatctagaaaactgaaggaatgattggattgaattgtaatcttaaacatcatggaaccaaaaatgctatggcactggaatactgggtaaactggtttggctatcggggctgttttggtatcacttcggcttgatgaataaatttgctttgtcgaaatccctataatgagtagtatttgctgttgccgaataaaccaactctgggacaagatctggcatgaggttcagtatcataatggtttcttcgtagtaacgcatctcatgaagaactcttttgtactttgaaaacggacatggatgtgtttttgtgctttgaaaacccgtttgaactagtagatgaccggttggtatttttctcgcaaattcccttagcccactcttctttattttataggggtataatttatcttctttattctaggggtataatttaccagtttaaaatttactagtttgaattgacactttattactgattcatgtggaatgtataaaatcttatctcttcatgtggatggcccaacaaattaaactaaaatctacatttgcgggttttgatgttaatgcatgaagtttgcgggtgacaagtggggttttctatttggtgcagacgtacatctgccacgcactttttttttccacaattgtttttttcaattttttcgcaacttattgtcacgtgagcctttttcccgtgttctttttacgtatgtttggtgaattttttaaatgtattttagaatttgagtctttcacctcaaaattcaaaacatgctattgaaaattttgaactcaaatttcaaaacattcatctcaaaattcaaaactctcaactcaaattttaaaacattcaactaaaaaattcaaacctggatatatcttgacttaaaagttttcaatttgagttgaaagttttttagattttaacttaaaagtttttaaatctgagttcaaagtttcaaatcttgagtttgagttagaagttttcaaatcttgactaaaaatttttcaaagagttgaaatttttgaatcttgagtttaaagttttgaattttagatgtaattcaatttggagttgaaagtttttaaattttgagttaaattgtaagttctaaatgttagaaagcagaaaccgtccggctagtcatgcataaaatcgttaatgacatcgctaatcaaatttgttacaaattccgattttcatggcagctagtgattccgctcatgtggatgcattcgttgacacatgcacatgtgatacgtgatgagcgagctctatttctagtgcgtaggcgcacgttagcctttttggcgactattcgacgtatacctattttgctttacacataatctgtgtacctcgtgtgaaatggttagagcaaattgtgttattttattacaaacataccaagttttaaatttaaaagtcgcttactatagttttttatgagataaatttaatttgatgacaaaattaattttgtacgagaaacttttgaataaggatagaaacttccactaggatttctttttacaaaaagttttttcattagaaaattttgactatgcaactacggaatgtaaatacccctaaatttatactttgtaaaagaagatataaaattttatgtaagatattacgtctattttacctctctcaagtactgcccttggtcgaatcacgtctctcaatcgtaaaactgggtatagagcttgctcctctctcccctctttattcattctctttctttgcgcccacatgtcgtttcagttcatttgttgtcctcctgctcctctcaccgcttgccatctcccacctctcaccgtggagctctcttatcacatcctgatttttgtcttaagatttataaattatttaataaattatttttagaacttatattaaatgttcattaatttacaagtgaagttaaatgtgggaaataaaatttcctaaatataaagtatggttggatttaatttttattaaattctccatgaataattatactctttggaattttctcggatttttcggagctcaattcctaattttaataatacaaagaacatttcagtaattatttaaataatacattaatcattaaataatctgattttaatcttgttaagtaatttaagtgttcaagtattttcaggattattcttgaaattattttagcattggaagtatttttaacaattcaaagatcatctcattgattaatttattaaattggaagtcctttgatgatcccttccggcccagcccaaaaagtctagtttccctccctgccgctacagtgtcgtcttccagctccagccagagccgagctaacctgtgcagccgcctcctcctccatcaaatccggtgcatccgttgcttcccttccaaaattggttgcaaaaacgaattcctctctatctcctctacctaatccc

SEQ ID NO: 4998 - DNA, 4334 bp, Oryza sativa
aattcctaattttaataatacaaagaacatttcagtaattatttaaataatacattaatcattaaataatctgattttaatcttgttaagtaatttaagtgttcaagtattttcaggattattcttgaaattattttagcattggaagtatttttaacaattcaaagatcatctcattgattaatttattaaattggaagtcctttgatgatcccttccggcccagcccaaaaagtctagtttccctccctgccgctacagtgtcgtcttccagctccagccagagccgagctaacctgtgcagccgcctcctcctccatcaaatccggtgcatccgttgcttcccttccaaaattggttgcaaaaacgaattcctctctatctcctctacctaatccccaagaaacccccaccaaattcgttatctatcccacgaattttggccgtttttatccgggtgaactcgggataagcccgaatcttccttcaccgaattcatccgttcccgagctgatctctccctcttccggctataaatagcagaccctcggcctcctctttcgtttcctccttttttccccaagtttttcctaaccctagccacctctccgcgctcgtcttatctctccgccgccggcaaccgctccagccgccgtttgtcgtcgcctcgaccgtcgccctcctgcgccgccacctctctcggctccgcaaggtcaagctccaccccggccgacggttcttttgtgccgagttccaccggaggttgcccgccgccgtgaaccagtgggttgccactgggttttggtctccagccgcgccggtcgtcgtcgtccatcgtcgccttcggtcgtcgtcgccgtcgttggattcgcaaggagaagaagcccggccacctgttccttttcgttgtaacccgctggaatcccctcgtcgacgtgaagccgatctactccacctccggccgagccttgccgtcgacttcgtggttgctggacatcgtcgtcgttttcttcggcaacgtagcgccaaggtgaagcccgtccgctggtttttctcgtgttggtaagaatcgtcgcgtcctcctattcctccttgtgctctcggtttccgccgtcgtgcagccgttcgccatcgccgtcgtagcctagggtcgccggccctcgtgctcgcatggcagtgcgtgtgcttgccttgtcatatgtccagttagtcacctatctctttttaatggcatattaggtctttttactaaatatcgtcaactaaattcattccagtttttagtcttatatcttattatatctcagttataaattatttataaattgttaaattaatttggaatattttttttctttaataggctttaattggaattaatcttgtaaaattcataactattttatatgtagtcagaatgaggccgttcaagtccctaaatttatttaaaatcatgatctacatgtttgtttactttatatgtactttttatttggtttttgttagtctttttctccgttttgtgtgttagcttgtcgtttccgtcattgcgaaggttcgttagtgcgtcggaagtggttcagaagactaattgaagaccgattattgcaaggcaagtcacacagatcctaaacacaatcctttgagcatgttgatcctatatttaaattctctatttatttcaactgtgcatttatttttgaatgtcaccgggtggagtgaacatattcctttgttatggccaatttgaattgaataccctattcctcgataccttgggtaataaattgattagcttgaaccttatatattggtttggttcagctaaatgctatatatatatatatatatatatatatatatatatatatatataattgcttagccatgcttagaaacattagctcattaaggggataaatcatactacattattacttatggttatatttaatagtagctcacgatggttaatcgtgttatgataattaattgataattgaaatttgacaatggtgggttgtgagcgcatggttttgaaggtcgtgctcatgacaattaaggaccggttcacgagctactggtgtgagacattaaccgtactaaccacaagtcagaatgggcaacggctagacactttgtatagcaaggcttattgtggtgagccagactgagaagcggtgagaagtccgtgggggtcgctggggagttcatgcctctggtttttgagggggtgattatgatccaggaaaggtgcgctgctttgagttgagctatatgaggggtcttgtcacaactacacaaatggtgacatgttcagcatgggcacatggtgatagggtgacatattgtggagttgtgtcttgtgggtaaatttgtacacatctggccagagtaaaactattcgaatagccgtgcccgcggtaatgggcgggttgagcaatgtttttcgtgagtagtctcacatctctcacaataactattgatgctataactggtaataatttgcttagctcctggtttggagttagatctgtacagccgggtatggttgttcaggatggttgggcctgagcagcatgggtgtgctgttcagtgttgattaaagttgatgaataattactctactgttttacttctaaatgtttgctaaatgctgcttttgcaaatgagcctatattatgccatcctttggtatccatgtgcacttgcatatttgctgtgtggcttgcggagtatatcatatgctcaccttgcaataatcaatcaacctcagttgaagaaaaaggatctagaaggagaagacgtttggcttataccccagttgagctgcctgtgggagtggagccggagcttcgctagaccgttaattccgctgctgttttcttttcttttttaagtatgtaacgttattattatgatggatttgtatattaaactgtcagtttgtgtatctcggctgatttctgtacgaggattttatgcacaaattagttcggaaattacaagtgaatttccaggcgtgacacctctcccggtgccccacgaacttaacatctcctgcccctacccctacaccaattatagatggccaaaaggcccacccggcacggcccaccagccatcgggtcggcacggcccgatcgacacttcgtgccgggccgtgccggcccatgggctacgcctcccgcccaggcacggcccaccagctgtcgggccatgccgggccggcccaaaggcgttgtggcccattgtgccttttttaaataagtctagttttcgtccctcctctttgagctgtgacataatgtaacatcctgagaatccctgacaataaaaatcactaaaatttcaaactttttaaaaactttttgcatcatgctggaagttatggttgttattgcttgccaaaccataaatcgacgcaatggaaaaaaatcaatctaaagatttacacccgagcaatagttacgatttacaacgatacgatatttattatcaatcccataaatatttatgcacatgaaagccaggccaaataaagtacaagtcaattattaaaccctttggtataaatcacaaatcaaatattaaataatcaaaccatgttgatagcctgatttcatatttaacaaaaggaaacaacatagttgaatataattcacttgaatccaatctcacatgaaatataagtacacatgaaatgatgatcacatcaatggccccatctataatagagtatctcactagaatatataattaatatttgaaacaccttatcaagctcctcatagcatgaaaatcactcatataaaataatggtcatataaataaattaggctttatacataaataagaatatgtgagtgtttaattaaacaattagattaatgttgtaataagtctcaatttatatttatagaatgagtagacccacgtaaaatgcattgttatacaaataagttcattcaatgtgctattgtaataatggccacattaggatattttaaattaattttagaaccctcaaagcctccaaaattatctaggttaattttagatttaaacctcatttaaataatacaataggaaaatatataaaatatgggtaatattaaattttggtcaactttcatctaaaataaaacatatattgggtaaaactctaattgtgtgaaatctagaaattatgggacaagttttaataggaaataggcctcaaaagtggataatgaggaaaaagtcactgttcattatggcctaggtgtttgatgtggttccctagcccttcccccctccactgccgggggatcctctagagtcgacctgcaggc

SEQ ID NO: 4999 - DNA, 788 bp, Oryza sativa
ttcaaaaactttttgaataaattgcatcatgccgattttgttcgattattttattggatttgatttcggagtttataaatcgcgaataatggataattgattaggaacaaaccctaaaagtaaattgacaaagtaaataattaaagtgcaatataaaataagatttggcgaggatagaaatgagtaaaatattattacaaccatatttgtatcaattaaatttaaaagtaatggaataagaattaactctaattaaattcaagaaaattatataaaaataaaatatgggtaaaattaatcaagggtggatccattagtgggaataacacaaatattaagtgaactttatttgtacaaaatttaagtttatcgaaccaagtttaaataaataaataggcttaaatcgggttaaatggacaacgtcactattcattgccccataggtgttcgattgcggtctagccctaaaacccctccccctgtcccgcgcgtggccgccccgagccccgtgccaccgctgccacgccgtcgccgtcgttgcctcgcgccccgcgccgtcgcgtcgccgtcggtcgtcccgcgccgctgccgtctgccgtgccgcgccgcgtgccgtcaccgtcgcggtcgagtcgccgtcgccgtcgctgtcgtgttgcctcgcgtcccgcacccgccgcgccgccgttgagtcgtcgcctcgcgtcccacgccgcgccacctccgtcgtgtcgccgctgccgcgccgcgagccgtcgccgtcgcgtcttgtcgccgctgccgcgccg

SEQ ID NO: 5000 - DNA, 3288 bp, Oryza sativa
  unsure (1)..(3288): unsure at all n locations
tgtccctatgcacatcaacagaatggttctgcagaacgcaaacatagacacatagtagaggttgggttggctctcctttctcatgcttcaatgcctctgaaattttgggatgaggcgttcctagctgctgcctatctcataaaccgcacacctagtaaggtcattcagtatactactcctttagagcgcctccttgatcaaaagcctaactattctgctcttagaacctttggttgtgcttgttggcccaatctccgtccttacaacaaacacaaacttcagtttcgctccaaacaatgcgcttttcttgggtatagcaacatccacaaaggttttcagtgtcttgatatatcaactggcagagtttacatctctagagatgttgtatttgatgaaaatatttttccctttgaaaggttacatgcaaacgctggagcaaggctgagatccgaaattcttttgcttccttcctccttatatcaaaatattgcaactaatggggttgaacataatgaccgcatgcctaatgtccctgagcaatctaatgtgcctgttgagcatgtgacagatcaggagatacaattcggagaaggttcagaaaatacagcacaaaatgatcacagttctgcagcaaatattgaaggagatgcaccggatctggatgccacagaagatcctgaggacatttttcctggcagcagcgatcccgagggaggatttcagccctcacctgtgcacacgcctgcactgtcttttcccgacgatgaagaaatcggcgaaaccggtggcttgacgtctctgcagcagggggagcagtcgcatgcagccacgtcgtcaagcagccatcatgatggggggagcggcagccctctgaccggcggatcgtctgcacccgacacagccgtggctgagcccgcacggccggtcactcgtcttcagcgaggtataagaaaacagaaggtttataccgatggtactgtaaggtatggcatgctgacaactacaggagaacctcaaaacctagatgaagctttgactgataaaaactggaaagatgctatggatgctgagtttactgctttattagaaaataaaacttggcacctaattccacctagtcatggtaaaaatgttatagactgcaagtgggtctacaaaattaagagaaagtctgatggtagtctggatagatataaagctcgtctagtagccaaggggtttaaacaacgctatggtattgattatgaggacactttcagtcctgtggttaaagcagctactatcagaactgtcttgtctattgctgtttccaggggatggtgccttcgccaactagatgtgcaaaatgcttttctgcatggataccttgaagaagaggtatatatgaggcaacctcctggttatgaaaataagagtaagcccaactacatttgcaagttagacaaagcactttatgggttgaagcaagctcctcgagcttggtattcaaggttaagtactaagttgattagccttggcttccaagcttccaaagctgatacatcattgttcttttataacaaaggaggtgttacaatttttgtacttatctatgttgatgatataattgtggctagttctagacagaaggcagtatctgctttgctggcagatttgagtcaagaatttgcactcaaagatttgggggatctgcattacttccttggaatagaggtcagtacggcaggtgatgatattttactgaaacaagaaaaatatgcctatgatttgttgaaaagagcaagtatgctagattgtaaacctgttagtactcctctgtctgtatcagaaaaactgtcagctcatagtggaactgctctaggagaaacagatgcaactagatatagaagtatagttggagctcttcagtatctgactttgactaggcctgatatttcatttgcagtaaataaggtctgtcagtttttacatagtccaactatagatcattggatggcagtgaagaggattttaagatatgtgaaattctcagttgatcttggtcttaagataagtcgttcatcatccactcttgttagtgctttttcagatgctgattgggcaggatcaattgatgacagaagatcaactggaggttttgctgtgtttctggggtcgaatttggtttcctggagtgcaagaaaacaggctacagtatcaagatcaagtacagaagctgaatacaaagctgttgcaaatgcaacggcagaggtaatgtgggttcaggctctacttaaagagctaggaatagattcacctgaaactgcatgtatgtggtgtgataatctgggagctacttacttggctgttaatcctgtgtttcatgcacgaactaaacatattgagatagactatcattttgtcagagaaagggttgccagaaagcaattagaaatcaagtttatatcttcaggtgatcaagttacagatgggtttactaaacctctcggtgctccacaacttaggaatttcagatacaatcttaacttagataagttatgattgagggggagtgttagagatagaggtttgttacatagagttgttacatgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatacagccatcccagtaagatcccgttaatcatgattcacttggggggaggcaaagcaggaggaagatgatgccaaatttgcattcattttaatagatgttgataatttgtttcacctctctgctggaaaagtttaagaagcattcaatgtttaagaattaattttcttttgaaaagaatcagataattaactacgagcaaagaattcagcaaacttcatgtcttcatcttaacaagccagcccaaagtttttagatttaattgatcaagatttcattctgtttttgtttttaaattcactgaaatatttgtttttggttgtatgcatatatattaggttcagtttagtagaacaatcctatatgcctggagtttcgaactttcgatggcgacatggcgtgtttgcagtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5001 - DNA, 556 bp, Oryza sativa
tggtgtggggaggtttggagatgaacgggggcttttataggactttgggggcaaatggtcggcctaatgatgatgtgacggcggtgcacgggctcggaacgacggcgacgcgcgcggcgcgaggcaacgcgacggcggcgcggcgcggcagcggcgatgttgacggcgcgcggcaacgcgatggcgcgacacgacggcgacgggttcggcgcggcagcggcgacaagacgcgacggcgacggttcgcggcgcggcagcggcgacgcgacggaggcggcgcggcgtgggacgcaaggcgacgacgcgacggctgcgcggcgcgctggtgcgggacgcgaggcgacgcgacagcgacggcgacggctctgcagcggcaacgcgacggcgcgcggcgcggcgcggggcgcgaggcaacgacggcgacggctcgacagtggcgacgcgacggcgcgcggcgcgccgcggggcgcgaggcagcgacggcgacagcgtggcagtggcggcaccgggctcgggacggccacgcgcgggaccggaggatgggttttagggctag

SEQ ID NO: 5002 - DNA, 3767 bp, Oryza sativa
  unsure (1)..(3767): unsure at all n locations
nnnnnnnnnnnnnnnnnnnnnnnnnnnnnnnnnnnnnnnnnnnnnnnnnnnnnnnnatgatgtgtaattattccccttcaattccccccatcttcttcaattccctacaaaacgaatatgtaaatgagatatgtgcttaccgatgtgtaagtggggtccgaaattaccggaattttggaaatcgcaatccctgccacaagagcatcagcttgtgacgtacacggctcagtcacgtacgtggaccgtgctcaaagcgctagctggccaagcacaaacacagctacgtcggttggcaggtatgccatccatacgaggaagcggttaactacgacttgatctactcctttcatctaattcaagacgcgcacacatttttaaaattttactcctaaatatttgaccaataatattttatcaccttatatatgtgggtttgccctcattatctgtgttagttaatttgcaaagttagaaagatggacaaactggtaagatatatatatatatatatatatatatatatatatatatatatatatatatatatatatatatatatatatatcaaccagggttaggctgtttgactgctttgcctaacccagtttggtgcataatatgtaaacatttctcgcgcaattacaagactaaatctaatagtttaacgtccgacatatatataaatataataatgttcaatgtcacaacccatctttatttctcagcaactaagtccgtgtggatctcatgttcaaccaaaaatgatagcacctatatggcatgtaattaaagccagtgctctgcacaactcacatttacgtccttcgcctgatacccatatataatgtcctcatcaagttccacctgttccatatagaaataaactatagtaaccaagaaattaattgtgcatctcctaattataacctacaagagaacataaattattccagagagaaaagaaaggtaattctatatgtaccaaattcatgttctgtataacaagaaagatcagtgtagataaagcaagtggtatatgcccactttccactagcaactagctagtttttatcatactatcatggatgaataacaaaatttcaagggctgatcaggttattattaataagaaaggtaggtgtaatggaggtgacaaaatgtatgatgccctcagagaaagaatgatatattgtgatggttgatttacctcagttggcttcttggattttttccctatatttgatctcaaatcagaacctagaactttgggtttctttgctatccgttcatccgaaagatcatcttcattcatctcacctgccatcaatttagatccttttttttcttagcgaaggtcacattggaaaatggaaatcacatgctattaaccttttatctgataaaagaaaggaaaaattagaaccatgccattataattttgcaaaatttgagatatgccatcctgaccctactgatgacatatctcaaactttgcaaaattataatggcatggttccaaatcacctaaaaaaaatccaacatctgtaacgtattagctggccaatgcatattaaaattcccttcacatcatcacacggtacgctgaaaattatgttcaaattaaatcaatactagcggaagtcacattaccataatcaccaccagggaggccttcaaagtcttccatatcttccatgtcatccatatagtctccttcaacatactcttccacctcttcctgtattgacaattgaattcacgatacatggattagttcacgaaatgtgagatgagcatgtctgcgccaattaacgatcgatgcttacttcttcatcttcctcaggatctacatcacctttttccatgtcaagaactttgaagggataactatagatcatgccgtcatcgccgcaaagacgttccttcaattccctccgcaaagacgttccttcaattccctttggatagcctgcatgccaacaggtatatcagaaataataaggcaaactatgaaacacatgaataacatcagaaataaaaaccttttatatttgagcggcatgttcagctttcgccattctcctgagatctcgctgagtctgcttccggggcattgtcatcagcttctctctgacagggcgagataggaagatgattataattttcataaaataagagaagtcaacaaaagaaagtccacaaaaagaatatacatcaacaacacaaatcagattataatgaaactgctgtactatatatgtaataccatcgaagttgaaagttgcggtctactgctacccatattatttctccattagtattaaaagaagttcctataacgatatgacaccacatagaagtgtacataaataattactattttctctttcaacaacgatatggtgtaatatgatcaaaacaatataagcagaaaactcataatgaaaacactatggaaaataaactgaagagctagcctacctcactttcagtcgaagcttcctcattcttatccgatactgagtcatttttgtcaggcgctgcttaatcttgtgcacaagtaacttgggccaaaattcctacacaatgaaggaaagagtgaaagacaagctatgagactaagtaaagttgacatccagatggggaatgacaaaatatgtacgctcgaagtgcatacaagatgcctgttgatgacttcaattgctttctcataattccttggtagtttgaccctctcccataatttatttggatgatgagctctttcagctgttttcatgtataggtagaaaatacctgcaaggccagaaaaaaaaaaggataaatacaaaatacaaacagaataatgtaacaaaaaagatcagatgataggcataatttctatatgggaaagaattgggagcatatatcacaagtatgcatgattcaattgaagattagactgcaatatatctgcatccttggacagttagacgaagagcaattttacggtccttgagaaggtaccataaagtcctattttttctattattaaattggtacctcattgtacctaggtactatgaggtaccaaaatttacactaaaattttggtatctcatgatacctcctcaaggacagtagaattgctcttggactaaaggattctgaaagcctataagcaattcactcatggaaagaaaaaaaaacactttctgcagtactatggagtatattcactttaaaattaactaaatgaatggacttttaggcaaaaaaaacattaactaattaataagcttccatgctggctagaccaaactaaaaaaaaacagtcatttgttgtgtttaactttgaggttttatatatccaatctactcacaaatcaaaatatcatcgatcttataagggaattaataacaattatcagtcacaattaaatgatttccttcaaatcaaaagcaacgcatctcctaattgcaactgcgaatgtcagtcaacaagggggagataatcccttatatgccactgaaaattggtctgatcccttatataccactgaaaattggctcttcccttatatgccattggtccaaatttgcgcactctctcatgccactacggtcagttgatcgtgtgttgaccgttaacttttaagtaaaaaagacatatttgccctctctgagttattaggcatgccctatactcagaagggtaaatacgtcttttttccttgagaattaacggtcaacacacggtcaactgacgggagtggcatgagagggtg

SEQ ID NO: 5003 - DNA, 2203 bp, Oryza sativa
  unsure (1)..(2203): unsure at all n locations
nnnnnnnnnnnnnnnnnnnnnnnnnnnnnnnnnnnnnnccgttaacttttaagtaaaaaagacatatttgccctctctgagttattaggcatgccctatactcagaagggtaaatacgtcttttttccttgagaattaacggtcaacacacggtcaactgacgggagtggcatgagagggtgtgcaaatttggatcaatggcatataaggaaagagccaattttcaatggcatataagggatcagactaattttcagtagcatataagggattctctctgtatatattcaccgtcatggtcgcggatggtggcgtagcggctgttggcaagagggcaggagctccggttgcatattccggtggcgttgtacgggttccggcagaatatccccgtcgtgatcctgccgcaaaaccaaaaccatttatcgtcagaaatcaaagaacaccaccacagcgaacgaaagaaagaagatgattgctgctctgctcgcatatatacttggccatgaagctgcagtggttgtgccggatgcagtgccatatcacgtcgtcgctcatccttggatgccttcctctttgcctgctaggtgcggttgcgggtgatcacctcaccggcggtggaagccggcctcagcaggaggaccccggcgccgctgctcgcgcgtggggtggaggagatgggcgtacgcaggcggcggaagaagatcgatcgactagggtaaaaataaaacctggtgttggccttaggcccagcacaaagcccaccgcggccccaactagatgaactctaggcccatatcaatactgcttgctccttatgcatttcactcagccctgacccagttttgaacccttgaactgtggaaggaataagttcactttgggtccctctatttgtcgcccagtccgattttcgtccattgaccgcaaaaccgggtacgacccgtccctcaacttacgaaaaccgggcaaacgaggtctctcggcggttttgaaggcggttagcttcatcgtgctctgctcgaattcctgcagactgctgccagtatattatttgcccttgcatgcccaatgggggtaagagagaagaattgaaaatttggataagttttcttggaaatcaaattgggcaaaagagaaagattttaaggaaatctgaagtcaaaaattgacatttgaatccattttagggatttaatggatgtttttggggcagggatttgatcatttcggtgaatgtgaatattcatatttttggagaattccaaataccacctaccttctctctttaatagatgatgttgttgatgttgttgacttttgaaataacgtttgactattcgtcttatgaaaaaactagtgtaaatatactaaaatataaatcatactcaaagtttctttctggtaaaatatgtcaacaaaattaaatattatctaaaaaatgtcaacaaataaatgatatttatatacaattttttaatatgacgaatggtcaaaagatcatgtaaaaaaccaatattgttatctattaaaaaaacggagtgcgtaattttgaatccaccataagcagactatccaagcaatccaaacatgacttattagaagatacacaaatgtagtaaaatcacatgagaaagacaacagttctgatccaattccatcccagcaatgtatatttaattgcagagattattaatagatacacaacttatctatacatcctatatagttggaaccaaacactaaacatacattaagccactagaaaataatatcctttgaatccttatagcgctttcatcataaccatcatccatatatcatattcatttacaacctacttagtgtaattattatcataaagcttaacattaatgagccacatcaacttagaaaaataatgcccattacatttctctcacgcttgattataaccatacatgcgtcatgtataactgaaattctacctaaattgcctaaactgtgggccatccttttaacattatttctaaatttgtttatttgagctttcttgtaattaattctgagatacccacagcagcgcgtggggtatccactagttaaaaggatggcccttcccgctacccattgcttgatattggcataacttatggagctgaagcagtaggaattggtagaaaaggtcctagaaaacgcatgagaaggagaacatgcgtgatga

SEQ ID NO: 5004 - DNA, 2554 bp, Oryza sativa
ggtacatgatatagtttgatagctctcggctcacctttcttcttcttgtttacttcggtggtgctatcctcggagtagtagcatatatctgtcgcaatgtgccagatgagcacagccgtggggaaatcgacatctctgccaatgctatcctgcaatttcgtcatacttgtctgttccaaatcttctgatttgcatctgtcgatccgcttctgaagtgttagctgaccacgggaactggcgaagttccagtcctctttaacttttccgaattctaacaatttatcgagcaccagctccttcaagtcttcagtaatggatatgtgtgttaaagtcgaatcaagcaactcaacaccacaagtattggaacactcactgatccatttctgcacggatgacaacaaacctacggtaccttgcatggtgtacttcgtgatcatgttgtactgtgctacctcttgggaccattgtttcctgcctcgtagtggccgaatggaattgactgcccacaagattatgcttgtagttctttcagaaggaagtttggagatcaagtagggacaaacatacatggtggcagcgaagacatctagaactattgcacctacaagtaatatgtaggagatgatgatatcggctctattatgtagttggccgcccttttcgatcggcgcacatgaagagcactagggctatgggggtgaacatacactggacaatgaccagcaaggtaataaggagggaacgaaatgatatgtggcagggcacaatagtcaagtagaaggctcgacgtaggatattttttttgtgtacccacgatttcatatgccctgcggcggtttggattgtcataaaactctttgagcatggatggtatatcctttgctgctaaaatgcacttcacatcatcgcgtggagtgtccactgaaataacttcactttcagtatatccgatgttttctgcttcggtatgtataatttttgagcttgacttcccatccaatgttgactcaaatctttctttgacatattttttggcttcttcttctactctgcctttctcaacttcctgtagcacaaatttcaaatagtgcagggatgcagccctgagactccttggtctggcaaggataaggcagaaggtacgcccagtgtaccttaaacacccacagaggaacataagcaccacagcagcctgcagccggcggtctgtccaagatgatgtggagatgacgtagccagccacaactacttggatgaccaagttgagtaggtgccgcttccacaagtcattgtcctccttggagaaggtagtgaggttttcctgcccaccaagatggacgagcagaaatggcgcccagaagagtatgagttggtgctgcggtccgttcacatgaaccgcgaggtggccaagtacgaaaacagcaatggagtgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaagataaaagcgagctaagcctgaagacttgactcctgcagcgagcgattccattccacaggcaatccttgacagcagcgacgaaaccaacctcttcgagacatctccagctgagaagaacttcaactctggtgagggggaaaagagagcaagactgagtactacccactgtactcagcaagtcataccggaagaggaggtatgatgcaagatatatccaagggaggctaaaggttcttttgcataaagccggcatttcaaagcagtagttgaaagcagtaaaacaattgtagtaattaatcaatattaaccaatcactgctcaacgctacaccacgttgagaccggcccaaaccaccacctgaactaaccagttccaaaagctaactaggggtgaaactaatcacggtgaatctggtcgaccgcccataaccgcgggcacggctattcgaatagctttactctgatcagaggtgtacaactgtacccacaagacacagccccacgacacgttcccgtgcgccgacatgccaccacgacataccagaaagaggccgtgacaggacccttcacataaccccctctaaccgatcgcaccacaccttagggttcgcccccgtccccagcaggcaacgggcagcctccctttcgtgccgcggtgaatccggaagccgatcaaccggacaccccggccgacccaactccatcacgcccaccctcgcttgggtacgtcggctagagaaaagttacactacaagcctagccgttgcccacgctggcttgtggtaagtacgataagttcttccggggcatcccgcgaaccggtccttaactgccatgggcacgactagcaaaaccatgcacccacagcccaccatgacgtgtattttaattaaccaacaccattacggtggcactaaacaaaagctatgccgataatcaagtctatgctttaatgtgatccccctttgtgcact

SEQ ID NO: 5005 - DNA, 3650 bp, Oryza sativa
aatctggtcgtccgcccataaccgcgggcacggctattcgaatagctttactctgatcagaggtgtacaactgtacccacaagacacagccccacgacacgttcccgtgcgccgacatgccaccacgacataccagaaagaggccgtgacaggacccttcacataaccccctctaaccgatcgcaccacaccttagggttcgcccccgtccccagcaggcaacgggcagcctccctttcgtgccgcggtgaatccggaagccgatcaaccggacaccccggccgacccaactccatcacgcccaccctcgcttgggtacgtcggctagagaaaagttacactacaagcctagccgttgcccacgctggcttgtggtaagtacgataagttcttccggggcatcccgcgaaccggtccttaactgccatgggcacgactagcaaaaccatgcacccacagcccaccatgacgtgtattttaattaaccaacaccattacggtggcactaaaccaaagctatgccgataatcaagtctatgctttaatgtgatccccctttgtgcactagttgaactaagcagggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattgggtacaatatgatcaattgtaatgtatgacttgccttgctctcgcactgatggaaccacagcaacgtcttcgagaaaccgcgaatcgacgaaacggccgaaatctacgcgacaaacaaagcacacaagcaaaacatgctataagactactgaaacagagaacaaaaccatttttaatggattctatacatttttatgaatttactaagacttgaatggacttaaacggagctcggatgaattagttatgatttttagaagattctctgtgtttttactataaaagaaaaactcttaatcaatttattgcgcaataattcctcccagggctgacgtcagcaaggggtggggcggcgccgacatgcgggccccactggtcagcggcactaagagagggagaagggggtggctggcaggcggggccccccgggcggcggctcaggggggaggaggtggcaacggcgggtgggccccaccgggcagcgtcacaagggggtgggaagcggcgaggcgcccggtcggcccggctcggcttcaaaccggccggccggttaggtgatgcggcggcgcaagcggccaccgacggcggcggccggcgagaagacgacggcggccggcgatgcgagcgacgacgcatcatggcgacgcgcacacgaggagcggcggcgcgcgcgagaggaagagaaggggagggagttctcaccggggattcggccggcgtgggtgaagacgacggcggccggcggcggcaagcggcggatggtggggcgcgcgggatggacgagatgggcctcgatctcgcgaggccaacggcggcaacggagcggcgcggcgacggcactagcgacggctagcggcggttggaggcggcggtaggcggcggcgcgtgggaagagcggtgcggcggtggcgcgcggcaagcgaggggcggccggaatagcccccgcgacggtgaagctagcggtggcgacggcttcgcgcggcggcggctctagcagcggtggcgcgcgaccggagggcggcggcaggcggcggagctcggtgcgacagcgcggcggcgataggaagcacaggagggcgcgacaaaggagggaagcgcgagaggaggttcgggggagcgttttatgggcgagggaggggaggaaacggccgggggggtggccgatttggccggcgacgtgggggtggagagagagagagaggagggattcaaaatgaatccgaccattctcgggcgcgcgcgagggcgggaaacggcgggacgtgggcggcgatgtgggcgtgcggcacgggcggagtgggcgcgggaagcggggaaaccggcggcgtgggtggtggcactgccgtcggttggaggtggaagaaggggctgacaggtgggccctacctgtcgatgacccagagagaggagggagggaggtaggacttcgggggaggggagaaggaacgggccggcccgacaaggagggtggcgcgggagagaggttgggcagacggcccaacaaagaaaaaggagaaagaaaagaggaaaaaaggaaaaagatttttcctaggattaatatattgcacattgctaattttaattggttaaaattatttacaatgctctgaaaattccgctaaaaatcctgttagcgtattttgacatgtagaatccaagaaaaattccacatgccgattctgattattatttgcatttattaatttagggtttctctcttgcctttaaacaaataatttcttccaactatttattaattgaatttttgttagggaaaagaacttctgggcgcaacatggagtcagctgacaagtatgccagccatagaaggaagcgtaggatccttgacgcgctgcgtgtccgcatgctcgctgcgaggaagaggaagacttgaaggaagaagctcacaaggatcaggcactggatctcccactcgtcccacagctccttcacatgatgcccaaaactacattgtaggtaagtgagaatcaatcctcccaagaacaacaacaataaatcatttattcatgccactctatgaatttgtttctcaatactaattagagatcgaccctctttaattccaaaagaacgaaagatcagaaaatcacacaataatcaagagaagtcgagctggatggtgattattacaacgttagtgattatgtatgtattgtaaactgttctgcagtacagttggaaggtgcaatacaatgttcagttgtaaatacttgatatttcatcgtatacagatggattaaatcatcaactgaatgatgattaaaacattcagttgtacttggactccaagtagaaacaatgttcgatacaaaaatattgttctttcttggagtccaactgaatgaagataacaacaacggatgagtgtgttttgcagtaattaggagatagcagcaggagacatgaaattcactagtattttgatttgttccatttcttttattcaatgacaaaggaaaaggatgaacacgagttaatgataaatgccttgatcattaaaagttgcttgctcttcacataattggcagatcaaaaggaataatccaaatgaacgaagccgaaatccaactacgaatgagagtggtcaatgaagtgcctataattaaccaaaaaaatgcatgctttcagccgaaaatatcaatacatacataaatatatacaggaaaggtatatatatattgcatatgccagttttgaattgccatttaatgaacactatacttaatacgctaattagaacgctgtaatataatatgttgctaggcagcatttatccacacaaaaacgaaaccaaaaagtggcatagcatgttaattacctttgtttctccttaagattgcgcatattgccgattccctcaccatttctcacaggtctcatttcagtcaggttg

SEQ ID NO: 5006 - DNA, 745 bp, Oryza sativa
aatatacacttgtatgtatttgaatcgaagaaatataaatgtagagcatgtgtactcacaggaaatttgaacttccgcctaagtctttctgtccatttgccgcggaccaaatgagggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcatacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttacttttcgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtcc

SEQ ID NO: 5007 - DNA, 3721 bp, Oryza sativa
atgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttacttttcgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcagcgtcaactttcgccttcttcgttgcccttgtgtgggtaggcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccacctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaacaactagcggaatggctaaatcttacctttattgataagttcttgaaaggaatatgcagctcacatggtgtccgctgagtgatgtcatcaacgggacaagtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttctctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggccaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttgcacttccgttatgatgtgccgaccctcaagcttcttcgctgcacctcgttgcccgcgtgccctcttctgtccaacggagggttgactaccactagcctcctcctcctggttcccctccgcatccctctccacgtttccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattatacatactaagtctaattataaataaagtaatcttatattaaaactcaaataatattagaacactacacaatcttatatgataagtccaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaagatgtattaggataaatgcgaagtaacatatatatatatatatatatatatatat

SEQ ID NO: 5008 - DNA, 2550 bp, Oryza sativa
  unsure (1)..(2550): unsure at all n locations
acatatgtaaatgccacatgcatgatttaaaccttttaaaaattagaatagtcatatataagtagcatatgaaagatagtaaattaaattgtgaaaaactctaatatatgaatgatagttttaaaaatatattaaatttaatacttttaaaaattctccagtcaattataatttgcatatgaatgatagtaaattaaatgttaaaaactctaattaacatatgaaattgccacgtgcgtgatttaaaacttttaaaaatcctctagtcaattataattagcatatgaatgctagtaaaataaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatatatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcctttctttccttngctagacatgtccttcacgaaaaagacttgcgttacatcattggcaaggacaaaaggttcgtccgagtatccaaacttgttaaggtcaacagttgtcatcccactgtcatcaatcattacgcctccaccagtcaacctaacccattggcaccggaacagaggaaccttgagaggaccatagtcaagttcctatatgtcctcgatggcaccgtaatacgtggcagttgttccatcgtgtcccatggcatcgacacgaacagcgctgttttggttcatgctcttcatgtcttgggctctcgtgtagaatgtgtacccattgatctcatatccctggaatgtcgtgatcgacccagacggtcccctcgccaggaaggcaagttgttggttgatcgactcgttacccatgagatgttgtcgtagccacgcggggaaagtatcaatgtgatgtcgtgtaatccatgcatcggacttaccgatgttcctggcgcgaactagagccaagtgctcctcgatgtaaggagctaccaatgaagagtgttgcagaacagtgaaatgggctttatggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggttaacgcaaaggttcttagtgaggtgcatcacgtcgattgcgtggcgtacatccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccaggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcagggtaccgagctc

SEQ ID NO: 5009 - DNA, 7435 bp, Oryza sativa
  unsure (1)..(7435): unsure at all n locations
ccccgagccccacgccgccgcgccgtcccgtcgtcgtttaaagccggccacccctccccgcgcctatataagcccctccccggctgcccattgctccccacactacccccaccacctcccctgccttttccctctctttcccatccccggcgttgccgcctcgttggaagccgccgccgccgccgctgagccgacgcgccccgccgccgcgatgtgcctcgtcgccgcgccgtgctccgccgtcgacctcgccgccgcgtctccgtcgaccccgccgccgaaccggtgagcctccccctcccccaccgcttgccgtcgcgccgtgccgcccgccggttctagccgaggccatgagagagagaggagaaaacagagaggagagagagaaaagagaatggaggagagaggttagagtgggccccacctgtcattaattccatccaatttcccttagaaaaataattctgtagaaaagaaaatcaagaccttgaccccacctgtcagtcactatagctggtggataaggttgtattataaataaatgaattaggaacagtaccatttcacaattattagaattaattcaaatttgaatctttacactagcataacttattcatttcagctccgatttgagtgaaacttgaacctaaattcatctaaattcataagctttccaatgatatataattcactatttgataaaatatatttataaatattaaataattaatatcaagatgatgcataatagtcaacttaaaaatatgctaataaataaaattagtattgtacagtagagtggatgtaataatatttgtctctaacatgtcttgccactgtaataaccacacaaactaattttatgtgatgtctcaaatgaatggatgtataggaaaatactagtacttatttaatattcgatggccatataattaaatccatggcttataggttatttaaatcaagtatagccttatgattatgtaactaaaatataaacacacatagatgaatctttaacctgtttaggagaatactaacagagctagatgtggaggaatcactaattaaattaatcgatgcaataccatatagaatagcatatatatgcctaaattgattaccacttattagtaacccaatagaaccagtgcttaaacttgtcgcatcacatatacaatatcactcatagaaactagctaatgtataattaaactacaatatattcaggaatcacttggagcattgggtagtacactttctaaataagctcatgtacagtaggcgaccaaaacattatacgttgttgcacacatatattgtacatcccattatagttatacaattaatttatctttttcatatattaaactggggagtatataacaaacatgcatagtagataagtactaattataaatcttgacctcatatgtttatagttcaattgtaactccggattgttcattaagagataatctgtaactataatattataaacctcccgaatttaacatatagagcatggataattattagcccttttataatttataatggcaagtaaaatatgttcataattaaagtaaagcttccatcaataaaataataatacaaatgattcactgtaattatttgattgatcctaaatccatttaacaacagaacctctgatatgtaaccgtgctatttagatagctgcatacatagccataatccttccatagccatttgatagactaaaccaccgattagccaaatatatatgtatcccataaatgctatgttggttaactcctaaataggccacgatgacaatagaaagattaagaaactttagccttagcatgattgggatccattagcaaacacgaatagtacattttgttgcacatatttgattgttgtttgaatattggtttttctcgcgtattatagaccttgtgtatcggttagtcgtgaggcaacgtctgcaatttccaggaggtgaaggttgatcaagattatatcaataataaggattatcctgagcaggcaagtcatcactattccttgaacatgttgatcccaattgcgaaattgttttgtttacaaataaaattacatgcaatgatgaacatcctacttgtgattatgccatgccttgattattgtttacccttaaatatttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccataatgttgatgacatgatttgtgaaaggagaaataaaattaaacaactgttttcgactggggcggacggaggatttgggtggtatctggaaaaggctagtaccgtccccggtcaattaaggaccgagccatgaagttaagcacgaaacgacccccgtacaaccgcacttctcgtatgggtataggcctagcggattagatagccgagcggaggcagtatccctgcatagatggttcacccttgagtgaggcaggtgtgctacggtgggacagctgttaaggtagggccgagaggcgtgccctacatcggtgtcgccattggtaggactgccatgagtgtgtgagagagagagaacttaacttgaaccataatttaatatgtgtgagacttctctttcccgggagcaccagaactcctcacactgctagaaacatggacgcctagagtgcatgaggatttaagttcatggagcgggtactgccaatgcgaggttatcgaaaaactttgccgtgacgcgtctcatgtgttgggacgaggatcatgtgttgggcagtcgcggagtgcgggtaaagtgtacatccactgcagtgtgagtaaaccaaatctattcgaatagccgtgctcgcggttaacgagcaccgggacatgtattacacttggctagactctaaattcttaacttgtgtgggatgggatattgcatggtgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggaactaaaatttgatcagtctatgataggtcttaggcttgtgaaaatatttgcaaaacgcagctttatgcaaaagaacctgaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgtgctaggtctcgttccccagtcgactgcctatggcatgttaaccagacccttatattattttgtcttctgctgttgttctctgatagttgttggcctacctggccctaatgtaagtatttaactcttttagcctaaattcattcgtgatatgttgtgatccaactatgtatgtgtgtaccaactactgatccagggattggtatggataaacacagaagatttccgatttccaaaatcgggggtctacacataatatagcgaaaataagtctattttccgtccctccactttgggctatgaattatatatagtgaaaataagtctatttttcatccctcctctttgggctgacatatatatgtaaaataagtctattttacatccctattctttcgaccgtggcatataatatgtctatttttactccctattgtttatgtgtcgggcctggcatgcggcccatcgtgctgtgccggcccaacgtgccggtggagaggcctaggcacggcccggtggtcgggctaggccggcacgggcccgacccttgacgggccgtgtcgtgcttgggccgggccaaaatgccgtgccgtgggccgggccgtcgggccttgggccttttggccatctataacaccaatgactctatcttcatccgcatgcgtgccgttccacttggaggagcaccacggctcgtcccttgctcgcccaccgtggccgacaaatgtggaggtggtgtcggggaggttgggaggtgcaggatgcatgcacgccacttccgctcggaggagcgacaccgcttgttcctcgcgtgctcgccgtgactgacaagtcatgacagcatacaccacgaccacactcgtccgtcatagcaggcgtgcgagggatgaatgtcggcgctcctctagaacgaaaacgacatgcgggcttagagaaagggaaggaataaaatgggagagatagagagatgatggagacttgctggtaggtcccaccctatttccgacgccacgctgttgccacatcagataatgacccgatcaacatgccacgtaggacgaaaatcgccattcaaaccgttcgaggaggtaaattgatccggtatttatagttgagggatcactagtacagaaaaccctataggtgccggttaggaactggctccattggtcggcacctttgcctcatttttattgctgccggttctaaaaccggtacctatactattaaaaaaataaaaaattgatggcgcctacagtgccaccggccttctccaccgccgccaccaccacctcgcctggccggcctccacgccaccacctagccatgcctgcctccatgccagcggccgccacccaacaccgcgctggaggagggggggcccggggagagagggtgtcggtgagatccagcaaccgcgccgcaacctcgccgtgtcggtcgccacaccacgtcgtgctagaggaggagaagggaagcggggcgaggtccctcgggagaaaggtggccgctgtcactgccacctcgccacgcctgcctcggcgccggcctccacctcacccgcgctgccacgaggagaggaaggcgagaggggcgaggctcctctaaccatcagccgccgtgccggccagcctttgccaccaccgttgtcgccgctacctcgccgcgccatcctcggcgccggcctccacctcacccacgccgccacgaggagaggaaggcgagaggggcgaggctcctccagtcgtcagcaaccgcgctggccagcctactccaccaccgccgttgtcgccgccaccttgccgcaccagcctcggcgccggactccacctcacctgcgccgccgcgaggagaggaaggcgagaggggcgactagcgaggctacaccgccgcaccgtagagcctccctggaggagaggaggggcgagagagagagagagatggcgttgtgtggcagtgtgggatggatggataagataaaggatgtcgtgtggatggcgctgtgggtggtcaaaaaagccggcttggtttttttcaaaggtgtcagttccgttgaaaaaccgacacctatactataggtgtcaatttttttaatagaaccgatacctatatttgtattacaggtgtcagttctgttggcaactttttgtaacaagttgacaagcacgatcgcagcaccttaagctttgcggtgatcctagagtcaccaacgacctcaatctagccaaacggccaaaccaagatgggttttcataactaaaccggctagcggagccgatttgagataactacccgtatcgtgggcaaaacggaaggtttttaggacaaacctacaaagaggtgttgcactcttacagtgacggtgcaaatcgacaaagatggactaaactagggtaaaatagaaaacataactgaaaagtaaagaaaaaacgattcaagtagattgtattagggggattacaatgaaccggccttgtcccttaaataggggttggtcttgccctctacaggcccttctccacgtccaactcggaatagaaacgaaaggaaacacgaaacatagccttcccgagcaaggaaacccgagacccgacgaaaacagacccggattcggaccctgacggtctgaccgcgcacatacctgcggtcagactagccctactagccggtcagaccgcacacatacctgcggtctgaccggccctgtgaaggaaacccgacactttccaaactttgacaattttcccctatttcatccataggtgccaaatttgggtgtaaacatgttctaaataaaaaccgacacctatcgtataggtgccggttttttaatagaaccgacacctatagtatttaaaggtgcgggttctatttttttatcgtgcggaggtgggaaaatgtctataggtgtcggttttaaatgaacttctataagaccggtccctatgagggttttttaagtagtggatgcgatttaaccaaaggcaatagtttaagaaagcaaaataaacttattcgggctcaaaatttacgcgtattacacaaggctcgtgtttgggccaagcccacgaagccaatgcaaacataccaattccggattgaattgccacgtaagcgccacgtcagtgccacgtcagatgaagacagattcaaattagccacgtaggcactacgtcagctaaaaccaccctcgaaacctccaaggaaccttatatgtatcggttttgatagttgagggaccggttgtacctggtttaaggaaaattggattcgttgacaagttaaagagaacttagatggacttattccacaccaaaataccacatcactccccagtcctcgttgccctcttgccggagccgtcctccgccatgctccgtactccatctccgatcggcgacccgccctgagccggcggagccgctcgacgttagggccccacctcaccaggcgacggcgtgggcatcctcgattctcaggggtgtggcggcgtcggcggcggcgcaacggtgggcgccgtccatccctcccagccggctcggcctggtgaccggtgagctctctggaacccgtcacatgaagtttcttttcgtcagtttctattgggccatcgatgatcgatctggtgaatctgtgatcctttgccgtgtcgggcttcagattctacggtctgcatacctttgcccttttgtattagagtataagttggaaaactgataactggccacacagttgaggtgattccaaacaccaacttcgtcataaccttcgaggcaaatagtttcttgttgatggcaaacgatcaatgtgtagcaaatgatccgattttttattattccatggtctcgaactgaaaaaaaaaagtagttcgattttacttgactaaattgctgttcacgttgggctggttctatgcacatactctctgctcctgacactaaatgtcgatttcttgtaggattcannnnnnnnnnnnnnnnnnnnnnnnnnnnnnnnnnnnnnnn

SEQ ID NO: 5010 - DNA, 3696 bp, Oryza sativa
aaatagtttcttgttgatggcaaacgatcaatgtgtagcaaatgatccgattttttattattccatggtctcgaactgaaaaaaaaaagtagttcgattttacttgactaaattgctgttcacgttgggctggttctatgcacatactctctgctcctgacactaaatgtcgatttcttgtaggattcagagatgacggcgagatgcaaatttgtcaggcaatgtgattaagtagatatgcatcctggttggtcacaaggtgttatgctcacgcctcgatatggttcttgcgtagccacagaaaggagcagctactatgtgcttactccagccactggagttgtatacaacttgcctgtgaatccagcagaggagcatgtgtaccatgtccagttgatcacctgcacagaccttaccctcatttgcatttgggcatgttgcttccatgggagagtacaaggtgatccatatttacagacctagagctacatcagctctgtgagttcattactgtcaagtgtggcactcaccatgcagacctatgttgaaacacaggcaaacatcaatgttatctcttattgggtggtgtacttgatggatattggattgtgtatatgagctatgataatatgtggtgtaggtaccttcatccatcagtatttcatctgttgtttcaatcttgggatggagcaagaaacgggatgtccagggaccaattagcagcattttattttattttatctttttgagaaagcgattttcctgaggagtatatgtcaattggcatcaacagtttcactgaactgaaaggctacttagttttagtataccaccagcattactgttgaaccatggattaaagagtatacattcagtctggatcattcatccctgttattgagtaggatataaagccaataagccattgttggcgttagatgatgggaggatattcttctgtctaggatggactggattgctaagcatacctgatgagacattttgcacttttccaagaaccagcactttgcagaagtggagatgagacatcttgctggaaatagcacacagcaaaacagatgactttacaaaatggtgatgtagtgcagtattgcaatgtattgctactcccttcagtttgcagttgatgaaatttgcaagaaccatccattgcttttggaattgatcgttgggcagaatcataaattttggctgtgattcttttctactgttgaattgaagcctgcaaagatgtcttcgattcttgaagatgatagttttttttctctttcattttgtactatcttctgagattgtaatataaggtgtacttgtcagcatatatcatagtatctgacataatttagggctgctgcaactttgttttgcagtaaaaaggtgacagattgccagtgccacttgtgttgtaggtgaaattcgctgtgcatgtaaaaggatgcggtttgaatgcttatcatataatctctgttactgttatctagatataatgcacaagctctttgagctcatatattattcaatgagggttgaaatgctcttgtgtattgtgatgaatgatgaggagccttttgttgtatttgtatgtcagtctcagtcaacaactctgtaacaaggctgcatgcctatatgcattgctcagcccgccgtcaattcttgaaaatgaatgctgaataaacctgaaggatccaaacatggagagttacttatattcaagtcaaacagcaacctgttgtgctaccaggacactgatttgataatctgattgttttacttcagaagataatcaacagaaaaaggggaaaaagagttacagtatcagaataatgttacattgaattcaatgagcaagcccagggtaatgttacttgcattgaattcaacaaatcagcagtaatgtcaactgaaccacatgttttgcatacatttaattacattcaattgaaccaatcaagaataatctcagatttgcataataagataagtacactttgtcaataattacaacccatcagagcacagaactcataaacacctcaattctgagctaccgagtatcattaaatctatttctaccaaggcggacaaagcttttcataatacagtttgtccataaatacaagcatcagagcacatctcgcttctgatctacagatattatcatcaactaaatctcttcctacaaaggactaagctaatcagcctacagatcaaactgaattctctacataataacatcagcaaatctctctcttgcttcaggaggctaatcagccggcggatcaaagtctaagaggtcgtccatggagaactccatatccaagcagctcgggtcggccattgtgaagttgatgctgtttagaacctcatcaatggtctctgggaactcgaaatcagacaatgccggcgcctcactgtcgatgatgccctgtgaggagtatttttggttgtccagcgacggcgcaggcgctgcactacaagcatcggcttctgcttcctctgctggtagggtaatcaggtcttcaaggtgactaaacaccatggaagaatcatccatcacgttggaagagcactgatctgcgccgtcagcatcaccggcaacatcgagcagagggtactctgggaactcgaaatcagacaaggagtagttctgatagtctagtgacatagtcccagccggcgcatcaggacgatcagcttcttcttcttctggcaggacgatcgggtctgacagatgagtaaacaccgcagaagaatcatgcatcacaacggagcatccctgatcagggccttcagagctatcggcaacttcaaccagagcagccagaggaggaacaagcactggctgtggctgcggaacgaactcctcgagcagatcagactctattccagtgctctggggctcatggaggtcgcccatggagagctcaatgtccaagcagctggggtcagttgtggtgaagtcgatgcagttaggcaactcatccatgttgatctctgggaactcaaaatcagcccaggagtagtccatcgacgccagcgctgcaccaccggcggcatcaccttcttctgcgggcagggtgatcatgtccggaagatgactgaacaccattgtggaatcgtccatcacgccggagcatccctgattggcacagtcagcatcatcgacagcgtccaccagcgctgcgggaggggaaatcgacacggtctgtggcggtggaacgacctcgtcgagcagagcaacccctgttccggtgatctggggcgcggtctgtggcggcaggacgcactcctcgagtagagcagactctgttccagcgctctgtggcgcggctcgtcctcgaacgtcctcagtgccgacgtccagggcatcctctgttccggcgataggagggatgggaacgggctgtggcggcgggatgcgctcctcgaccagggcatcctctgttccgacgctctggggcgccggctgtggcggcatgacgcgctcctcgagcagagcagtctctgttccagcgctctgtggcgccgcgcgtgctcgaccgacaccgtcctcgccggattgtggctctctcttgcgcttcttgccgtggccgctgaaccggacgcggtagagccggatcggcgacgcggcgagctcggcgggggacgtgacggcgtactcatgcatcacccagc

SEQ ID NO: 5011 - DNA, 2696 bp, Oryza sativa
  unsure (1)..(2696): unsure at all n locations
nnnnnnnnnnnnnnnnnnnnnnnnnnnnnnnnnnnnnnnnnnnnnnnnnnncaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccatctttttggaagaaattttgaagcttgctcgggcagctggaggaggaagaagacatatatataggggtgggactttagtcccggttggtagcaccaactggggctaaagatcaccgggatctttagtcccggttggttacgatctttagtcccggttggtgttatcaaccgggactaaagatcccgggggggcctgacaggccctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtggaagcggcttggtagtagcaacactacctccttttggaagccaatttcctctcaaaaaatctgtgtcccttccatctcgcagaatatgagtcactgatatccaggggtgaagctacagcaaagcgtcggggtcagtagaccccgacgattttccacaaccatcgtataccccgtttatcttaccagccataaccccggtatagaataccattagaccccgatagattgattagttaaaggcaattgtgattaacaacaaagaatgacacaacaaaacagaaaatagctaagctagctcgtatgcattatatgccagcccagcccacataatgagacaacgtttggatgtgagcccacaaggctggcagccgtctccacaaattcccctgcgttgatgtcatattccagtattcctccattgtgatgaatttggaggcgtagacaagattttgtaagtaaccgctaccgaaccaagacttttttttttaacaaaaaatgtgccatagttgattttgtaccatcttatgtatagtcttgtgttcttttctcctgaagatgagacgaagattaagttttttacgcaaaacaaggtggtattaacatatgattgattgagttttaattattacaaacttgaaaaatagattagtatggtattttagagcaactttcatacagaaagttttcacacgaaacacaccgttcagcagtttgaaaagtgtgccacgaaaatcttaatcttcatccaacttttcttggagaaaagagcgggaccttagattattacaagctatagtctattgttagtatcattagttagtagaccccggcgatcatttatcctggctttgcccctgctgttattgccattcactcaattcctcgtgctgcgtgggctttcagcatagtgaaacaagttatcccatatcacctcgacaaggacacctacctccttcaaaccaaggatcacactggttgtagatgttttggaccgcgttgttctattttgcgtcgaggtttgctgcaacctatgtcccatgcacggaaggcgtaagacaaaaggaggaactcacccttgataagatggcatggggtaactccacttcttcacgttggacacctacacaacatgagaaactgagctagcagtgataaatcactaaaaaattagtggcaggtgagaaattgaaaatgaaaaattaaatttatggggagtcttttgtgtggtttgtgcggtctgtcagaagttttgatttttcccacaagtcgagtcctcagtttgccacagataaattagccccgagttttggtttccgattgaacatcagacatttcgatttttgtcttgaactctccgtttcaaacaaaaacatatgacctagaaggtccaatctagtactacctccgtctcaaaataagcgcagccatgagtttccgtgtccaacttcgaccgttcgtcttatttgaaattttttatgattagtatttttatttttattagattataaacatgaataatactttatgcgannnnnnnnnnnnnnnnnnnnnnnnnnnnnnnnnnnnnnnnnnnnnnnnnnnnnnnnnnnnnn

SEQ ID NO: 5012 - DNA, 11392 bp, Oryza sativa
taattcatttgtatcaaatattttgatagaaatctgggtaattaaacaatacatttattgtagatttatttcctcctgttttggctggatatagcctcacgataagtacttccttcttgagatatgaatcacatgggcattagctggcaagctattaattatttatatcaaatctttttagataactatgaccaattaagaagtacattaattttagattttcactgctatgtttgcatgctacacagtaaatggtatccttttccccaatatgaacatatatattcaacaacttctcttattaaggactcatttttactgaccgcgcatattttccagcaaagctcaaccttcaagcctgatagaagctcttttgctgccctgattgaaaatcgcaaaaggttaatccagattaaccatagaaggtactaccaaaatccccactggcatgaatccactgccagaattcttcaaacttttttccttatttttatgatatatggacaaaaaaggatattggtgatgaactaatcttcagcactactttatctttttgcttccaatgtttgttttgcatttcttgtcgtagttgaaagactccatgagtgaaaagaatttaaatttgttttaaaatttttaagttgactatatgtggggaaatttgttttgggtaggattagaaggaatggattcatatatttttgttacgaacaattggtcaactatataattcaaaagagtaaattgtacgggcggtccttaaacttgtaggggtatgtcatataggtcgctaaactctcaaaatgcatatccaagtaccagaacttgtcatagtgtgtaatataggtcacaaatcgctacaaccccttcaggatcctacgcagcgttgacgtggcatgccacatgtacatgacatggcattattttgactgacaaatgggacccatttaaaattttccctttttctttttttcttctcttttcccctttcttctccttcatctatcatccgtgcagaaaaaaggaaaaaacagaagaatgagaagaaaacaaaaaagaaaaagaaaagaaaaaaaagaaaaggatacgtcacgtccatgtggcattgccacatcagcgtcacgtagtatcctagaggggatgtgtcaatttgggacctagataataaactttgacaagttctgggacctggatatgcatttcgagagtttaggggcctatatgatataaccctacatgtttaaggactgctaatgcattttactctaaatcaaaatgtttgaaacttaacaaccccgtaaggtataaaacaaaatatactgaggcaaatattatcttgtgacttggaggaattaaacaataaatttactgtgatatttcccacttgttttgtttggatacaacgtcatgaaagattgtacgcctctttatcaaattccttctcctgacatgactaatttattattttttcaaacctttagataaatcatattattaaggattatatgtaattatacagagtcatgatagataaacttctttgactacttccttcttcagatatgatttagttaggaagtaatgaggcaagctattaagtattttaagtatcaaatcttttcatagaaatctgagtatttaagcagtacattagttgtacatttgtctttagcttacatgttattaatttatttgtatcaaatattttcatagaaatctgggtaattaagcagtacatttatgattgatttatttcctcctgttttggctggatatagcctaacgataagtacttccttcttgagatatgaatctcatgggcattagctggcaagctattaattcatttatatcaaatctttttagataacaatgaccaattaagaagtacattagatcttgattttcactgctatgtttgcatgctacatggtaaatagtatccttttccccaatatgaacatatatattcaacaacttctctttctgaggacttttttttgctggtcacatattttccaccaaagcttgcaaccttcaagcttgacggaagctcttctgctgctctgattgaaaatcgcaaaaggttgctccaaattaaccacacaaggtactaccaaaatcccctctggcatgaatccactgttagaattcatcaaactttttttcttatttttatgatatatggacaaaaatggatataggtgatgaactaatcttcaccactactttttctttttgcttccaatgtttgttttgcatctcttctcgtagttgaaagactccatgagtgaaaagaatttaaatttgagttttaaaatttgtaacttgactatatgtggggaaatttgttttgggtaggattagagggaatggattcatatatttttgttacaaacaattggtcaactatataaatcaaaatgtttgaaactttacaacgctgtaaggtataaagcaaaatataccgaggcaaatattatcttgtgacttggaggaattaaactataaatttaatgtgatatttccacttgttttgtttggatacaatgtcatgaaagattgtacgcctctttatcaaattccttctcatgacatgactaatttattattttttcaaacctttagataaatcatataattaagggttataagtaattatacagagtcatgatagataaacttctttgacaacttctttcttcagatatgatttagttaggaagtaacaaggcaagctattaagtattttatgtatcaaatcttttcattgcaatctaagtatttaagcagtacattagttgtacatttgtctttagctggcatgttattaattcatttgtatcaaatattttcatagaaatctgggtaattaagcagtaaatttttatagatttatttcctcctgttttggctagatatagcctcacgataagtacttccttcttgagatatgaatcacatggacattagctggaaagctattaattatttatctcaaatctttttagataactatgaccaattatgaagtacattaattctagattttcactgctatgtttgcatgctgcacagtaaatggtatcctttcccccaatatgaacatatatattcaacaacttctcttattaaggactcatttttattggccgcgcatattttccactaaagctcaacctgcaagcctgatagaagctcttctgctgctctgattgaaaatcgcaaaaggttgctccagactaaccacagaaggtactaccaaattccctctcgcatatccactgccaaaattcatcaaactttttctctaatatagcttttgttcttcgttacttttttttttgaaagtttattttgcttttcttactggtggtaaccggaagccacggagcgagaggaatttaaattcgaattttaaactttgtaatttgtgtatatgtggagtaactagttttagttttgggtacgatcagttggaatgaattggtatattcttgtcacaaaaaaggtcaactctataaaatcaaagtttttgaaactagacaacccggtaaaacagaatcaaatcttttcataggacttcaagaaattaagaaataaattaattgtggtatttgcttcatgttttgtttggatacatcataaaaaaaatatttctctttatcaaatttcttctcctgatatgaatattttattatttttcaaatcctttgttagaaatcttagtaattaaggatcacattaattataagtaattacatagcctcgtgatagtattgatagctaaatgtctttagcttgttccttcttgatatatgaatacactagcaattagcacgaattctgttaagtcttctaatatcaaatcttttcataaaaggctgagtaattgggatataatattattaattcgtttatatcaaatcttttcatagaaacctgggcaattaagcagtacatttattacagatttgtttccttctgttttggttggatacaacctcataataaataaaccgctttaagtacttccttcttgagatatgtatgaatcacttagcagctatcaattcatttatatcaaatatttttactcaaatctgaccaattaagaagtacattaattctagatttttgcactattttttggatgctagtacataattaatggtatcctccccccataagaatatatattttcaacttctcttaatgatgacttttgttttactgaccacaaattttcttccaaagctcagaaccatcaagcctgatgcaagctctcgtgttgctctgatcgaaaaactgcaaagatcgctcgagattaaccacaaaaggtacaaccaaatcccctctgacatgaatcccagcgaaaattcatcaaacttttgcaatcctttttatgatatgtgggcaaaaggagcatgtaagtgatgaactaaccttcattacttaatttttttccttcaaaagtttgttttgcttttattactagtagtagcccagaagtcagggagtgaaagtaatttaaatttgagtttttcaaccttttaattggctatacgtgaggaaatttgttttgggtaagatgaggtggaataaattgatatatttttgtttgagacaaatggtcaactctatataatcaacattttcgaaactagacaaccccatcgggtaaaatgaaattcactctggcaaatcttttcataggacttggagaagttaaacaattaattagttaattgtggtatttgccgccagttttcatttgataaaacatcatgaaaaattatacctctttatcatattccttctccttgtatgattaattttttatttttcaaatctttcgatagaaatctaagtaattaaggattacattaattataagtaccaataaagcctcatgatagataaacattttttaactaattccttcttcatatatgaattaattggcaagtaccatgcatgctattaagtcttttaatatcaaatctttcgtagaaatctgggtaatgaagcagtacatttattatagatttgttttctcctgttttggctagatgcaacatcatgataaataaataaatttaataagtgcttccttcttgagatgtgaagcagttggccattagcatgcatgctattaattcatttataccaaatctttttacctaaatctgaccatttaataagtacattaactctagattttcactgctatgtttggatgcttacataactaatggtatcattttcccctatattactgatcacacatgttttcctccaaagcttagaaccttcaagcctgacagaaactctgatcggaaaaccgcaaagtcgcaccagattaaccacagagggtacaaccaaaccctctctgccatgaatccataggccacagccagaattcatcaaactttcgctcgcatttttatgatatatggacaatagaaaacgcatgtaaatgatgatcactaatcttcgttactttcttttttgttgcttccaaagtttgtttcgctttttgttactggaagcagtcagaagccatggacgcgtcctagaaatccgtcatgacgaaggaggagcaacaactgtcgccagcagcaagcccagcggcagcagtcatgacagccgaggctgatgccatcaacgaggaacaagactaggctgctgctgctacaaccgcagatcacactgctcctcctcctcctcctcctgctgctgctgctgttgcagatcacgctggggagatggacatggctagtggcagcggcgttgctcacctggcaccaccggcggtggcgccggcgccgcggtcttctctcgctatggcgggctcggggctggcggaccatgtcctggagcgcatggtgaaggtgctgatgaggaagtgccacccgccgcaggcgttgtacccgctgattggcaagtcgccactgcggccgccatggtggccgacggggcgcgagcagtggtggccggagctcggcgccggcgccgtcgtcccgccgtacaggcctgcgccgctgctgtccaaggcggagaaggaggtggccgtggtcgccatggtgaagaacctcgtgccggacttcgagcgcctcttcatggccgtgcgaatggcgcccagcgtcaccagcaggatcaccgacgccgaggcgagggcgtgggacgacggcgtcgccggggagcgcgagacgtacatggcgcggcacccgcaccgcacgacgccgaccagggcgtggaagctcatggattccctcaagccggaggcggtgaggatgaagctcaaggcgcccaagccgaagccgcaggtcaccatcaaagtcgaggacgccgcgcctttcctcactgtctccgctgccgctgaccccgccgccgtcgaggccgccatgggggccatcgaagccatgagaaacagcagcaaggatccagatgctccgtactatcccatgccatctccacttcatgggcataatgaagttggtccaaatgattacccaggtatgaatatgatacgaaattatttgatatttcaccaatatgttttgttccatatatgtgctgctgaattctgaatcacttttgatagttctaataatcctcttttgcaccagaaaacccagcaatctggaaggagttcaacaggaaagaaggtatgtgtaattataaaagaaaataaagataaaattcatggaaattcggtttaaaaaattctttactttcaattttaagttacacattagtcatcacggattctgcacctagttattaacatgcatgcatggtggtacatgtatgatgcgatatattgtaggtcagcttgacttgttgcgagttggcaaaaagaatgaccggatggcgatatccgatagggtggatggaggagccagtggtagcggccccaggaagggctatcttgtgatgaaaacgtacaaaaaggctcaagaatattatcgcgaactacggaacaaaggcgccatggctagtggtgcaggtagtatgatgagttttcgataattttttctcttgtctaaaatacaatagaacatatagaaaatagtatggttggctaccgagaggagtgaaccgcctaggcagataagggtcagggttgttagctggcttaaccagctgagtgcacataggccaacgattgatcaccctcaattatttcaaacaaaaaccacacgttgaaagagtttttttattgattgatgatcgtagatctttgcgtatgtcgacaccacttcctacgccttgctagatatatagtaccgtattgttggcttttagctgtattattttttttgtcggtcactccttgcatgtcgtgtgcatccttagatgatgttagctggtaggttggaaataacattttgtaatgctcacataattttgtttaatttgtcaaataatgcaactgtatctatttttttcattcaaaactacaactaactaacattttatgaggctcacaattaaacttttgcttattttttgaaataatgcaaatgatttgattttttttatccaaaaatataactaactaacagtttatagtgctcacactattcaatgtttaggtgttaaaattgaagatgacagtgaaaccgagagtgacaatgaagatgagaaggcaaatgagaaggctaaggctaaggccaaggctagagctgtgtatcaacaaaataaaggtatccaagaaaattattggtgatgctagctggcaaatgtcatggtacctttttatttttattttaaacatgtttcttgtgattgcattcctatggtcaataattgtggcggatgatcaatatcggaaccatttgaaccgtgatggttccaatctaattcaggttcattttttttaataaatgatttaatagtgcttatatatttttgttgttatcctttaaactttgtgaacagtccttagatgttttgtctatccttagacattagctagtaggtaggaagtaacattttggaatgctcacaatttttcaaatttgagaaataatgcaactgtatttgatttttttttacccaaaactacatctaactaacattttgtactgctcgcagttaaagttttgtttaatttttgaaatattgcaattgtatttgattttttcatccaaaactacagctaactaacattgtttaatgctcacattattcaatgtttaggtgttaaaactgaagatcagagtgaaacagaaagtgataatgaagatgaacaggcaaaggttatggcaaaagctaaggctagagttatacctcgaccaaacaaaggtatctaagaaaattatcggtgatgctagccggaaaatgttatgatattcttttttttatattaaacatgcctcttagttgcgactgcaaatctttagtacttcagtattttcatatggtcaataattgtgcccaatgatcgaaatcagaaccatttgaaattgatgatgccatgctaattcaggttcaaaacttttttgacgaaatgatttagtcatgcttaaatatttttgttgttatcctttttaaactttgtgcacacttcaaaactccattagtaggttattttgccatgcatacatggaaatggtactgagttgatccgttgtattgcacacgggaatttatcccatttctagcatgaatggaattatttgttgttaaactactgcattcagtttagggcatttttagtgtatgcacattaatgataaactaaatgaaattgcggatccttgaactccaagggagttatctaggtttggagactcaataattttgggttgtacccacgaagttctcttgtgcgcttgttgtagattcaaactagggatggttatatatttgatggaggtggtatctacaccattctttccagccaactcatgactataatttgttttccattaacccagtttgtccgcgcacctcacataccctcccccccccaataggtgttcttaggacaattataatttactaagttgaataaggcttccatgttctaaaaatatatatcagcccccttgcaatccctggcctatccagcagtatggtttgcaagatcacgttggtgacaacacatggtcgggcacaactttcagaagacatgcctatagttaaaaatatagtgttcacttataagtgtcattttagcatggtgttttgttatcccctcatatctgggcacggatgagggaagaaaatgcatttctaaatgtcaagtatgttgactaggtgcttcgtccactatagggatggcaagggctaggtcaagcttaggcagagcaagagcataggtccgaccctagacctggcccgataccgtcttgcctgagctatgcctgatagcctcagcgggcatgaaagacacgccaatgctgagtgggcacctgaaactcaatgagtcacaatcgggcatctgctccttcaccgccactagggtggggctagcatcccccatggagtaaggaaacacaacaccacaaccaatggtaaacaaggactggaaattttccctcaattaaactattcattgtcacccacgtgaccgggccaagatgccaagtagaaaatagaggtgtattgcgatatgtgggttctcatcttttgtccatgcatctaattgccacggcacgatgctgatccgcgcctacgttgccgtctgctgagctactagtgagttctcattaggacattgtcctcctaagccatgcctccacaccacacctccccccttctcccggcgtgcagagttattaagtacgacacttttttggtatgttcattgcacattaccgtattcgatccaatgttgcatccagcaaacacacatgtacaacattacacagtttccatggtaaatcgtatttgcacgtaaagaaccagcagtgaagctagctcctgggctggtcgggcgaccaccggctccatcgccgacttttgcactatttttccattagaaacacatgtaaatatttatcgatcaataggaaacactcttcatcacctgagcttgatgacgtcattggctcctccactgcaaagaacatacttggctagatgaagataaaagcaaatagctgcactccagaaaaacatatttgatcctttccttttgtacaaacagaggactcaggaacatatggcaacttggtatatatagcgggtatggtcgatgatggaatcatccttttttttaagtcaaagaaagactttccattgtcaaattggagacatctagcaattctacactccaaaaagtccagaggtttcccaaaggacggtaagatgggcccttccttccccgagtgaacaactcaaacttccctctcccctaagtgatagcagtgctagtttgataacagatcttgtctattagcctgaggagggagtcttatgagtgaagcatgaaacaatatggtaaggttgagtggaccgaccgagatctaaaatactatggttaggaacaacttgacttatctcaacaagtggtttaattagctcttctttcacaaaacacaaatccttttggtatgaggctctatgagcttatcatttgtactcttatccatccattttaactccttttatcgactggagaagcatagcttccttacacgcgcatgacataggatacgtgaaaacagatatttgtactagcgatcagccgatcatcaggagaggaacctctacatcccacgtttcttcaaatgcattctacagtatatttagggaaactatgagtcattgagagagaccacatttgtaccaatcaaatgcacttgtggtgcactaacattccgttttggtctcgtacactccttatgttaaaatgtcacctagacctcctttggccgcatcattcctctcaaccaaaactgtaaatcaagcccactaacccccgtaccatataaaagctatgattttaaccatgaaaaattgatagatccaatagcgttggaggtagtttgatttgatggagtgatgacttatgcagcaagcattgtcgactaggcgaattgtggacgcacctacagagtaggtggctgggcgctgacagagcagatgccctattggcactcattgggtttcaggtgcccactaagcatgggcgtgtgcactgattcatgctcgctgaggctattaggcatagctcgagcaagaaagtatcaggttgtgtctagggtcagacttgtgctcttgctctgcttaagcttgacatgggctttgccatccctatagtggacgaagcacctagtcatgaatcaaaaatgtaaaccaaaactgtaaatcaagcccactgacccccgaaccatgtaaaagctatgattttaaccataaaaaattgatagatcca

SEQ ID NO: 5013 - DNA, 8196 bp, Oryza sativa
  unsure (1)..(8196): unsure at all n locations
ctgattcctgcccgcttaggctatcaggcatagctcgggcaagacagtatcgggtcgtgtctagggtccgacttgtgctcttgctttgcttaagtttgatgcggcctttgccatccctctagtggacaaagcacctagtcagcatacttcttgacattaagaaatgcattttattccctcatccgagcctagatatgaggggataataaaccaccatcctaaaatgacacttaattataagtgaaccctatatattttaaactatatggcatattttttgaaagctaggcccgaccgtgtgttgtcaccaatgtgaccatgcaaaccacagtgctggataggccaagggctgcaagggagctgatatatatttttagaacatgaaagctttattgaactctgtaaattacatcaaggtggtgcaattgtcctaagaacacctgttgggggggggcgtatgtgtggtgacgtggacaaactaggtcaacgataagcaaatattggtcatgagttggatagaaagaattgcgtagataccacctccatcaaagatataaccatgcctagtttgaacctacaataagcacacatggcaacttcgtgggtacaacccgaaattatcgagtctccaaacctagataactcccttggagttcaacgatccgcaatttcattatgtctatcattaatatgcatacactaaaaatgccctaaactaaaagcagcagtttaacaacaaataattccattccaactggaaatgggataaattcccgtgtgcaacaccacggatcaacttagtaccatttccatgtttgcatagcaaaataacctactaatggagttttgaagtgtgctcaacgttttaaaaagataacgacaaaaataattaatcattactaaatcatttcttcaaaaaaatttgaacctgaattagcatggcatcatcactattcaaatggtttcaatattgatcattggccacaattattgaccataggaaaatactgaagaactatagatttgcagtcgcaactaagaaacatgtttaatataaataaataaataaagagtatcaaaacatttgccagctagcatcaccaataatttgtttagatacctatgtttggtcgaagtataactatagccttagccatagccatagccttaggcttttcatcatcattgtcactttcagtttcactgtcatcttcagttttgacacctaaacattgaatagaatagtgtgagcattacaaaatgttagttagctgtagttttggaagaaaaaaatcaaatacatttgcaatatttcaaaaatgaaacagaactttaattgtgagcgttacaaaatgttagttcaatgtagttttgcatgaaaagaatcaaatacagttgcattatttcagaaattaaacaaaactttgtgagcattacaaaatgttacttacaatctactagctaaagtctaaggatgcacacagcatgaaaggagtgcgcataaagtttaaaaaggataacaacaaaaatatttaagctcgactaaatcatttcttcgaaaaattctgaacttgcattagcatggcatcatcactgttcaaatggttccgatattgatagtcggccacaattattgaccataggaaaatactgaagtgctgaagatttgcagtcacaacaaaaaacatgattaagataaaaaataaaggttaccataaaattttctagctagcatcaccaacaattttcatagatacctttgtttgttcgaagcatagctctaaccatagccttagccttttcatcttcattatcactttcagcttcactctcacattcagttttaacacctaaacattgaatagtgtgagcatttattggaaaatacgagaaaaaaattatcggaaactcatcatattacctgcaccactagctatggcgcctttgttccatagttcacgataatattcttaagccttgtcatacgttttcatcacaagatggccctgcctggggctgctaccactggctcctccctgcctggggctgctaccactggctcctccatccaccctatcggatatcaccatcccaccattctttatgccaactcgcagcaactcaagctgacctgcaatatatcgcatcatatatattccatcatgcatgtatgttaataactaggtgaagaatccatgttgaacaatattgcattacttcctcataggctacatgaatttgatattcacttcctatatataacctaaaattcaaagaaaagattttctaaaaccgaatttccataaattttgtctgtattttcttttataattacgtgtactttctttcctgttgaactccttccagattgttgggttttctggtgcaaagaggattattagaacgatcaaaagtgatacagaattaggagcttcaacttgttacattacatgatattttagcacatacaagaatattgaactagcaaaatatctcgttgtttctttttttttcatggtaacacatttgactagagtttgttctcatcaacacattgtggtttagtctaaaaggaaaggagttgcttgcaattatttgtttgtgtgtactgatatgtgttggaacataaagtgaattaaccatctttcccccatcagctttaagcttttggattgaactgattagtgcatcaatgctagatacttaaggggcctcgcgtgaggaagaatgttagaatataaagtgaattgcctatctttccccatcagcttaagcttttggggttgaactggtcgatgcatataactcaaagtgtgcatacgcatacatgcataaatccacttctatgattctatatttgtaaaacaaaataaagtaaaaaattctgcgtaacagcctctcctgggcacttctgaagagcaacttgaagctttaagcttcatttttcatgaaaggtccagcctttgaaaattttaattcaattattgaaaggctgctgagctgacatggttttactgatggacaccatgcacgagagagagatgggaggccggaggggagttggcagcggctgctagcgctgtagaaaatggtagagcagagcagcggcacaattaaaaagcaaccaatgatatacggagcttgggaatacctaagctgaagcctagaggcggctgagcaagtgatcggtgagaaactctgtagtagtacttaaagactcccgtatgtacttcagcagaccagcatggaagcttgacaaataccgcctgtttcatatttcttgaccttttttatagctaacatggtctctaaaaatatatcttttattttaacacataaaagacaagtaaatatttaattttattgagacagtgttttcaaactagagttattagttattgatagtcaaagtttaattgttcgatctcaaccttatttcaaaggttaagaattatgaaatcgaaggaaatactttgatcccaatccgtcccatgatataaggtgtttgaagttccacaatataagacatgatcaaacttggcatattctacaaaactaatctttgacttttagattctgattatacgataatgttttagcaactaagttcacatgaaagtaaattcaaatgctaatttaattatatgagtaaagtgcatatagggagtagataatttggctatttctagctaactttgaaataaaaatgtttgtaccaacaatagcatatggttcctatatatgactacctctacacacatggcatgcaagatctgtaaggtcaaaatgatatggaaaaatttgcgaaaggggacatcctggtttgacagttttagctgcgtcgtagaagcaaaactttgggaaaacatattctcaaagtatggctcttaactgatggacactgtgcctattttttattatatttcttttattgagaagagaaaggaggccagaaaggagtagctaaaacatgcatggaaactcaggagttctcttgcgatcagaattgcttcaccgaggcacatgatacatgtgacctgtgaccatcatactattagaggtcatatgcttttgattttatattgaattacaaaattaccataactatctcctcaaaattacatagatttaatgggatttaagctatgtgaacagaaatatcacttgcgcaaaacatgtggctaagctggtataaacatcaacaattgattggagttaattaatctcgtttattttgcattttagatcttttgtttgaaacaaattcaacttaaaataagactgaacgcaactatataaatattaatatgttatactaaatatattttcagggtatatgtaacatggacacgtggtctccatgtgttcaaacatgtgctaactgctaatcactttttcagtagcgcacattcagctaagtgttaactcattttgagtgaaaaataatcacaaatatctgaaatttcgatagacactagttaagcataacagaactattatcggtactgaaattttgtatgttttttttcgtttctatttgattgtcttctgaagtaaagaaccaaccaattcagtgtcctggtagcacaatgtcaagaatcaactcatgcttaatcaccagcgtttatatagaccagatctcctgttttcatgcgtgaaacttcactgtataatgtggtaacactgctacagaacccttatgggtaccggttgggaatctggtttccagtcggtaccaatttggcggcaccaataccgaaccgcatgggatactcctatcgtccaacaagattatttagatttccactattattttactataaaattaattaataatgcacttgcaagaatttctaccaaagtgctaaaatctacatccaaaatgctaaaatctagcaactagtgaaaacacatgcatcaataaaagaaacggagatagaatatagagaaattaaccttaaataaaaaatttaaggcaaaacctcccctcctctagctagacgagtagaatagaggcgccactagctctgtctactcctggccagcttgaggtaagtaggaggtatttatactgcacacaataggtgctggttcttaggacaaaaccggtacctattttctattataggtactggttctatgttaaaaacagacccaatacccccaagcaaaaatcagcacctataagtgggcccaccttccgaaagtattggtggaccgttagtggggcccacttataaatgatggttctgtcataagaaccggtgcctacacctccctgcatataggtgctgatttttctaaatgaaccgttacctataggtgggcccacaagtgccaatgtgccggccggaccaactataggtgtcggtttttggttaataatcgacacatatgcttgttggcgaaaaatccgtgttcagccgatggtgccaaaactgtgttaacacggactaagtcgatgaacacaatagcctgggagatatgcttagctccagtgcaagtccaaaatattgatgagatgcgggcgtgccagtcagtttgatcctgtagctgataagatatgcaaataacagatcaaatagccgatcggctgacaagccgatggagtaattccagccgatgccgataccagccgatgccgataccagccgatgtcgatagggttttgaacaattggctatatatccaatgtatattctgatacttgagtaaaaaatgatataattaaagacaatcggcgggtgataatcaatataattcgacaatataatctagtagaaactaatcggctaataatgatacgatagaacaagtgtcgatccaaaggttaaagcatatattggctggaaatccgatgttataaaattcaagagattaattagataaacagtgaaatctttgttgcgatcggctaaaactaacttgtatacaatccttgtaagctgattgtttgtatttcttaacgatattactagaaatataattcccagcaatggcgtagaaataattcctggtatattatggttaagtttatccacaagcgcacggatataccattgtagcattccacccaagagtattccaagggtatcgtatttgtttaatcccgtgggaagattatagtagagagaaccgtactaataatttatatgttacttgtaataatcatagtctaagcaggggttaatataatccatagggtaggatgacatacaagcattgaactactcattctcatactaaattatctaagctaagtggaaagaaagtagaaaagaatctattcctatacatctagtatacatattatacatacattctagttatatgattaactagctaatgccctctttccgatgccctcctagtacttcgagaagccacccctaactgttgagttccttacgacagcccgtcatgaccatacaaccggagctaaatacgttcaccaggaaattaacttaggactatatacacgcgtggaggaattcccgtactgagctatcaccatcagcggctgtcggtgatatgggcctgggggtatcacgtttagagggaggaggccttccccaagcccgcgtggcttcccctgaggggggtcgagcccggggtggagcggcggctgccccctcccagcttggggtcggggctgcgccccaagcccacgtggctcccctctaggagggtcaagcccggggtggagcggcggctacccctcccaacttggggtcgagcccggggtggagcggcggctgccccctcccagcttagggtcggggccgcccccaagcccacgtggctccccctgagggggatcgagccctgggtggagcggcggctaccccctcccaacttggggtcgggttgccccgacccgctccccgtatcagcccacgtgtacagggttaggtgggcacacctaacgcccacctaaccgcatttaaagtggtccttgcagccatgctatggcacgccgcatttaatgcggcatgttgcacatctgacaggtctgtgaccgatttgtggctagtctatgaccggtcgaatgaccgatgggacggcggctgtgtacccccaccctgtcagtgtgccaggcggcatgcggcgtgctctgtcccgtcacatcataatgagaggctttttagtctctcatcatagccagagtcggtttatccgctctggtcaaacaggagcccagaagtcttcatctcttaaatggcaactgacaggggcaccccctgtgtcaggcggcaagatttgacgggccacatcatcaagacgacgtgcgcttggcttcccaaatcaagatacaagacatggatttaatgcaaagattgtaatacttctccactaagttaggttgttgggcccatgtggtaaccccttaaggtataaaaggaggtctaggcctacttaaggagggggatggacagattgaggggaggatgagccattttagactctagagcagcttctgcccctcatgatcaacaccttctactccaacaaggagatcttataatttctcccacaatcagcatagcacaggagtagggtattacgcttctcagcgggcggaacctgtataaaccccttttgtctcatcgtcttggaggggcctaaccccctcaagatcacacagtttcgctctccaagccctcgaatctcacccgctacccccggccgaaccaaaaaaggggggcctcacggttccctggtggaggagttcaccttccgacaacggcccacctctcatccgcagcatataaccccaaataatgattcccgataatttagacaccacgcctaaactaccagatactactctaatatcatcgttatgacatagagtaattacaatagcaaacattatacccgtacctatgcatctcctaaataagctagcagtataatcagtataacattaacataaagtaaagttggtattcatatactcggaaagtattttaataccagaattgtataaggaagaatattctaaataaagtacaaatcttacaaaagagaaaaggagagctactagagccatacctgaactcttccgaagacttccagacttcgatttctattctattcctactcactagcttgagaatactaaactaannnnnnnnnnnnnnnnnnnnnnnnnnnnnnnnnnnnnnnnnnnnnnnnnnnnnnnnnnnnnnnnnn

SEQ ID NO: 5014 - DNA, 3476 bp, Oryza sativa
  unsure (1)..(3476): unsure at all n locations
atctagcaagataatttagccgatactagcataaaccctataacaaatctcagccgatacaagtaaattacaatgctaaactagattgactaagatatatgataaataggttggcaaatatgtcaaccgaatcagagcaatccaagaggttgaagcgatgcagccttgaacaacgccaatgtagccaatacaattgccatggccggtggaacgtaagacttaccctttccccggagatcgaaagccgatgcaaccccgcgtcaggtgccaagttccgctgtgataagtaaaaacctcggaaaagaaagtggcgatgcgccgagagtagttgtattaatctgtggagatagtttacaatgaccccgggtgtacatatttatagccatgggtagatactagttcttgttggacaagaaaggaactttcctaaaaataaaaggaaaacataaagtccttatcggacactaaacacactatcctaaagataaaacgaaactaatagactattcctaattaatagataaactgtcatgccgcatcctccttgaactcggtcacttctggataaactttctttagcagattaatttccttaaccaaatctactaagaatccaactattggcaacttgataattcccatcggccgatttcaagactctgaagccgatactgactctaggccgatgatgacttcggggcttaccaaatttcactgttaacaatactataagtgtcggttgtatcttataaccggtacctataaactagaattgatgttggttttagtttaaccggcacctatgaaccaatatctatgagagattctgtagtagtgtaaaaagtgttggttgatttttcggatgagcccacaatccgaactaatttgagataagagataaggttgttttgtaatcggttaaaacaacttttaacacctaattcgagataagctcccgggccccaccagtgctatataagagaagtaatcgcaggaggagaggatgctcaattcttgctatctaatctaaaaccctaattcgccaccgatcggcttaagcgctggaaggggttcgttcggctgtctcagggcagtgctggtggagacccgaaggccggcgtgatctagcgagaagaaaagagaaagagaaagaagaagaaaagcaagaggaaccaatggcttcaaatgcgacaggtcagagaagttaattttgtaattaagagtgattgctttataggctaaagttaagatcttgtaatttagaactccaacaaaaagaaactatgcatgtgtagtaagtatattcggaccattttcccaatgtcaccgaacagaaatgccatcactactgtaccagtggtgatagctattcaagattcagtatccagttatttgcatcgaccgtcttgacggtacctggaaacacgaccatttagagttcagagtgcacttaggtttgtggaatttctgagaaatgatagatgactgaagtcatcatgggttcaggtaagctctgctgcaaaatgaacctcacatcccaatttcagacttgttcctgcatgattcgagtgtacaattaaccatcaatttattagagtgttagcttgttggagtgctccatcaaccgatttcatatgagaaaattcatacagatacttacacagtttgtcgagatacttagtgagggaggatgcacgttctgaacccaacatcacttaatgcagaatgcgcatctcttccatcaggagttgttacatccacagccttgcagtgaagagagtggtacaaacaagctttagaaaagggaaattctttcggtcagattgcgtgagcttctgttcacaaaataaattcagaacagagactataatttcatagtaaaatcattctgttaaaataaagggacttctctaccctgtcccagtcttttttttgcgaaagaaaggtgcaagagatcttctacttcgataaataaaatatacaagagcaggctatacaatggattccctaacaaaatttcttattgagtactaactctatttattcgaaaatcctattttatcacaacctagttcattagcctctagttaaaaacgacagaatacagttgttgatagtgtaaatatgtttcttttttttttttaccttctgtttggttgtcatcgctggtgtccttttctttacaatagactgtgttgttgattgcggtgggaatggctgctgttatttgggccatttagaaaactcgaaataaagcatgctttgagaaaaggtatccacaagatcccactgatttggtcaaagaaatctggagcaagtcaaagaagactgcaattgggggctaggctcataaggcaggtagcaaatgaaatctacagctcaagacatggatggagggcttgtgccagaagaattgagggatgatctgctgaatctttctcagtttatgttgtttgctcttcagtccagcgatgtatgttaacctgcagtgcttttgtaataggcatagttcctgttatctcagttcagtcctagacctgatggactgccttctcttttatttccagactctgtatgtgtgatcatttctaaaaaaagaaatgggggtattcttgcccttggtaaaaaagaaaaagttcttgctaacagagcttgtggtttttcagtcaagaccattgtcactgtagtgggtttgtatggaagatgcaggatgtttgattcatttccactcaggatccatttttttcagatatgttggcaaagaccctttcaatcagaagcttttctttcatttgcttaatgaaatccccatcatccaaaaatttagaggctttaaaggcaactttaatatgctccccacatctgagattgaaggagggtgcaaaacaaattgaatcttatctcgtatatagtttataatattgtatcagttgtaacaaacagataaaatggctatcctgtgatcaatttgaccaatactactattcatgcacggcaatataaatagccatgcactattcatgtcctgcttcaaaaacttctctccaaaattgattcttgtctctctctttttttttttttgacagagtacatgtcacatgaactgtacaggttaaagtatgtggctttgtgctacactgctactaactgccagtccttttctgcgtggaatatcacaattctcaccaaactgattcatagcctgcactaaagcacaacagagtgcagttagcaaaatgaataaaagagttgcatttaatcttcagactttcagggtgcatgtgacgtggagtattggactgtatatgtgcaataaccacaaatttcctaaaactattttttttgccatcaattaaccacgacacagtacttttgttgataatgaaactctgtcctctttttttccttttttaatttgannnnnnnnnnnnnnnnnnnnnnnnnnnnnnnnnnnnnnnnnnnnnnnnnnnnnnnnn

SEQ ID NO: 5015 - DNA, 722 bp, Oryza sativa
  unsure (1)..(722): unsure at all n locations
nnnnnnnnnnnnnnnnnnnnnnnnnnnnnnnnnnnnnnnnnnnnnnnnnnnnnnncgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggtgtcctctcatgtatgatgccatgttcctcacaaaataagtcaaactcgttcgagaaaaactctccaccacgatcagacctaagcctttttatctttctgtcaagttgattttcaacttctggcttataattttaaaatagtctagagcctcgtctttcgttttcaacaagtacacatagcaaaatctagtagcatcatcaatcaatgtcatgaaat

SEQ ID NO: 5016 - DNA, 923 bp, Oryza sativa
  unsure (1)..(923): unsure at all n locations
nnnnnnnnnnnnnnnnnnnnnnnnnnnnnnnnnnnnnnnnnnnnnnnnnnnnnnnnnnttctgcttcaatcacaaccctatacacattgttattcagagcttcttcgtcaagcaatggtggagcacttggcacatagactgaggcgtgcaagaatgtttctccatcgctacctgaccctaagaatgcgacactagacttagtgtcctttggcggctgaatttcagaatttttgccgccacgactgatgattgcaattaaaccacccagcagatttctaaggtttaccggcttatctgccttcaagggtgcagatccccaaccatcgtccgcacaatcatagccataaaaattggttttgccaccaaaatcaaattgcttgtgctcagccaattttgactcaaaggaattgatgatgtttccagctgttcccagtgctccttctacatgctgtgggaatgactttggatcaaatgagttcatcacatcccctatcgtgcccaaaaccttggattggatctcatccttaaaactgttttccactcccggtgtaggcaaagggtgatacttgaaaacctctcgcgaggtcgccatggtcataaattactaccacacaaaagttactgaaagagtaaaacacgaaaagagaaaataatcaaaatatgctggaatacaatttatctaaataacaaccaaatggtaataactactcatattcagaacaaaacaatctcagctgtacacaaaatttccacgtattctgcgaacagggttgaacctaacgtgggcatggggatacctctggttgaacccacagttttttttttatatatatatatacttctatatattaagaaaaagagaaaaacctaggttccagatctacatgttattacaggctaaggcgaaatcgaaagaaacagga

SEQ ID NO: 5017 - DNA, 622 bp, Oryza sativa
  unsure (1)..(622): unsure at all n locations
nnnnnnnnnnnnnnnnnnnnnnnnnnnnnnnnnnnnnntacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5018 - DNA, 4110 bp, Oryza sativa
tatccattattcgcgagttatgaactccgaaatcaaatccaataaaataatggaacaaaatcggcatgatgcaatttattcaaaaagtttttgaaggcccatatttttggagtttagatttttgtcggtccaatttttagggtgttacaaacctatccccctgaaataaatctcgtcccgagatttcttaccagttttcgaataaatgtgggtattccgtctttaagaactcttcactttcccaggttgcttcatcctcggtgtgattactccattgtaccttgtacatatgccacactttgctcctagtcctcttctcggctctatccaatatccggaccggatgctctggatacgtgaggtcattgctaaggtgaatttcttccaacagagcttgttcttccggcactcgtaagcatttctttagttgagatacatggaagactgggtgcacatcagcgatattttctggtagctgcagctgatatgcaacttctcctcttctagccgtgatttgaaagggtcccacatatcttggtgctagttttcctttaaccttaaaccttttcggtcccctcatcggataaattttgagatatacgtaatctccttctttaaattccagattccttcttcgagtgtcggcgtaacacttctgccgtgattatgccacttttagacggtcccgaatcaggcgaaccttctcttcggcctcgttgataatgtcaggtccaaataccgcccgttcacctgtcttcgaccacatcagcggagtccggcatcgtcgaccaaacaatgcttcattgggggacatcttcaggcttgcttgaaagctgttgttgtgggagaattcggcgtagggcaaacacctctcccagtctttactaaaatccaatgcacaggctctcagcatgtcttccaggacctggtttgtcctctccgtttgaccatccgtctgtggatgatgagccgtgcaaaaagcaagataacttcctagggcttcatgtactttctcctagaagtgcgaggtaaactgtgtgcctcgatcagatataatcctcttaggcactccatgaaggcacactatcctggtcatatacaactcggcgagcttagcactgttatagtttgtcttgacgggaataaatcttgccgtcttggtgagtcgatccacaatcacccagatagaatcgtaccctgttgcggtcttgggcaatccaactatgaaatccatacctatctcatcccatttccattcgggaatcctgagaggttgcaacaaacttgccggcctctggtgctcagccttcaccttctggcctacgtcgcagagtgctacgtattcggccacatctctcttcatgttgggccaccagtaaccctccttcagatcctggtacatcttggtacttccggggtgcaacgaatatgccgattcgtgagcctcttttaggattaatcctctcagtcctccctgttcgggtacatagattctctttttgtaccatagaacacctttttcatcggttgaaaattcctttgcacgtcctgcggctaggcgtccctttacttctcggatttcctagttgtctttctgagcttcctctatttgggtcctcagaagaggttgaatgtccagggtgtttatctgtccacgaggcactatatgtagatttagctgggccaattcctctttaagctcaggagccatcccttccattctcagatgtttgcaatggctcttacgactcaaagcatcgaccacgacgtttgccttaccggggtgatagtgaacctcgagatcgtagtccttgattaattccagccatcgcctttgtctcaagttcagatctgactgggtgaagatatatttcagactcttgtggtcagtgtagatatcgcaatggtttccaatcagatagtgtctccaaatctttagcgcatggaccacagctgcgagctctaggtcatgggtagggtagttttcctcgtggggtcgcaattgtcgcgacgcataggccacaacctttccgtcctgcatcagtactcctcctagtccttgccttgatgcatcacaatatataacaaagtctttcctgatgtcggaaagaactagaataggtgccgatgtcagcttctctttgagttgctcaaagctttcctggcactgttctgaccatacaaactacttttcctttttgagtagttgtgtcattggccgggctatctttgagaacccctcgataaaccttcggtagtatccggccaagcctagaaaactccgaatttcggtcaccgacttgggtgctttccatcccgtaacggcctctactttagcagggtccactgctactccaccggctaagattacgacctagaaaagcgacttccttcaacaagaattcacacttgctgaattttgcgtataacttgtgctttcgaagtttctggagtaccaatcgtaagtgctccacatgttcttcctcatctttggagtagatcagaatgtcatcgatgaataccaccacaaacttgtccaagtaatccatgaacactttgttcataagattcatgaagtatgctggggcattggttaaaccaaacgacatcactgtgaactcatacaatccatagcgtgttgaaaacgcggtcttgggtatatcctcggtcctaatttttagttggtggtatcctgatcgaaggtcgatctttgaaaacaccttagctcccttaagttgatcgaagagatacacaatccttggtagtggatacttgttcttgatagttacttcgttcaatgaacggtagtctacacacattctcatgctaccatctttcttcttaacgaatagcactggggctccccatggtgacgaactagggcatacaaaccctttttcttgtaactctcggatttgcttcataagttcctccaactcgttgactggcatccgatagggtctcttggatatgggagcagttccaggtaaatcttccggaaacacatcaggaaatcgttgctctaccggcattcctttcatgggtagcatggtgaatatgcctccggcacattcggccagtctaggatcttgatccatagttgttctcatatctgatccccagggggtggttaaggtcacttctctacgcctacagtcgattacccctctattctttgttaaccaatccatacccagtatgacatccagggtctgaggtattaagaccataagattggagggaaacaccacatccctaagacgaattggtacgtctatgcaagcatgattcacagttatctcgcccccaggtgagtgtactatcataggctttctaagtcccactagggttaggttgtgcttttgactagccttcagagatataaatgaatgcgatgcaccagaattgaagagaactttaaccggggtagaattgatagagaacatacccattagtacgccatgatcttcctaggcctcttcagctcggacatggttcacttgtccgtgcccaaatccagtagcggtcctgttagattgcggagtcttgaatagacctcgcccggcagcaggggtagcagtgccacgaacagtcattgcattcgcgccagtccggacaggagttttgcgtggatgtgggcagttgttagcgtagtgcccgtattccccgcagttgaagcagtccacattcttcttggctccaggggcaaccaaagttggtgtaggggtgcggttctgaattgcaaccggcctgttgaagttgctaggtgcagcgggacgattggtcgccacgatagggggcttccatccggatggagtggctcccttgagtcgctgaggcactgtctgaggtgggcgactcatagcaagcctcctcttgcggttgtgttccaccgtcctttgatcgttctccagcctaacgactttgttgatcaggctctggaagctctcatggtcttgcccaatcataggtccacgcaattcatcattcagcccttctatgaacttgtcgatcttttcctcttcatctgcgaggtctccaattgcatagcgggccaactgagtgaacttgttcagatattcctgcaccgttgtattcccttgtcgcagc

SEQ ID NO: 5019 - DNA, 1973 bp, Oryza sativa
  unsure (1)..(1973): unsure at all n locations
nnnnnnnnnnnnnnnnnnnnnnnnnnnnnnnnnnnnnnnnnnnnnnnnnnnnnnnnnnnnnnnnnnnnnnnnnncttcctaggcctcttcagctcggacatggttcacttgtccgtgcccaaatccagtagcggtcctgttagattgcggagtcttgaatagacctcgcccggcagcaggggtagcagtgccacgaacagtcattgcattcgcgccagtccggacaggagttttgcgtggatgtgggcagttgttagcgtagtgcccgtattccccgcagttgaagcagtccacattcttcttggctccaggggcaaccaaagttggtgtaggggtgcggttctgaattgcaaccggcctgttgaagttgctaggtgcagcgggacgattggtcgccacgatagggggcttccatccggatggagtggctcccttgagtcgctgaggcactgtctgaggtgggcgactcatagcaagcctcctcttgcggttgtgttccaccgtcctttgatcgttctccagcctaacgactttgttgatcaggctctggaagctctcatggtcttgcccaatcataggtccacgcaattcatcattcagcccttctatgaacttgtcgatcttttcttcttcatctgcgaggtctccaattgcatagcgggccaactgagtgaacttgttcagatattcctgcaccgttgtattcccttgtcgcagccttctaaactcgttcttcttcatgcgcatcactgcagcaggtacgaagttctcgcgaaacgctgcagtgaactcttcccaagtgggtttttcagcatcgtcttcccaagcttccttgtaagtatcccaccaatcaccagcgggaccctctagttggtttactgcgaagatcaccttgtcggcttcgcgtaccctgacaagagtcagtttcttttctatgatgcgtagccaatcttctgtttccatgggctcgtcggccgtagcgaacgtgggtggcttggtcctcatgaactctccaaagcttgaccctccacggttgccttggttgtttgcgatggcttgcagaagttgagtttgggtggccataactccggccagagtggttaggtcgggtgtctgtgtttcatcgttgctagttgatgcccgacgtcggcttgccatctgtgtaggttgattgattaagtatcctaattttctaaccgccttttacggctttatcccattaggggaaattgttttgatgtgaactttgttttgcaagcatggtggaataaactcatttataacacaacaacaataaatatcataaataacatcacagagtttcacaaatagtacataaatcatgatgtaatcgactgcatacatacgcagtccaaataaggttcatccaaaagatacatcgaactaatcatcaatctactcgtcaatctagatagggggggtgcatctcgcatgctatcccaaaaaaaacatctgtcgcgagatcgaaactgcaaggagtccgtcagtctagtcctccaaccatccgcaggatcccggggcaggtagagggtagtcgctggcacgggcaaacctgagtccccacggctcggaagtagtggcctctggatctggcttgggcttcttgctcgggggtcgggtgctcttgcgggcagtgctgagagtgcgggggcctccgaggaacgtgatgcggggaacgggtgtctcatcctccgaaggatcagtgatgtctggctcgatctctggcttggtatcggtcctctctgcctcggagtcaatctggatcggagtctccatactgtaacccagctgcggtgacgggacagtgaccaggggagtgtgtacaatctccggtgcaggtggctgggtcactgtagtgtccaccaggcagggtgctgactcagtagatgtcatgccaacctctcccagaagggcgtggaacgcgggtgggtatggcggggtgaggaagaagt

SEQ ID NO: 5020 - DNA, 2910 bp, Oryza sativa
  unsure (1)..(2910): unsure at all n locations
ctggcttggtatcggtcctctctgcctcggagtcaatctggatcggagtctccatactgtaacccagctgcggtgacgggacagtgaccaggggagtgtgtacaatctccggtgcaggtggctgggtcactgtagtgtccaccaggcagggtgctgactcagtagatgtcatgccaacctctcccagaagggcgtggaacgcgggtgggtatggcggggtgaggaagaagtagcagttatgccctgctgctgtggaagtagaagctcctggggtgctgatcgtggctgctcgaagctgctcctccagctggctgacgtgctcctgactctctctcagctgctcctcaagtgagtccatcatcccgcggcgatcgttgtactgatcagatagctgcttgaactggtcgccatggacctggagctatgccttcagtgagtctatctcactgccccaagtctgatgctcctcctctagctgaagctgctgcaccgagaggtcagtcaactcagtctccaactctcccatacgcctctggttgtcgtcaatctccaacagagcctcctcgtagaagtcatctactgcctcagcccatcgtgacagccgagtcaccatcgggttgtagcagcagggtgtgtcctgaactgtgcagactgagttgctctcctcccggaacgggtgatgattaaactcggtactcgctaactcagctcggtggatagagctgagtcggaggaaggcctcccgggctgcatcctgcatcgcggtctctggcaagtctcggcggtgacgtgtcggaaagctgtagtctaactccgaagaaactcgtgagtgaacctcgacccaagcctcccaaactgatccacactgtctcactcggaaggtcggaaatccggagtaccgcagacgcctcatcattcaatgcagctcaacgacatacccctctgagcggggtaagcccaactcccaggtagcgggtgaatcctgatctgccatctaagtttaagaaaaacccaaagtcagttgagagtaaaaactggttttgtgaagaaaatagttaagagtaaggtgtaaaatcgtataaagttttgtaaacatagcatttttatttttgaaagtgttgctaaataggaatttctcccttggccatcttaggaaaggggtggggcgcctttttggtctttcctacagtcgtatggctctgataccagctctgtggacccccgtttttataacaggaatcattcgtgtaaacagtaccatttccctggatcaagtagtctggtacacacgagttcatagctgaaataccagatgcacatacatgagagtctagtgctaattattacatcataagcccgcaggcattgtcttaaattatcggaccgagtggtccggaatacatccaaaagcagaaatagataaggcagcggaattaaggcagcggcatgccattgccacaggcaacgaccgtactaagacctactgagcaccatcgtcttcatctccctcctggtagtaggcatagggatcctccggagcttcatctcccgcttctgattaattttatatttgcaagggtgagtaccaaccgtactcagcaagccaccacatcaacaatgcatatgatagggtatttcaaaggatggctatggttttttttgcgcaaagcaaattttgtaattcttttcacaagcctaagacctagcattgactgatcaaactttagtaccagtgtttgtattaaaacaacgacggttctgtccaccatccattgtgatcccaaggatagctttccgccgttgagtcgttatggttttctgaggatgcccaccttcccccatctcaggaagtggctccaacagcataaaaattcatcatgcaataacccatcccacataagttaagaatttagagactagccaagagtaatacatgtcccggtgctcaataaccgcgagcacggctattcgaatagatttggtttactcacactgcagtggatgtacactttacccacactccgtgactgcccaacacatgagccttgtcttaacacatgagacacgtcacggcaaagcttttcgataacctcgcattggcagtacccgctccatgaacttttgcatcctcatgcactctaggcgtacaagtttctagcagtgtgaggagttctggtgctcccgggaaagagaagtctcacacatattaaattatggttcaagttaagttctctctctctcacacactcatgccagtcctaccaatggcgacaccgatgtagggcacgcctctcggccctaccttaacagctgtcccaccgtagcacacctgcctcactcaagggtgaaccatctatgcagggatactgcctccgctcggctatctaatccgctaggcctatacccatacgagaagtgcggttgtacgggggtcgtttcgtgcttaacttcatggctcggtccttaattgaccggggacggtactagccttttccagataccacccaaatcctccgtccgccccagtcgaaaacagttgtttaattttatttctcctttcacaaatcatgtcatcaacattatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaatatttaagggtaaacaataatcaaggcatggcataatcacaagtaggatgttcatcattgcatgtaattttatttgtaaacaaaacaatttcgcaattggnnnnnnnnnnnnnnnnnnnnnnnnnnnnnnnnnnnnnnnnnnnnnnnnnnnnnnnnnnnn

SEQ ID NO: 5021 - DNA, 974 bp, Oryza sativa
cataattgactagggactcatacgtatcatggttacaaggatttaaaggtgaacaataaacaaggcatggcataatcacaaataggatgttcatcattgcatgtaatcttatttgtaaacaagaattaatttcgcaattgggatcaacgtggtcaaagaatagtgatgacttgccttgctcaaggtcttgcgggtcttggccttcacccggatccgcggctcgctcggtctctatagttacgtgcgtaagaacaatttgaattcgattagaattcaaacaaaatccaaataatgaccgaattgaaaaacgagcgcgagaggtgaattctatatcggctattttattcgcgaagtggaatttttcctcctcctaagatgttttgcgtttcctaagaaattttgtggtttaaaattacgtcctagacttcatctaattatttagttcttaattatatctaaattactaccgcgaaattgattccttatggagatgactaagaattaatctataacaatctataagaattcatctaattatattttcattaatcctataattaaattctaatatttttaaatattttaaatctccccctaatttttcctttcttttctctccctctctcttttcttttcttttcttttctctctctctctcttttcttttcttttcttttcttttcttttcctctcctctctttcttttcctctttttcttttctttccctcccggcccctttctccctcggctccttctccctctctccctctttctgcctaccgagaccggctggggaaagggaaaaaggcggcggcggcacggcttaccggcggcaacggcaacggcggcagcgcatggcggctgcgacggcggcggggaactcggcacggcctaaaagggcgacggtggcgcggttgagatggggaggaggggggaaaattggggaaatgatgtggggaggtttggagatgaa

SEQ ID NO: 5022 - DNA, 10831 bp, Oryza sativa
  unsure (1)..(10831): unsure at all n locations
taannnnnnnnnnnnnnnnnnnnnnnnnnnnnnnnnnnnnnnnnnnnnnnnnnnnnnnnnttttgtacaaataaaggtcacttaatatttgtgttattcccactaatggatccacccttgattaattttacccatattttatttttatataattttcttgaatttaattagagttaattcttattccattacttttaaatttaattgatacaaatatggttgtaataatattttactcatttctatcctcgccaaatcttattttatattgcactttaattatttactttgtcaatttacttttagggtttgttcctaatcaattatccattattcgcgatttataaactccgaaatcaaatccaataaaataatcgaacaaaatcggcatgatgcaatttattcaaaaagtttttgaaggcccatatttttagagtttagatttttgtcggtccaatttttagggtgttacatccttccatcgccccacccttctctccggagagtcgcaagcttgtgtggtacttgtcatcacatgcatctctctcagccggcccctcccatcctcgagctcgtgcaaggcgcagcctccctccctatcccaccggcgcggtcgccgctgtggaggccatgattcttgcctccactgcatgatgggacccgacgtgatgtgctacctagcacactccatgtctccatgagtcgttatgtgaatagctttgggaatcaataaataaaaaataggtaaaataggttccacggcatcgaaagtttccaagtattaaagtgcaacggaacctttcgatggtgcaaaccaacattcgaaaactttcaatgacgtgaaaccaattttacaaaaagaaaagacaattattgttgtaggacactacaatttgtggttttaactctaggacacgtcaaaagtcgatctttaggggaagacactctcaaaatgtggttatttgttgatgggcaccgcatacactaaaatattaaattccgattgaataggagagataaacaacatgaaaggtcaaaaatgccccgggtcgacttgtcatattcttcccccacatctcactccctctcacactccagccgcaatagcacctccgctcgccaccggcgaccaccacggtcctcccacctcgcctctcctccacctccactgcagcggcgtgacccgtctcccttcaacatgcgcgtgcggcggcgtggcccagctccctcgcttggctacccggcgtgcgctaaggggcgaggcggcaagcattgtgcgcgcgtcatcaatgccgagggcctctacctccaccacggagccacgggcgatggagttggaggtggtggcgtgcggctgctcccctccatagacctgccttcaagcggcgctgccctgaccttagagcagagaaggtggaaggggagaaaagcgctggcagtttgggcggggggggggggggcgactgggggtaagggcaggagaacggcaccggtcagtgggtgaggggaggaaggagctggttgaggggatcagattgaatgagagatgggggcaatttggtcatgacgtgtcaaaaagtagacccgccctcgcctagtcagcactaaaatactaaataaatagttaggtgcggtgtccgctagcaaataaccaagattatagatagtcttctctttatgacacagaacatgtgtgaaacatagcacgagactctaaacaaatacattggatagtagcagataaaactcgatgcagaataacgtttgcattgttgacaaaatttggatattcttcagcccatgttgtcatcagacaaatgaactaccaacaagagcatagttacaagaccagaaatacagaaaaaaaaaagatggtggaatacaaggtttaagcttgcatgttcatcagatagtgtaagcagagataataacttggctagcatatacaaagggctcactcttgaaagaatttctgctccagaaaattctctatccctatcaccttttactcctgcacaaaacattcatccattgaattatgctggccaatctgagtaatagtaaactaaagaagtaataaatccccgttggacttcacactttgtatggtttcaagaaggttttgaaaaacgttatacctctagattgtgtaacatatgtgcaaatatatatatagatcctgttatcgtatataatattttttgtactaatagtaaatttcataatagcatcgtatatgtgtacgtaggatcatcgattcactaaaaaatactagcaaatttcatattgttccaccaaattctagtatacaaaacttctataaaaactcctgtggaataaaattgcaagaatatagagttacatggggaagcaccattagtgcagtggtggagccatgtataaaaaaactctatacatcaacattcaatcatagcattcttagctggtgcagagattaaaactaacttgtagttccattatataaaaatatagagctaacgacaatgtggtttgagtcatctgcccaacaaaatcctaggtcaaccaatgtttaccacgatcctagtagtgatatattattgtgcagaggaacaacaaaggaaactatgaaacaaatacctggtcatcgtcgtcgtcatcatcgtctcccttcttaaggcgggtagttccaccctctttgcatataggtattttcatgtgtccaaaaggagtattgacatcaatgtgcccctttatggtgtaaccagttccctttccccttatcatatcccacatagcagagccaaaatccttgggcctgaagctgattggtaaattcatggttgttacctcctgcttcttaatatttgtagtttctttcatctcagcagaagcaatgctcacattagagagccacacttcataatccatagaattcagtcccaggtcaaagtcatttttgttgtcaagattcaaatggagtgttgcggttgcttcctcaaaggagaactgctcaaacttgatcttactcacattaacgtctggtctgtaaggcactgggatctcaccatttttctccagaggtatagaaatccttccgatgaccgggatatctatatgaagcacaactctgatcttgtatggaatgatactcccaggcttgatgtccccatatgtactcttgatgtcatcataaataagtagcagagggattttcactgtctctgaaccatgagcatgtatggttccagaatcagggattgtcccagacatgagctttctctcttcgctttcgatcaagtattcgatgtcgacgagagggatcggcacggggtttgggttggtgatgagaacatcagcaatcagctctaccttctcaaggctgatgtgaggtatgtggatcccggtaacatcagcagtaggctttccaaagcttactgcatcttcaatcttttcaccaatgtcttgaatgaaatcctttaccttgtcgaagaaacctcccccctctccatcattattgtcgtcatggtccttgtcagctttcctttcggtcacttttgggctatccgaagatgacatgctgtgatacagattgaagagttaacatatcagatttcacaaacaatttcctgtcgaaaatgttcagaggtgaaatatgaacgacaaaactgacaagcgcaccaatggtaattggtaaaatattaaatacacagtaaaatgaaaacatcaacaagaatacaagattacataatcacaacaggaagcggtcaaaagatatacgaagttactatactgttgtatgaaacgacccatttgagctgatctcaaagaaatgttgtaattaaccctcagaaccagatgttcagcccggacattcgactatttcgaaatctatgatcatgtgaattcaagcatacacaaggtgcccccatcttaaatttgtatagcaaggatggacgtaaacaaaacaagcaagctccacctgatccaaggagactactaataaattaagatggcagccagcaaaatatttccatggaaacgtgagaggccaatgataatgagtttggaaaatcaacagtttccggctcctgcaggttattgtcaaattccagccttctcaatggagcttcacaaatcgaaatggatgcatgacggatgcaagtaaataaaaaataatacggagaaatcattgtccttaatcttagaatcctgccgctaagctctgtcgatcgagtacctcgcattgttctgacaaatcacaatgctgataaaaccgtgcatttataaacctacacaaactaatcccgtaatccccatcggccattgatgagaatggatcgcatttgttatcttctacatgcgtcttccttcgttttttccccttcttttttaccgttttataaacaaaagacaattgcgtcgacatctcctctatatgtgattctatcaaaaccagcaaataggaaaaaatggaacgaaacagaaaaataatttgatcttcagggcattcgaattcaagaagcagcgcactgcccagctcagcccagattctctctccccacgatcaagagaagagaaaagaaaatgacagcacgagcacatattggatcagatcatgatcatcagtacgctggatggaagaaaagcagctggactggattgatcgtcggtcggctacctgctagggtatcgacgacgacgatcgaagcgaaacggccgcgatcgagcagagcagaggaggggagaggagatgggcttcgcgtccgtcggtggaattgggatggagagcggaagcggaacgccattagcggcttaagcggcacctgcgcctgcggcgggctgatcggcctttaccaccgtaagaattttttttatttttattttttataaacctttttgattttttaattttaaaataaacattttaaaaagttattttcaagagctaaacattttgaggtcaagtgataaaacaatgttatttggctatacggtccggatggtatagaagctttgttttgttacgctgccctgaagccatgacaggactgtcacgctcgctgcgggtgatgttataatattgttttactgttttgtcacgtttgccgggatgatagggttaaaatgttgaaattttgaaaaataagttttggaaaggtttatttttaatttaaatttaaaagttaaaaataatgattagtcatgcttttctttttgtctttctaaactatcatcctcgttgtcaggttttgggtcattgggcttgaggccatttttgtcttctggatgggcttttccaggtccaaagtcatcatacgtgggtcgggctgaaatttttatcttaatgtaaaacctcctttttttttctcttgagatgaatataaaaaggtctgcctaatgtcatccaagtttaaaaaaaaatgtgattgcacttacattttcaaccgttggatgataacatgtatcgccatatcgcccctccagcgtatgttagaccgtccgtgaatgcaggcatgtttgtgttttgtgcaataaataaattattattgctttgtcagttgaaagaaaagcccaaattatctttttttacatttttattgggggtataatatgactgaaatttcagttatttcggtctaaactagtttgaaatttggaacaaaatatttgaataaatatttccaaattcacaaaagttatgaaaaaaatcaaaaaaatttggccaaaataatttcatatcggagagtacgatagacaaaattttcaaaattctgacatgaaagtttaaggagcaattgcttatttaccatgtttcgaaggataactactaatttgatcttgctatttctagtttgcttatttgaacctgcttttcaaaattgaaccaactgtttgaccgtatttacaatacaccattagtgttttatttaggaaaagaaaaaatctatttattatttcaactgacaaaaataccctccctttaaacttatccatctccctacctcacaaccgacattatatctctctcccccctctctcgctcttgcgtctctctcggtggctcagcacgagcagcggcgcaggtgcatggatcggcgacgcaggcgtgcagagggtgaaacagcagcggcagcggcactgacgcgcggaggaggggctggtagcaacggcaccggcgcggagggaggaggtgccagccgcgcatgtggcagcgcggagggaggaggggcggtggcgcgcatggccacctacgcctgctgttgcgccacgaagggagggaggtggcggtggctcaggcgcacgaaggtgaggcagttgcggcggtgacagtggcgacaacgctgacatgtggagggaggggacggcggcgccatggccgcctaccgctgcacctcggagctaacacggacgtggttcacgccgtcggtggcgaagccgtaggatcttgcaccaccgctcgaagccggtagagtttactttattgtgtcaaatttctatcaaattgattcgaatatatcaaatttggtgccaaattttgtttatttcgttttgccgaaaatctttcaaaattttcaaattgatttgattttagcagattgaagctaaatctatcaaacttgtgtcaaatgtgaaagatatgtcaagttcgttacaaatatatcaaaagatctgaacatatggccgtcttgatataacagggtcaaataaacaagggcaaaatataccatttacctcttagttaacattgttaagttgtcttaacagaatagagttagctttcatcttcgattttgaaaaatatgatcaaataagcaaactaaaaaaatataggatcaaattagtagataacattcaaaataggatgaaataagcaattccccttgaaccaggggtgaaaacggagcggatattatccggtccgatccgctccgaatccgtccgatgtgagaatatggtaaggatttttagatatccgaccggatgcggattttgtcatgcggatgcggatgcggatatggtatcaacgatatccgacggatacggattatccgatattttaatcggattattcgatatactatttggcggataatccgcaactttcagaccacacaacaactctatttagcacattttacatcgggcggcccatctagcccatctagtgtaacctaatccaatcctccccgaaatctctctctctctctctctctccgtgactcttctcttggccccttctcctgctcccacacgcgccgctacatggcgccataggtgtgccgcgccgccgccgctccttcttccagtccgccggcaatgtgttgtgtgctgtatgctgtatgcagtgtgatgtatggaactagtgtgttgcttactatatgcagtgtgctactgtgttgtgtggctgtgtgttgtatgcctgcattgtggtatgcctcattgccttgtgcttgtcgtactgatgagtgtgaagtactaaactactgcactgaacactatatttttaaattttaagcaatgcagtgaactgctgaactgaacacttatattatatttttgatggatgtgttatattaagcaaaattatattattgatatgttttagttggttttttctagagaactgagatcatgttcatatgttgttttgccatcgtattgcggctaattgtattgccgctctcttgttgtatggattgaatacaaacttgacatccgacaactttttatccgtttttgaactgagtccgcaccgaatccgacgtccgaaaaaatccgctccgcatccgtatccgcacgtcatccgcatccgtttaaaaaaaatggtttaggatatggtatagctattatccgtccgaatccgctctgttttcacccctatcttgaaccctggatctgctaacgtgctagagctttggtccgtccggagttgaagttctaatttaactggtaataaattttaataatttcagtccataataattatacagtagctaggaaagatattagtaattactacataaaaacgagcgtgtagcgtgcaatgggtaattttcacagatagcgtgtgtaacaaaagactatattcggatatcctatgttaacaaattggttatcctctcctcgcagttcgcttaaaaattgtctcagtttaagttaaattgataaataaatcatttagcgttacgttacggagtctcggttgggcttaaacaacaagcgagccttcgcacgccttcgttggccgatcgatctccccgtggacggacggagggacccacccatccacgtcgccgctattttcgcggcgcgcgcgccgccgatctccgatcaccggcggctgggtgcgagccccgcaaccgcaaggcgtccctgctgctactcccgcccgcatcctccctgcgcccaactccaatctcttctccgcctccaactccaggaggtcgctctcctcctcgctaatttcgcccgcctccgccgatttcctcggggggaggggagcagcggtaggtgccgtacgtctccggtgagctcccgtgccgacgcgcatcctctttctttcgatttcgccttagcctgtaataacatgtagatctggaacctaggtttttctctttttcttaatatatagaagtatatatatatataaaaaaaaaactgtgggttcaaccagaggtatccccatgcccacgttaggttcaaccctgttcgcagaatacgtggaaattttgtgtacagctgagattgttttgttctgaatatgagtagttattaccatttggttgttatttagataaattgtattccagcatattttgattattttctcttttcgtgttttactctttcagtaacttttgtgtggtagtaatttatgaccatggcgacctcgcgagaggttttcaagtatcaccctttgcctacaccgggagtggaaaacagttttaaggatgagatccaatccaaggttttgggcacgataggggatgtgatgaactcatttgatccaaagtcattcccacagcatgtagaaggagcactgggaacagctggaaacatcatcaattcctttgagtcaaaattggctgagcacaagcaatttgattttggtggcaaaaccaatttttatggctatgattgtgcggacgatggttggggatctgcacccttgaaggcagataagccggtaaaccttagaaatctgctgggtggtttaattgcaatcatcagtcgtggcggcaaaaattctgaaattcaaccgccaaaggacactaagtctagtgtcgcattcttagggtcaggtagcgatggagaaacattcttgcacgcctcagtctatgtgccaagtgctccaccattgcttgacgaagaagctctgaattacaatgtgtatagggttgtgattgaagcagaaccaccagaatggttacctgatagttatgctaactcatgcatgcaatgcgctgcttcttttactgttgttactcgtggaaggcatcattgtcgattttgtggagggatattttgtaggacatgctcaaaaggcagatgtctgttgccagccaagttccgtgagcggaatccgcaaagggtttgtgatgcttgttatgataggcttgatccgttgcagaacttattcattaattctattagcaatgccacacagactgcaaagcatgatgttatggattggactagtaccagggggtggttgaatttgcctattggattaacaatggaacatgagatttacaaggccgcaaattctgtgaggagctatagccaggtttgaggttactgattttgatttcttatcgcctccttacatatttaatcgccactctcatacatgtttaattgcaatatttaggatatacccctactaatgaatcatacaaattttaatgcagattgcaaggctaaaccccgaaaggtctattcctcatgcagtccttagtggagcaagtgggcttgctatcctgacagttgtaaaagctggtgcacttcttacatacaaacttggaactggcctagtagttgctcgaagatcagatggatcttggtcaccaccatcagcaatcgtttcagttgggttaggatggggagcacaggtattaactacattgctaatttcatctctgtctttgatatggacaatttgttgtccatcaatttatgaaatgcgttttttttgtgttgttacacttaatacagtttgcttaattgctctagctttccttgtggtgtagaaattatccacatgcattgcccattatttgtctttgggtaaaaaagtaatgtaatggacattttttgtatttcctgatggaaaatagtacagagtgtgcatgcctgcacaagagctcgtaatatttaagtgcttgttgtggcactcaatttacctttaggtaaaaatagtttttttttggatatgaacatcaggaggaaactgcttccttttgttgtgaatgttacgtgattactggcattaacaaacgaaattatgttttatgtttacttgatgagtaaaaatatgttaatatgatttcagccataattcaggaggtttcctaatatttactttttacatgttatactcttgtatgttgtattcttatgtttgatcatacaggttggtgctgagctaatggatttcatcatagtgcttcgtggtctggaagctgtcaggacttttagcagccagatgcatttttctgttggggcaggtttaagtgctgcagcagggcctgttggtagagtgctagaggctgacttgagagctggtgataaaggctcaggtgtttgttatacatatagctgcagcaaaggtaatctttccatctgatcg

SEQ ID NO: 5023 - DNA, 1452 bp, Oryza sativa
agttcttaagcctccctagttgcattgaagtcagtctctgtttctattggagtgtataaattcgtaggaagaaaatatgttgcgtcacatgcataggaaaatacatggatatgaagtcctctatatgacagctttgctgatttagatccatggaaatcatttaggtaaaaacctcgaaatttagtttaaggtggaacagaaatttcggtatatatagagattaatatgctggactttgaagatatggcttcaaaaagaaattatgttcccttgattgcagaaaccttttttctgatgcagtaaatgatgattatatatataatgcagtaaatgatgatgtgttgttaactcgtaatcttaacaagcgcttaacatcttagtgatgttctttttttttcggaagaagggcaggtgggccctcttaggctcttattaaagagaaggaataaaagcaaaagttctaccagtccaacatcttattgatgatcattttaaaaaaccctgaactttttataagcaaccttgcttcccacttttttttttctcaaatattccgaaatacaacgaaccatttcagaaacccagcatctttgtgtgttcttgttcctaatgtttcataatgaccatgcatggatgtgtggctataactattctttgtgtggttgattcgtgatgactctgcaggtgcattcattggtgtttcgttggaagggaacttcgttgcaacccgaagggacgcaaatctgcggttttacggcgacccgtatctgacaaccagcgatattctcatgggggatatgcagagaccaaatgctgccaagtttctgtacacagcgttggatggcctgtactctgggctgagtcgttaggacgatgtaaatctcaactgtacatatttgctctgattcttctggctgtaggcgtttttagctaggcttattgattcttctaagtgcttgccattgtagctaggtccactgctatcagtcaagttccagatggcaagtcaaaacctctatagtttacatgtaaatatatcttcctatgatacatacaccgcattgttcgaagtttatcatcggatatttgtggtggtatgcaactatagaagctgttacatgttactgtatcatggatcatcgaatttaaactaaacttagcacttacatctgtttgtgttagatgggctgcatttaggtaaccagtccagcccaaaactgattccgctctgacccaagtgcaaagcgatgccaataggaataagttcatttaggtccctcgtcttaacatggagtcttataacgcctctcaaccataatactagatataacatgtcaacttgcaaaaccggtccactcaacgatcggtctctacctagcatgcttgtggccccgagaggattatgaggtggactatgaatcttgcgcggggggcgggggggggggggggggg

SEQ ID NO: 5024 - DNA, 649 bp, Oryza sativa
aaaaaccaacttgcatagtaagccttgataattggggaaaatccaaataactggcctttatactcccctcttcaactcactgttgcgaaaaaggtccccacaatttcaatttctcttccatcttcgctagttttttttttgccgggtcggccgaaagattggccgaccaaattttattaagatttagggagtttattacatggttcattcacgacattagattgtcgagtttggggtggctgaacaccctaaaaaaaccaatacaaggaactaaacaaagagagagaggctactcctcgcgcgcttgaaaaatgcctgctgacttccaaatggagatttcttccttcacattaccaaccagctactctgctactttgaatttgtgctaaaaaaactcttccattccgttctttccaaatgaactaacaaaccataagaagactgtatcaaccgccttccggtaactcacccggaaaaaggcgcgtgcatgctgccaccactccgctagcaaaaggttatcatggtttggcggatgaaagaacaaatttatccagtcccgtagcaaggaccacactctattggtgtagaagcatttggtaaaaagatggttgcagtcctcaaattcagcatgatatagcgagcaggtcgg

SEQ ID NO: 5025 - DNA, 1608 bp, Oryza sativa
  unsure (1)..(1608): unsure at all n locations
tttgtgagcttccacaatactgcatcttccacactccttagtccttactgagtttgcatgccctgcagctcatccctaagggagaaattttccactaccgccctgttagatagtgcatctcaaatgtccctcacccatctgtgattgatcagtccttgttccacagtcaacctagttccgtcgacataactaaagagaacactggtggagaaaccctttgtagtcccggttcgtaacccccctttagtcccggtttccaaaccgggagtaccaatccgggactaaagatcgctatctttagtcccgggtgaaataaccgggagtaaagatggctcagccacgtggccggctgagccatctttagtcccggttggtgttaccaaccgggactaaagatcgagctgacctttttttttttttttgcatggccctgttgctgcatggtttatatatatatatatatatatatatataaaccatgcatatatatgtttcaatacatatatatgcatacatatatatatgtatatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggattaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctgtccatttgccgcggaccaaatgagggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcatacgggaatccaatttggtatgtaggaagacannnnnnnnnnnnnnnnnnnnnnnnnnnnnnnnnnnnnnnnnnnnnnnnnnnnnnnnnnnnnnnnnnnnnnnn

SEQ ID NO: 5026 - DNA, 828 bp, Oryza sativa
tcgagctcggtacccattctcttctttgttagctgcccgtcaacttctcctggatcgtcccgtcgaatcttgtatcgttttgctttgcaaacagggcatgcttctagggtctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtactcctttggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgag

SEQ ID NO: 5027 - DNA, 739 bp, Oryza sativa
  unsure (1)..(739): unsure at all n locations
nnnnnnnnnnnnnnnnnnnnnnnnnnnnnnnnnnnnnnnnnnnnnnnnnnnnnnnnnnatgtcgacaccacttcctacgccttgctagatatatagtaccgtattgttggcttttagctgtattattttttttgtcggtcactccttgcatgtcgtgtgcatccttagatgatgttagctggtaggttggaaataacattttgtaatgctcacataattttgtttaatttgtcaaataatgcaactgtatctatttttttcattcaaaactacaactaactaacattttatgaggctcacaattaaacttttgcttattttttgaaataatgcaaatgatttgattttttttatccaaaaatataactaactaacagtttatagtgctcacactattcaatgtttaggtgttaaaattgaagatgacagtgaaaccgagagtgacaatgaagatgagaaggcaaatgagaaggctaaggctaaggccaaggctagagctgtgtatcaacaaaataaaggtatccaagaaaattattggtgatgctagctggcaaatgtcatggtacctttttatttttattttaaacatgtttcttgtgattgcattcctatggtcaataattgtggcggatgatcaatatcggaaccatttgaaccgtgatggttccaatctaattcaggttcatttatttttttaataaatgatttaatagtgcttatatatttttggtggtatcct

SEQ ID NO: 5028 - DNA, 8689 bp, Oryza sativa
  unsure (1)..(8689): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaatttagttcccaaatagactggtgcaagggtcttcaaatgcttatccatgatcctagaaaagatttagataggtgtccatgaattatcatcagggtcaattaattatcatcaggtcaattataaaacaacttatttttaaaagaacaaattatgtcctacttgcaacggtaaaattcacggtggtagaaatggcagatgaccttttcgctgccagtgacctctcctaggaagtccccttcagttatctccctatattcaccatgaccttgcctttttagcacttcacgcttctcgacctctttctgttatgcacaggaaaatgaataacttaaaatgaagattatccacacaggttcacaaccttcaagggcaatgtgcagatcagtaccttcagagcagcaattctctccgcatgcaacttctcaagctctggatcctatagttgtagttccacagcatgatagataaaaaggtaatcagtgcttcaaactgaaggaaaaaaaacaagagaaatatagaagatactatagttaaactcacatccaataattcatcaagatcaacctcatcatggcttgcatttgctgcttgggctttctctttagctacaatttcctaacatgttaactatgtcagtatacaggaaaaaaaacaaaaggggacagagagagtagtattagcctgttttgaaagcaagtttgtttttaaaaaatgcaagaggttcaaagcactggaacaagagtgtaaaaatacagtatttcacccccattataacaaggacataaatgaaaatgacccaaacaataagagaagatatagctcgccaatcatatcaaaaggagtgaagaatcaagtataaataatggaaacgagtgatgtgcgtggaggacagttatatccttttgtactatactttcgatgcaaacccccaacagtttgttgctgtcaatatacagaaaggccattttgatagaaaaatgaatacctacaaattttacataacatgaattcatgagagagcaaaaggcatcagaaggtaatccattttcaacatacataagttaagaacacccgaatggagaatgatccactgcaactttgattattgcaaacttgcaaaccatattccaatctaaccacatttataggctgcctaaatgggaggagcacccttgtttttgtgtaccctgaggtgccataaagcattatctcctatccagcatagaatatactggtctctagaccctgcaccatcactctatttgttgtcctggaatacatgactggagctaatccatcctccgaatgaactgtcccccaccccaatgttcccagccaaagattggatcatgctacagcaacaccaggacagagcagtctggaaggcaagacttttcacgtgagctaacaccactcccatagccaaatgcccaaatccaatgcacctgccctttctcaagacaaaaaatcacactgttgtgttaccaggatcatcctccacgttgatctatggttataccttccacaatccatgcctgtggcaaagctgagtggaggcaaatcagacacaagttctaaagataggtgtaccagactacaattcactcccaatcaaaaaccaagatttgatcacgcgctggttccgagatccaggagcacactggctccacggccaccaaccagccaatttcacgacccaacccgctggatcagttttttacccccattacaacaaggacataaaatgcagttgacacaaataagcagagaagattataacttgcaaatcacattgcaaggagtgaagaatcaagtgtgtgcatgaaggacagttataccttcctctacactttgatgcaaacaccacattttgttgctgtaaatctaggaagaatatcaaaaggattacctgcaaatgttacatgacatgcattcgtggcctaagaaggtaacccattttgaacatgtaaaagaacggccagatgtatcatgatccactccaactctttgttattctaaacttccaaaatattatactcaaattgatccatgtttattggctacacgtgagaagcgccattgtttttgtgtacactgaggtgtcataaagcagcatactcctattcagcatggaatacactggtcttcaaaccctgcaacatcaacacaggactggagctaacccatcccctttatgaactaaacctccccatgatcccaaccaaataccagatcaagctaataccacccaattgctaaatgcccaaatacatgtgcctgccctttcccaagacgagaaattcgcattgtcgtgttaccagatcatcttccccgttacctctaccttccacaatccatggctgcaggcctgcagcacagctgagccgagtgctccgcggccgaatcaaccgcccgtcaaccccactcccaatcaagaaccgagattcgattcccccccgctggtgccgagatccatccagcagcacgcccggctccgacaccaacctccacagccaattccgcgagtgagtgagagaagtcaccttctggtagtcgcgggcggcggcggccatgacgttgccgaaggccaggttggagagcgtcgacttcaccgcgtcgggatccatctctccctctcggcgctcgcctcgctgctactccctccgctacgctccgccgcgccttcttcttccccctccgcaaccgcggcgagcgccgccgcttctgctcggccgccgagatctcctcccctccggctccggttcaggtggcgccgcgagagaaagagcgaagtggtgcgtgttgcgttgcgggtgcaggtgaaatcaaagcccgatgggccaaattctttcaaactgttccagctttttttaaaaaaagtatttttctttcaaactacgtatatattgactaacctttcataaaactataaatataaatttaagatgatgtatcgtgatttattgttaaaactgtagttttgtgatatatcattttaaatttatagttttacgataatttaatcaaagtatattttaaatatttagttccgcgataatttaattagttttgtgaagttaattatctttttttcggttatcttttttttaagcaccacttaaaaagttgcggtattggtaccacactttgaagactactgactgagtagaaatttcctctattctggtttaaaaggcgcattcttggtttttctggtaccaattcaaattcaaatacagttttaccgtattgtcatctggtttaaaaggagaattatttgtctacgtttctactcaagctgtcaccaaccaaagtatcaaacacagagcatcaggtattcaggcatccctaccagacaaaactcattgcaaggtttcctaataccagaagcacatattttcccttgttcagatcaccaacctaacatgcacaagaaatgagctcatcgaaataaaactgtgaaaccattcatcgtataaaaatcaaatgctgttgtcatttttcagataggtattcccttgttacaatgtacaaaaaaagacaaacgatattgttgtgcatttggctgcttaaaaaccgaaacgcctgcttcaccgcttaatttgtatcatctcctgtacagctggatagtgccgcaagtcctaaattaaggtcatcattggtataatcatgggctacagattatagaagccccagagacttcagctgttggacatgctccgaagggagagggggcggacaccaatccgcgcgctcgccatcgacatcttccacaacatattcctgtaagaaccagatacagcttaagtgcagaaggaaataaactaaagtcaaagactgagaaataagcggcaaacagaactcaccttagttaacattcgttttgcaagaatatggtagtgtctctgccagatccgctgacccaccatggttgctaccaagacgctgtagaaaatgccgataactgtgaatagtccaagcacgattactcccatgataaagagcaatggtaaccctgcttctccagcaccacccaagcaaccaccacactctccagctgtcgttgcacagccctcaaagcatgtagtgcaatctgtccacatgcaaagcgtaccaggtagatggcaatctgcacacatcctgaaacagaaaagaacaatgagcagtgctgatgaaacaagcatgcagcattagtagcttgttaatacaattgctaaattagttgaagcataccctggttggcagcaacaaagacataactctcgacaaggctgtgccaggtcattccgtactcttcggtcataacaagttatgaagcatcctgataacccaagcaaagcaaaaaatagcaatgcccctgtaaccataagaacaatactcaaatttagtccagattaaactaatatgcgcaagagaaggtacggtgaatcttatagcgagtcttcccacagatttagtgagtatatatgaattttccacataatatctattatcacaattggcaaatcttagttcctcataatataagtaacagagcccaatgaattcacgcagtagggagaatacgacatgcatatcatatatccacttctttacatacttggctatgatacagatgaatatcctagcttgcccaattctccgttcgtttgtgatgaaaggggcagattatccctcggtttccgttagcacgcttttcaaacaactaaatggtgtgcttcgtgtgaaaactttctatatagaagttgctgtaaaatattcgataaaatccatttttcaagtttaaaataattaaaattcaattaatcatgtattaatggctttcttggtttgcgtgcccatacttaatcttcatctttatcacttgtgaacacctcattaacaaagaaagttcaacaactcaaccatgtaacgaacatgtgttcctgattaatccagccatgtgagctacactcaggtagtttggttgatataattggcatttatttattgagccgaacaaagttaatttattggcatttatttattgagccgaacaaagttaactagatgtctataaaactgttcattgcgatgtttcagcaagagctcagaattaatcaaactgaaggcattaatgtaaaaatgggtgaaatgagcagctcatgtcaggagtttcttgttagttatagggttatagcaaattagaagcagaggtgcttggtttcgaaggacacatgcctcgaataagtcacaagcaaactataacatattcaagtgacaacaattaccatgcattaaacagggaaaagtagcttgctctttcctattcgatacatatatcattcactctcatatcacatttctacacttaaattcctttttacaagcccatctcacccatcatacatgaaacaagattgagccattgaggttcatcgtgtacgcactgcacatttaaccttgtaaaacctacagcgcccatgtgattgagttatatggatgcatggtgaactatcatgataattatttcaatcagggtacaatttcatcaaacaatcatgcaaaactaagtgcaagaaataacaagtttgatatgataaagtaatttaccacatatgtaataaaaactaacttcattgtcaaatgcccaggctgtcctcaaccagtaattctgtaatccatcaataaaatgcaccaaatacgctaatgcagatatgacctgaacaaataaataacaaaaaacaaactcttttatcattcattagaataaagacaatcgagaactaacaaagagtatctagagggacttacaaactgcactagagcaaagatgaataatatatctctagtaacgaagaaacgaaatttcaatgttcgccatttcctatcagtgtgaacatgaaccctcaaatagtaaggagctttacaagtggtgcaatgcgaaaaggcaaatccttcctgtacatgagacaaagaaaatgccaagcaaagttagttttcttacgaaacaaagcttagcaaaataacattgacctgccaatttttgtgcaattaaaatatgtatcttgaaagcgtaaatgttgacaaaggcaactctggatactctacgttatgaagaatcatagcttaaattgtagcaaatcgcacctaaactacattttaggcacagcattcatataacgctaaaattagttatcacaacaaatgaggtttaaacatggtatcttatctaccaagaatgccacaaccccccaacttctctcagcgcacagcaaacagcagctcccccaatttattaacagctaacgtgcaaccaatgaaatgggcgggagatcagcggggaggcccgagggatcaaaagcttcataccttcacggctctccagtggtcgaggcagtcgcggtggacgtacttggacgtccccttgcacttgcacggcgcgatgaaatccctccctgcacacacccacacacacacgcaccgagccaacaaagcactcagatccccctcgcacgataaggtcgcgcctcgcgggcggaagggggggtggatctgcgcgtaccgtcggtctcgaggcagatccggcactggaactggtccccggccccggcctcgatgtcgatctccgacggcggtgggatcagcggcgacgactccgacgccgacgacgccgccccccgcgccggctgctcccccatcgacgatccaccgcagcctgcccccgcgcttttacaaccttcctcctcctcccatccgaaaccctagctcctcctcctcctcgcctcgatcgatcgaatcgaagccgacgacgacgagtcgagggagaggttggcggttgttaggtgcggtggtggactagcgaggagcgagcgaggtatagattggtcgagaacttttgccacgcgacggtggcgtacgcgcggtatgatgacgcgtgggggnncggtggttatnttggtttggagtaactncgntnngnntgnntgnntnggtagtcgtacgtgcgggtgagagttgaccagagaggcttcgttgtgattgcgcgtgcggttaatgtttttgctcttttgcgaacggggacttcagtgactgcgtatcaacctctcgcgacacctagttcgcgcggattcgcgagtagaatatgtagcgcgcacttttttggttattatacggtacaccagtggagcagcctcattccgactcctgggcattcagcccaccaacgcgcgcccctgctacagtgctacgacattcgtgccgcaaattacgacaattagcgttaattaccatcattagcattagtctttaaaaagcatatatagttaatttagtcgaaaacttttcaaaaatagtggaaagttttaaatttgaagtggaaaggtttcgaaatttgatttaaaagttttaaattttaagttgaaagttttgaatttcaaataagaagttttcaattttgagatgaaaattatgaattttgagttgaaagttattgaaatttgagctgaaagatttcaaaatttgagttgaaagttttaaattttgagttgaaagtttttgaatttttagatgaaagtttcaaattttgagttgaaagttttcaaatcttgacttcaaagtttttaatatgatttaaaaatttttaaatataagttgaaagtttttaaattagtgttgaaagtttcaaattttgggtcgattttttaaaaatcattgaaatccttgaattatgtaaaatcattgaatgcagattacggcctaattattctggaaaaaatcagcactaatctcgctaatctgaaaaaaaaaaccacgcatcacctttttttcttctggtttccggcttttacttataataacggtagcgctgcgctgtgtgagcgacacgtgtacgtgcgtgccgctaactcatctggcgcgtacgcgctaattagttttcctgtcaaaagtttgcgatgtttttttgtttgagggggtgtttagatataagggtgtaaaatttttactgtcacttcggatattatatagggtgttctatgagatattcgggcactaataaaaaaaccaattacagaatccgtcagtaaaacgtgagataaatttattaagcataattaatccgtcattagcaaatgtttactacagcactacattgtcaaattatggaacaattaggcttaaaagattcatctcgcaaattagtcgcaatctgtgcaattaggtttttaagtctatattcaatacttcatgcatgtgtttaaacattcgatgtgatagggtgaaaaattttggggtgaaatataaacagggcctaaaatgcgaatcaacatgaatctcgtgaaaaaaagtgaatgatcatacttgaaactctactgtgttagatcaataagacataggctctgtttggatcctc

SEQ ID NO: 5029 - DNA, 31406 bp, Oryza sativa
cggtcaaacatgtgctaaaaagtcaacggtgtcaaacatttcgaaacggagggagtagtttgtatgtcatattgaccttgcatagttaaggtctcgagtatatctccactgaaatagtcagatggcaacaacattacagaaggtcactcactggataacaaagttatcattgatgatcaatgtgcgatcaatgccctttaggacgcctttcccaatgatttggaactatctctttagccctttttaacatttctcatgatcggattataagttacgggttttatgagtggtttgttgtgagaatagtcacttcacacgtatggtttgttattatcttttatgttcgtgttgatccaatcttggttggttgcatgcatatagagcatttacagatacacatttactatttgctcaaataaaaatagagacagtttagtagaggatgattatttcggaaaaacatcacgttgattatagatgatgactttgttatccagcgagtaaagaatcaatctgtatgcatgtaaactattaaataaactataaaataaagacattattaatagtttgtttccaatacttgtatagaatttgaaagaaaaatgtaagaaaatgctacttactagtctcacttgcatccttaccaacatccatcgatccatccacgagcaccaaggtaatcgcgtcgtcagtacgtcacgtacgcggcggccggctaggatatgaccaaggggttgatcacttccccgtagtactgtcagattagttgctattcttcgatccgcatgagctattctagaagcttcaaaacactgcaatctcgatcgaaagtcgtcctttcgaggtaagcaaaaagcaacttaaattagcttttgtaaacaaaaggctttatatacaatccagtccgtgcaaagcaacttaaattatcttgaaataagccaaacggtatatttataaacgaaaagtaatttgtaaatataacttttatatacgcgcttttagcgatctaaaagcaaaaactaaaaaataaacttcagcgtaaaaaccacaaaatcagtttcaatttaaaggttgaaaatttaaatttagctgataaatataaacgaaaagatggagcccatctctactcgtcagtggtatcacttgattaattaggggtttaaccattggtttcctcgttgaagctgttgcggtacaaaatcaagacgtgctacaggatatgaccgggcgttgcgccgttgccgtcgccagcgcgcatcgtcgcatctccggcaacccgggaatcgatcgatcagctcgtcgcgtctccaaccataatactcctcgtcaaaatctctattctctagtggagcttggcgtatcgatgcgtttgtgcgaggcagagtgcgcgtcggggaaactattttaacgtacgttctttgcatgtcacttaaatggttataaaaaaatttgaaaaaaattgggaaggtgtattaacatatgatataacactccacaaacatgcaagttcaaattcaacgtctacatctcgtaacgaaaaaacaaattgaaccgcagctagttaacgtatattcagagtcaaatttgtttttttcgttgcgagatgtagaagttaaatttttacttgcatgtttgtggagtgatatatcacatattaatacatcttcttaattttttttaaattttttcataaccatttaattgacatgcaaacaacgaggggatattccctcgaggatcaaaatcctcttccgtgcgcgtcgtcgtctgcaccgcggacggcgcaggtggccatgctgcagggagaggctgggctcgacgtggccccgtgccggcgcgcgcccttgcagttgccggctgtgcgtggcactgtatgcaccggagcgcgcgacgctggggcgtccacttcgcgttcggacacgcggttgacatgctcgagagacgagacccggggccgttcgttcgatctgctcggcctcgcccggcgccgccgacgaggcgaggcaaaacgatggtcacgatcgacgcagcgatctcataggctgcactgcagggagcttgcgggtctcgacgtggccgtgcgcgctctcagctgtgctggtgcaaagagcacgacgcgcgcatgcagtagtgccacaccatagagcgcggaggcggtggtggactggtgggtggtcgatcgcacagtggcacaacacttaagtaggatggcaattttacccagggtcccgatatccgcggatacccggctcaatgggcatgggtatgggtgtaatattttgcctatgggcatacccgcccgagacccgagaacatagcgggcagcatccgagtattgttttttacccgcagataacccatgcccaacctaatacatatgtatttgctaattttggcccatctcttattcctcgtacccttttctcttagcccatttgacccactaaccaaggacatatatatactcaactaatagaaaccctaacctaattccccaccctcttctcctaccccaatccccatggcggctggcggcggctgcgcggctgccggtggcggcggcagcggcgcaggctagcgacaatgcagtggtggctggcggcgcacagcgcaggcggcggtgcacggccaagcaggcccgatgggtactcatcgggcatgcccgtgcttgacgggcatgggcacgggcataggattttgcccgatagaccttgcaggcatgagtcaggcacgggcacgtgggtcttgggtcgggcatggaatcgctttacctatgcccgatccgacccgttgccatccctagggctgtattcggcacccgttcttcccaacctctcttccttatttttcgcgcgcacgcttttcaaattgctaaacggtgcgttttttgcaaaaaagtttatatacgaaagttgcttttaaaaaatcaaattaatcaatttttttaaaaaagctaatacttaattaatcatacgctaatgaactgttccgttttccgtacgcactgttaactttgggaaccaggctgtccgaacacagccttaatcaacaacgttttcatggtagagtttgagtttgacgtccacaagctgaaggtcgtcgtgtcgggctcgaaccacatgatgatctggccactagctcactacgcatggcacccgctgctatggtgggccaattgagttctttttaggttattgctagaccggatatccgtttccgtgtctacgtccaacaaaaacagatttattatattcgtatttgcataaaaaaagatacgaattttaaaaaaaaactcatgtatgtttccgtatccgttttgggctaccctaagcccaataaaataaaaggaaaagcctaagcgcagcccaataggaattcagcgccgcatcaggtgattcattgcagcgccgatcatctgaattctctccgctctcgccacctccctctcatcggcggccgcctcttcttcccgctccgctggtcatggaaactcctggaccggagccgaaggcggcgacgacggtggaggtttccgatgaggaggaagtgaaggcgatcgctgcagatgcgggatccgtcaccggggaggggaagcgtctcgacgcggcggcggcggcgacggcctccactgcaggtggagacggcggcgaggaggagaagcctcctgtcatggtgcagatgcctctgaacaccatcgccgccatcctctcactgaagagggagccgaggccgatgcccgaggacctggcgcgtctctcgccggaagagcgcgacgagcgcctggcgttcttcgattcatgggaggaggtcaacgacgagttcgaggagttccagaaggagatcctccgcgaggtgaaggagactggccgctacatggtccaccagagctacttcacggagcaggcggagatgcaggctcgtatggagaaagaatgggccgagatcgactggaccggcgtcaaattcggcgactgggactacgacgaccccacttgctgtcaaccactgtgatttcaggctcgcccgctaactgagatgctgcagaggactacttctttactgtatcttacccaaatggtctcaagccagcttagcttttgagtactgcctcacccttagctactaaattactagctctctgtcgggtagtagtatcagttatctatggtgtttgctaggtagtaatgtcttgtgtgatttgaccgacccttataaggaagaccatgtggcttatgctatgaatgaattactttaatagtagtaagtctgttattattaagtttctgctggtattaggctcgataatattctttcttggagttcctttgtgatgctctatgtgattattactgtgctaactctatctgtgatttactactttactaactctaacccttggttaataagggggcataccagtgctctgtgattagtggtaattttggtatttagtttttgttattctttgagactgcttccaagagagcgcaaaaccctcctctaaactaaattttgggaattaagtctgaaatcatataccaaatccccttcctcgacggtcgccctgcacacttcactaggtgaatgatctgcttctctgttctgcatctatacgaactgtgatggatgagttgttgccaaacagaactgttggtacttctttggaaaatatgctgttgaacttgtcttgaaaatggtacagcatgtttgttgtaattttgcacatggttggacatatagcacatgtgatgtttgaaagcagcatctttttggcagtcaaactgccatgtgtgtagcttagctttacaaattgcaagaaacatagcaacctgaacttctagaagacttttgccaatgcctctacaatcagatttatatccgtgttcattttcttcatctgcaaataaaccaagcaataacagagtttttagatgtacattaattgagctgcaataatagagttgttagtcgttttatggcataaggtagagatagcaaaagtcgaagtactaagaaatcaaaatctgcgtgaaaacataccctatagaagtcttcaactttggaaatcattatgatccagattactatagctgaaaagcatttgtccaagtgataatctatacctagttgatgatgccaatatcatttttggttgtgctttcatggcaggtctaattttggacagcagacataattttgtctgtgcagatctctatccagtttatttgtttgtggattataaagcgagcactacattgttttgtatcacctaaaaatttatttgattttaccatgctaattatgccctcagtccaagtgtgataatctgttgacctagtttatgacttgttcatgttaagattatatatgtattagtgtgtatgtgttaaggggtatttctgtcttttcacgttgtattcatctcatattagccctaagggccaactcaatgaataaatagttaaatccccaattcactcactgattttgacatggtatcagagcagagatcctaaccctagcctcaatccgacgtcctccccggtgcgccggcggcggacgccgccgccggcagccacaccatcaagccgtcagctctgtcaagatgcattagcttctcgtcatcgtctcattcatcttcaagtagcagccagtagcagcagccagcagcagatcgtctagacattgactacctcatcccatcgccagtcgcggccgccgtatcctctgccggcgggcaaaccgtcgtcgtcggccgtcgcagcctcgccgcctcaatcactggtctcgtcctttcatcaccactcgcagtattcgtcaagcaaaccaacagcagcagccctgctttcgtcgtcttcaagcagcaaatcattaagaagcagcagccattgagctagttgcagacttgcagcagcatgtgtcagcagcagcaagtcatcttgatccatttcatcctcaagcagctgaggaaactcctctgctttcttctacattctcaccaaatctaagtggatctgttgcatttaggcttcagtttgagcctctgcttgttgtcctggaactccattttgtgcactatcatcaacatcctttgtttcctatcctatattttgctagtatcagattgccatgctataagcttgattgctcatcatcattttgtgcactgctagctccttgatttatacctaatatcagttggcacaagttctaaaacctcccgcatcatgcttctatcatgtgctgcaacacatcaacagcataaaccagtggattacttgggatatttctaattgaaattggcttcttgattagtagatgatcttcaacctttagttcgaaatggttctcttccattgatatgccatgatttggatgaagcatctagggtctcagtctcacagtcctacccacaaagagtagtgttgatttgttagcctctaatcgtattccatcaacagatctacttatttcttctacatttgctatgtttgcttgctgctgccatcaacaattctactaatctccttaggcctattgatatactatgttgtcatatttcctttacaatccttttgagtccatccaagtccaatacacaacgattcgttgaagcgtgctaatctatcttcatcactagttccccactggagctggtttatcacaccacatcatctgcattgtcaactccccatcggagttatcatctccaacttcaccagctccatatcggagttggacatcgttatcagtcaaggaccgaagaacaatttgtaaaggtccattatcatcaccatcaacatctctagatctacaaaggtctgaagaacagtttgtgaaggaccttcatcctcttcatcatcatatccacatctccgaatcagtgattggccgaagaacggttcgtgaaggctttaaggtaccaaaggagctgaagaacagtttgtgaaggctccaagatcctcttcattgaggaagggatggatttccatcttcatcatcattctagagttgcacgattcgacaacatcttcaagcatggactgtggatttattctagtgtgtcattaatctatatttagtttcaaatgcaatgttacatatacattgcatttgagtaggggtgttaagaatatatatgtattagtgtgtatgtgttaaggggtatttctgtcttttcacgttgtagtcatctcatattagccctaagggccaactcaatgaataaatagttaaatccccaattcactcactgattttgacagttcattcatcaaatttgagctgcatccttttactgaaaaaagtgtttactggactattgatagacttgatgtttcgaggttcagagactattaatttggttccctgataatgtctcaagagttttgtgtacgtactattgatgatggaaggagaaggatacttcactaactcgttgaatgagggaagcattatagattttggcaaagtaggtgtgttcattgtctgttatagtcaacatggttagccaagggctacatgagccaaatctgtgtatgtgggtgaaagaagaaaagaaatactgtccaagtgctatgtgagccaaatctatgtatgtgggtgaaagaagaaaataaatacaggaatcatttatattcattcgaagatatttgattctgtaacttcctgacaagagtttctttattgcattttctttgtctagcttttaccttgagttttattgtgtgcaagcatgtgaagccaactacctccaagattcagatgttgtatccgctcgtttccaggtaaattgttattatttcctgcaggcaactagttctgcacatacatttgttttgttctatgatatacaattttctctcttccggtttctacagaaagatgcctatggatcttgggagcggtatctttggtaaccgcagtctggttgtgaacttgtgaagtgaacgtcgtgaattcttgtggcaacctctttttaccttcattctgtcactcggcttgggaatagatatgctatcttgcgacctgcatttccactgctactgtgttatttcttgcataccttttaaactttcatcaaatgatctttcaaaatatttgggtttgcctgatgttttaaaggattctgtttaaatcccttttagttgaatgtatttatgaacccagtaataaagatgtttttacttgcattttacagtatttccctatatgtcacaaacttagagatggcttagcttctaccaaagaagatacctcacctggcacatctggtaaaagatcttgaagttaactttggatttccccataaatatcttgttagttcacatgcatttttctacactgtaccgtagcattccagtgccgttttatgtgcacgttactatggattagaaggacctgtatcttcacgaaattctgcttttctcccctggtttcaaccaacatgcagaaccgtcacacgacaggccaactacggtctaacgctgggggctcgctctgtcttcttctgtataaatcatgcttgtttacggtttacataatatctcatatttacatctgcttgttgtatcctgataatcctagaagatccatgcagtttttcgaatacatactcgatattatctgctatatgtcttgccttctagaaaatatctttcaggaacaattgagcactcgagtagaatgtagtcgagtacgccgcattatcgagaacgatctcgacaaatgcagagccgtcgcgcccaacctgccaacgaagaccgacgacctatctcatagcaccggccatcgctgggctactcgagagaaggttgttaacggataattcctcgcgaacgtcgtcggcttgatcacctgacatgattgcgaacggacatccgggtatgctataagttgggtacgcgagtcatgctggccacatgagatacacttgcaacaaaccaactctagcgcttccatcggtgttcgagagataattctgctcgctcactggttctcgcaccaggacgtagcaatctctcacaccacagcttccatcggtgttcgagagataattctgctcgctcactggttctcacaccaggacgtagcaatctctcacaccgcagcttccatcagtgttcgagagataattctgctcgctcactggttctcgcaccaggacgtagcaatctctcacaccgcagcttccatcggtgttcgagagataattctgctcactcactggttctcgcaccaggacgtagcaatctctcacaccgcagcttccatcggtgttcgagagataattctgctcgctcactggttctcgcaccagcacgtagcaatctctcacaccttaacttcaagtggttgagttacgactactatctggttctcgaccagccgtgtagcgatactcccactacttcgacttctagtggtcgagttacgactactatctggttctcgaccagcaatgtagcgtttctcccactactttcactttaagtggtcgagttacgactactgcctggtcctcgaccagcgatgtagcgtttctcccactatttccacttcaagtggtcgagttacaactactgcctggtcctcgaccagcgatgtagcgtttctcccactatttccacttcaagtggtcgagttacgactactgcctggtcctcaaccagcgatgtagcatttctcccactatttccacttctagtggtcgagttatgactactacttggtcctccaccagcggtgtagcgactctcctactacctctactccagcaaagttggtatcaggtacataatattgccaagtgttttacccagagatcccttacaacgacgacacctagcgttgaaacctgtcctactgttcctttacgccgtgctgacaaggcctccgaggaacataagtgatcttcggctggggacgcccatagccgataaggccttgtcggattctgtagagacgaaagaccatgtaagacctggtcgtgtaaaagttctccccgtgcggattaaccaagccgtgtaatcggaaactgagctttccaacttcatggctgggggctaggattagtgcttattcaaccaaggcaggtcaagggtccaagagccttctcctccgaaaacgattctccaacgacaaggctggggcctagggagagtgtataactcaataaactgactggtcgaagtcggtaaaagagaagacgctcatacacaaaacattggtcggtaaatttaattcattcttaatttaccatacatattataacatgtcaccctttgagcgttcgctcgggggctatttctatttgatattcttttctgagtattgatttcaggaaaatgctgctcgacattgttgaagactccatgtctctatggttctacaccaagatcgactaaggcgagtacgaccaatgttgacaaggctccgtcgtagactctacgccttctcgatcgctcgagaacggttgctggatctcgacaaggaatacggaatgaagaaatggtgtacccgccgagataaaatttcctgacttcaatccaaattctctattacggcaagacgggaggcttagtcgtacgctctgtactttctcggtcgacaccagagattggcttagacaaaccctttcggtgcccgcacgaggctgataaaagaagtctaacgttatccctaaactcaccgagaacggtcacgtgagctcgataacagttactccatggtcagcggtcgagaatatgaattcgttcatttgcattgaagtcgggggctattgtcagggttatgaataccacatacctaatagtagttgactaaatctcagcagggcccaccacataccatgtcttatacggaaactgacttcgagggagttccggataaggaaagacaaccaaagttctacatggaaacgataaggactactcggattgtatccatattggcttccctagttctacttggacaaggggacacctatgagtataaatacaagcccccctgggaggacagggggatgactgaccatgatatgagacgatcaacacgatcaacatgatcacacggtcaccacgatcgagatccacctcaatcagcaaccaccacaatatacggaacaacagaagccaatacaagctaacatacgccaagacacgccgctggatatcgacttcagggataggcatggctattcccctacggtgtctccggataccgtcaggagatacgaaagtgctatctctgatctcgctgggcacggattcgaggaggaagactaccttgttgtcgactacgagtcagaccttcagaccgacatgtcgacaacagttagataggctacccacatattgtactggtgtgattatggtgaataaaagcaactccggctccggccaacaggatgtagggttattaactgacaactcaggggcctgaacctgtataaaaatccttgtctccgtctcttttacctaagtctcgcgtatatcctagcaccaacgaaccccatactgtctaaataccgtagtcgagacatcaaatgtcgacacatatatattctaaaattaatttcttttctttgtgtatttatattttaaaatcaatatgtttatatgatacttgtgttagagttagatatcattgagtgattagagaactaccttaagtgctaatgatcatcacatttgatgatatgtcttttctcaatcatttatctataaaattattctcgatatgtttttgcaaatgcgatttgagtagagatcagtacgctacgtgggagaagcaattgactcacccgacaaactaaggatgagaattgaacaaagagtaagtatgctacatgggagcagcaaccgaatgagactcaaccattataatagacttgggggctagagttaagttggggcatgcatcgagcagtaggtgaccacaagaattggatgtttgccacttactttagatcaaggcaatcaacacattatttcagccatctgtcattactatttactgacttatttttcttttttttaagaattacacagtataacgtagacactcataacgcacacacaatcttatttgaaacactagaaattccaaaatcttgaaaaagaagttgaccaataaacctttccagaggaagcagttgaaggtcagattccctgagcatgggagaagcggtggaactgtgtaaacaataaggaaactcctatttggatgcatggaaaggtcagctttggcggggtgctttgcaaaatttcttgatttcaatcaaaagctgatactaaattttagacacttggttttacaatttgttttaggggttaattcgtaacttttgttgtgtaactctctctcatgacaacgtatgatactcaaattctgtaccctaatgatctgtatagatgccctcaattccgtctttctttggtatcatctctacaacttgttcaacaatggaactgtgatagtgtagagagaagcacactactcaaatttgtttttgggatggagagaccacaaggaggcaaaagtacttgtggaacctacatattatcagcaacaacaacaacaaaaacactaaaatggtttaaaccgaaaaataaaaatgtactcctaaaaagtagtgtaccggtgactaccatattacaacaggtaagaaagacgtcacaacagtaatcacacattctatttttatgtacccatagttcttggttctagcagaaactctcccgtgtcgtcctcccccacgggcgacacgggaggtggaaactgccggcgtcgcccgctcctcccccctcctccctctgccgcctcgccgccgcccgagcggccgccggcaaagccgcgcggctgcaaggacggcagcggcggggcttcaccctcgtcttcgtctccctctcccgtcgcggtggggggccgcgcgcgggacggcgaaaaccgcccagatccgggctgccgcggccggatctggcggggaggccgccggcggcgggtcagtgtgaggtggcggcggcagttggtggtggtggcggcggggattgaaggtggcggggtggcggcggtagttggtggcggctggcaccgaggaaggcgacgacggtggcgagggagatggcgacggtgacggggatggcatgcgtgctggcggcgtgctgcttctcttgctgggggcgtcggcggcggggttggagatggcggcagggatggaggtggcggcgaggctagcgacggaggccggatctggcggcgaggctggcatcggcggccggatccaggcgctggattttgccacggatctggcgcccacggcctcgcctgggcggctgggggcggtcgcggcagctagtgcggtcgagacggcagcggagagctcggcgacggtgttggggtggctgcgttggcggtgacggcggtttgcgacaattgctgctggcgtcggtggctggtgatagcggcatcggcgacggcggccgacttgcagcggccgtgattgagaagacggtggcaacgttgaaggatgcggcagtggaggcggggaaggagttgggtgtgaggtgacggcggcgacggtgaggtgatggtgaccgtgacggtggtgggaggaggcatggcggcctcggacggcttgccgagggcgtggtagatggctgcatcggccggcgcagcatcatttggaggaggggtcggagaccggctggacgcagagtggcatagccgatggtagcggaggccggctcggcgcgagaggcgtgggcggcggagatggaggctagcttggcacgagaggcgcagcctatggagggaggctggatcggcgcgagaggcgcatccggtggaggaggccggcttggcgcgagaggcgcgaccggcggtggaagaggcgacctcggtgcgtggtggagctgccggtgggtgtggcgcggtcttcggcgcacgaaggctggctggcgaggggcgtcggtgcaggggccccacatgtcggcagagtttgagtggtggtggagcatcggtgcatcagccgtagattcgtaggtggtgagcggcgggtgaaaacccagcccggcgttggccggaccgacaacgatggttaattctccctcctgagggcgttgtcgtgttgtctcacccctcaagggtgattgccgggcgaaagcccagtcttggctcctttgagccctgatggacggcggtggcggttttccgtcgcttctcttcttgaagacatcgttttggcaccctccttgctgtagggcgatctcgtctgtgttcttttgttggtctagcggcggccggtcacgcttagtgacggccggtctggtgctaaccttctcctggccgtagtgggtggtggtatatttttttcctttctcctggttatgaccctccagggttgtaatcttgtatttttttcctgctctatcaatagaacttcgcaccgtctcgtgcgagtcgttaaaaaaagttcttggttctgcacttctgcttaatggatgagtggacatataagcatgcttttctcaaacttttatatatgaatttcttagaatatatattttttttaaaaaatcataatagttaattcatacgtttgtacccttgaataattatcacaaatcatttttctactcggtcattcagtcattggcacaaaagaacacataagcggccaaaactgcaaccccaggacagagcatatttactacagtttcatgtttgctatgagctcaaactcaggacataaaagaacagtcaaactatgaaagaaaacaaatatttgctgaatcttggaaggttggcaatctgctacaagctatggcggatctgagagcacaattccaattaaaaactgagattgaacttccaacaaaaccacttcaggtccaagaataatctgctgctactaatggctaccagggacaccaattgcagtctatatcattcttgattgattcactatcatgcaaaaacacatcttccaaatggttcagcgttattttctcaagtaaaaaggctaaacaaatgagaaaacagagcacagctgcatatattagattcattcagttggtggagagaaaatgttaacacaagatggtaaaagaccctgaaggacacaactgctaaaatctaaggaataagaacattgccccattgttacgcttattcatatgcttatttgaatcgcttattagcaaataaacgatcatttgtgaataaaacttttacatatgtttagaggtgaagatttctggttttgcggttaacggtcataaaaaaaatctcgctgttaaattgagggacctccggtgaacttattccatatccgcgcctacgtggagtcaacaaatcccatgttgggcccagcccaggcccagtttgtttggaggcctggagcgagagagttcgagtcggatccctaccgtctcccacaaatccccaagacccccaactatagatggccatgtgggccgcccggcacggcacggcccaggcccggccgtgcctgggccgaggcttgtcgggccggcacggcccgaccgacgcaccgggccgtgccgtgccagcccacgtgccgcactcacagcccaggcacggcccaacacgcctcgggccatgccgggccggcccgaaggcacgatgggccatcgtgcttttcctcagaataagtctaaattttctccctcctattgggctgtgacattgtatagctaaaaaaagtctattttacctccctcttctttgtgatgtggtatataaatagctaaaataagtctatttaaggtccctattctttagacattgacatttatatgtctatttttagtccctatactttgtgtaccgggtctggcccgaacgtgccgggccagcccagcgtgctggtggggaggcccaggcacggcccgacagtcgggccgggccggcacgggcccgacccaagtcgggccgtgccgtgcttgggccgggccaaaaaggcgtgccgtgggccgggccttcgggcctcgggccttatggccaactatacccccaaccgataaagaggtatatatatatatatatatatatatatatatagagagagagagagagatcttctggcgattccagatggccggtgctgctgttccgcgcatcaccgagttcatggcggaggcggcgcttgaggagggtaccacgacggagaccgcggtggtggtggagcgcgcgagtaagctgggcggcggcggcggcaaggcggaagcggcgcctccgcttaaggagcgcgacgcaaacaagaagagggagaaggcgactggctctgctcaggttgtcaacgccgagtccgccgtcgccgtcgccgccgcgggtggagaaggcgaccagaagcgtaaggtgcccatgcctgagaatttcgtcgccatgatcctggcactgaagaggagccatggccgaccttcgagtacctggactccctctcgcttgagaagcgcagtgaggaattgaagagtgctgaacgccgctccaagctggacgacgacttggagaagctccagaaggatgtccgtgacggcatcgacaaggatggctactatctggtcgatgagagttacctcgctgagtcggccgcctgcaaggctcagatagacgaactatgggccaagatcgactgggatctctacaactttggggactgggactacgatgacccagaatacgttgtgtacctgtgatgatggtgatttctagctcaaatgacaatggtggacaaggactgaccggcctttggggaattcagttagcccttacctatctatctaagctatctctatcagttagttagtagtatcaaccagttaatatctatcatgtatctatttatctctctcagcaagtatcatgtttagttgatgacgtttgttaggtaatgcctatctatgttattcggcactctacctatggagactatgtgatatatatcttatggatgaattgcgtatggtagcaactctactattattaaattcttgtcgcattggctttcatgtggttctaatgcttggctgtggagctgtcagtcagggatgtgatatataatgctctctttctccttgtgtgtgtgatagtcagtttctttattcctctgtccaggtaactaaggctgtttgatgctaaaagactagcactactagttaattttgtttggtgatgaaaattgctactcgtgctactctttaaaattgcaggcctatgatttgtttgtgacaaactgatggtaccttttgattctgttatgtaaactctgtcttttgagtgtgtttctattaaatttgtttgcaactggggtgtttaatttgtttagttgttgtgatcttgtacaattttcgtgttcgagcttaagttatgcctctctatggcccatcttgcagcccttgtgtatatatttatttctatcaagtcagtatcagttatgtctacccttttaattgatgatgtttgttcggtaatgcctatcaatgttatactaccgaccctttgtataactattcttgaaaaatcttatgagctggtgtggttgtttatatataaattcgagaatttgccactcaatagtagtatcggaagattttccaccatatatctcactgatgtgtgtcccgattccacatgttatagagtatagacatataagaaactgtatttttttcttcattgtccaatgtgtccttcaattggatttgcttacagcaaattgcattgtgtgctggtcatttggtgcatctgcttttcttagttgcactgatactaaagaatgttttctgtccatgaccactcttcagctcttcctttttaaggaagaaagcaatttgataaaatggctgaatgaaatatgttttgttcgatgttacattatcagaataagccaaataactagatggtatgataattttcatagcaactgtttgaataactatatcttcagtgttgaagttatgtgttgccgtggggaatatttttcttgcatttggttttttgttctgttctaatccaactgtagctgaacttcttgacaatgtagcagacgaggtttgtagtaccttatggaaacttcatttgttttcatgcattcatattaatcttagagctgctgttgtgtctgatggaggaggaattggtcctacctaaaggggtaaggcgatggatcagtctaggattcgcaatcaagaaatcaaagataaccagtgtaagtctcatcttgttttcctagcaaaatttgaagacctttaccaatctgtgagggatttcaaatagaagcttattgagtactaaatttctatatttctttttgagaattgtgtattctgtaccttaatgagagtctactaaattaagaaagcaaacctgcagaaagatgacatgatgataatggataattttgttacctttgctatagtgttttaaattatttcccctgtattgtttatgatatgatactgaactgttttcattcgatatagggcatgacaacgagaattaaatgcagtccttttttgtactagcatgcattgacaaactatggtgtaagaaatacaaaagatattattgaggcaagtctgatggtaggctggcagcttgaacatgtgtaagatatatagttatatataattctctgaaatgaaagatgaattgatccctaatgagtaaatatattttggagatcttcaaatgtaaatctgtgtagtgtatactgttttataggctctgttccttacaaaatggaaatatcctttacttgtatcaccaactttgcagttatatatatgcaatttcgtctgggcattgtgtgtgcaattaatcttataaaactgtcatggagtgttttagttcaaatatttgtaacattttttcttttagtatgtaggtgccttatgctttaattttgtgtcaaaacacttcttaatcactgttcactgactgttagttgtttattttgcacttttctctacagcacagattgaaatggctttaagacgagcacaatgagacttcgtgctgatgcaatagtgttggcttgcgcaatttttttcattttaatcattgtttatcttttttctgaacaattcatggcaatttaaacttctgcagctatcagcaattatcacacagttcttaacagatgattatttttacagtttgcttgtaagctcaaggcttgcttcccttcctaccattttggaatccaattgataattgagaggcatatggtctagagtctagacaggacagtgttggtgccagcatgccaccatcgaggccaagttttttttttttgaattaatcaccggggggggggggggggattccccacctgaattatattgaaaagaggaagaggggtacatcaggaagcattacaacattagctagagcgaatagaggaagaaagaagacttttccagttggtcacaaccgacctatcttctctactgaggcgctcagcccacaatgtagcgtcctcaatacatttagccactaacctcgtccgggagttagggagcctccggaaaacaatgtcgtgtctatggttccaaagtccccagaaacaaagtaagaaaaaaacttggaaatgcttgacaggcaagtggcagggagcagcgaggtcagcgagatcatgaacattcaaaacaacagatatacgcaaagctctctagaattcttgagcgaattggcattgaagaaagatatgagtcacactttcatcagcacagttgcagacaatgcacccagctgttggaacaatgttcttcttgtgcagattagccttggtagggagccgatccttagctagtagccaggcgaagaattgaactctcagaggagcttgattgtcccagatgaagcgccggttcttgcacagagggatgcccaattgagtagaagaatagatacactttgtgtgaaggatctcgggagcatcacgcgacgtacgtaagagttattgaggtagaagttttgtagcatctctcgcaattgtgataattgggtttcagcagtggaggacagcccgggggggggggggagagattacgtaaatcgaggccaagcttcaaacaacataaggttaaggtatgaacctacaccatattttcagcttcagaagagatccaattatattatcttttctcttttggtggtccatctttgatttaaattgtcaagtggggcagccaagacgaaattaattagtttttatctcgattacatgtgtaaaccatggcaccatgtattcaccctttctatattgaacgcttgattgatctgaaagattggctagatttgttatgttggtttgttggtttcttgggactttgtagcaaaggagtggtgttatagtgctcatccatgggtggaccatggacgatgggcagcaagcctgagagtcaggtaaaggagttggcaggaagctcagagaaagactgtcgtcaagaggttacaggccatcatacccagcttgcttctttgcttagattatggtactataattgatttggcttccatatgtggccacatgatcgcacacaataggctcatcttctattcttttttaatactggtgcaagaaaccatataatttctctctctcttttttactccagtcatcgtagtgcctccattgttttagttcttgcaatatccaggtgaccaaaatttttccttcttttttaagacagttttcctgaaatttagtagagtttcagaaccactaacactgaactttgtatggaaacaaatgttaattatttttggagtagtatgatgttagaatttcttatagttttacgtttacctccaatcacatggttgcagaatcatggtatcagccatttcatcattgatattagaaaaatccatgtgtagtatcattgggtatttagaaagttcctccaatttttggctgtaaaaatgttttactatacataatatttgttgtcctctgcagttcagattgttttggcactacgtttcaaggatggattaaacatcccaagcatctcaatctgtggttgtacaatccttcagaccacataaccaccggttgtctaattttctggataatagcatgttggatggctattttgctgtgttggacggacaaacagattattcaaatgtgcattcagtaccgtgaatgtaacaattaggtacctgatcattccagaaaaagaatgtctatatagagcatctttttttgttgaacaattactccctccgtcctaaaaaaataaaccatggattttggtgtccaactttgactgtccgtcttatatgaaatttttttataattcgtatttttattgttgttagatgataaaacatgattaatattttatgcgtgacttgtctttttaatttttttcataattttttcaaataagacggacggtcaaatgttggacacggaaaccagggtttgtctttttttgggacggagggagtacgtatctatctgatcattccaggtacaaaaaatgcttcatcctcgggcagacaactgatgtgatctcgaattctaggcagcaggtgcacgctctatgcttctatcctagggccttgacctttgaataaaaggaatgcagatcctctgcctcaccttggcaccagaattgacttggcagcctttgtctccactatcaggtaaggagtagtatttcccctttatctactttgatcatcactatttcttctttagtttctccattaactttcagttcaaatatactacatgtcatcttccaatatcagacgtaattcattgagtccgaacaatgcatattaaatttcaaaattgaattcatactcgaatggccagcatttaactttgcttgtaatgaacataatggttcagtttgtcagctataaaaatagattgccgtaaaaataccagtggtcaattggagcattctgtcatatccattatcagttgtgcagctacgaaaatatgcgtgcagctgaccattgcagcctataaaagtaaagcggaggtgaatactttggtgatggcaatatgattatgcgtatgtgattcttaatttattttatatggtttattctctgaaataagagggagaaaatgctgatttatgacagtgtgacaatgtgaatgctaattttatgtgctatgaacaaattacggataccaagtccatatgctatagaatttcagagttatgatgctacctatacataggtttgttggactgcaagtggtcaattgcagcattctgtcatccattatcagttgtgcagctactaaaatatgtgtgcagctgaccattgcagcctataaaagtaaagcggaggggaatactatgggaaaactaaaatactctctcttgcagtccaaaccactcatgtacctatttctggtgaagtgagagaccaaagtttatttcactcaagtaaaccaagttctatcccacaaatgcatatacttaattatgtgctttcttctgattaagagatcctcaagctcattttactcaggtaaaccatgggccgggagtttaagcaaacacatctaagtcatgtgcctttttctggtggagctagagaacatcaaattcaagttagaccaagggcaatgtcctccagcagttcaaacaaacacttctactcatagtagttcaaacaaacacttctactcatagtagttcaaacaaacacttctactcatgtgagctattctggttgagttacagaacaactttctcaggcaaaccaagtatgaaatttttcctgatacatatgattatgattactgtttgcttatggaaaaataatttaatagtgtatgatttagtcggtatatatgagaaccgagaatttattttattttataatttatgtcggtattatggaattaagatggtttattgccttttccttagcatggttatagtgcctttagtttagcccaccaacttttgcatcctttaatgtccttcctgatcttgtgatgtcttttacttttctgtgcccaattttcagcttgccctgaggcggcaccggtgagttttgtgtgtcagcctcaggcattggttaaccgatgaaaacttttttttttttggtatttggatcgactatttctttctgcagcattatccaacatggagtgctcaattgcatcgatgcagatcctatagtttcacttatccttatgcttatctatacggcttattgaaaaaaaaattatgggtaaaacttttataaacaatattgtaaaataaaacttgatgaaaaaaaatacaaaatcaactttaaaattaagttttaaaatttaaattttgacttgtaaacataatcataagcggaataataaggctggaagtggctagaagagctggaattccaaaaataaatattatctacctgaattctgttggcaatttttttgaagaactgaaaaacactacatgaattctttaaggcattttggatgtcttatccaatatgtttcttacgcataatgtgatttcataagaaaatttttgttcatcatcttctttctttcttttttagaaactccatcattttcttttggcataaaaatttgagttacataaattttgatggtttatcttttttttgaagcgggcaaagcccactgacaaagatccactacatggtccagtaaccttttagcaaagatcgctcatcggcctattacatgatccaatagcgcgttagaaaatgactgagcctgacaacctcttctaaaaaaggaaaaagtacatcgaaggtcctcaacttgtcatcgagttaaaaaacatcccccaatcacaaaaccagatatagaacatcccttaacttacaaaattgttcactttaggtccttcggtggttttgaccccggttttatccgacgtgacggctaaaacagcgtgggacccatgtgggccccacatcagggtgtccacgtaagcacccctctctttcccctcttctctcccttcctcccatctctctctctctcactcacttttctgctctctagcagctgactggcgggtgggtagggcgccagtgacgcaggagaaggcgggagagcgaagaggacagggggagaaccagatgtatagaaattctgatcttttttaactactccgtatatataaaaaaagtatcatatattttcttagttttggatttagagtagccgctagtctgctatccattctgatcatcctggtaaaagaatcatccaatacatttcacatacaggttctcatggtcttctgtcaaacaaaaaaaaatcacatggtcgaattacaattcacacagtcatatttaagcaggataagctgtgtaatcgaggaaagagaaaaaaaaacaggtcgatcttgttcattatatagccatgatatgattttggcaaatcaatcaccttgactacattggtcaaacacagacaagaatgaaaattccatcacaaaccagcacaataatatgagaccaacaaatctctttattattataaataatattacttaatcgatatatatcacagtgatttgaaccagtatatataaatcatttgcagctttgtctaactcagctttccaacagtagactgtcaatcacaatcatcacagcgagcgatagcaattggggtcgtcgaagtcctcccagtcggcgaagacgatgtcgccccagtcgatcttggcccatccttccttgagctgagcctggatctcggcctctcctcgacctcgcggcggacctccgcctggaactcctcgaagctgtcgcccaactcgttgcaggtggcagccatctcctcacgcatcttgcggtgctccggcgagagcatctccccgtcgtctgggagagggaagggcctcttcttccatgccaggatgtagtccacgtactcctgcggcatgggcagcttcacagacggctgctgctgcttctcgtcaccgccgtctccgtccacggtggtcgccgccaccgccgcgtcgtcggcacagtccactccggtgacaacttcagctgctgcggtggcggcggcaggcgtgttctctgcctcgtcggaagctgccgccttcttcgtcgcagaagcgtccatattttgcgcgtttgtcggtgatcgatcgagcggaatgctgctgctaatcggcaacgacgacatcgtcttcgttttcttgttgcctcgttcctgagcccctctcgatatatatagtgccgctgcgttcggagtcgatcgatcgggagtgggagtacgacaacccggattggtgcacatccctttgattgatttattgagagggtggtggttttatctaggctttattatcctacttcagtaatatatgaggcttattcttgtgtattaattagtaccctggatcggttggtacagtatgacttttattagctagcgatgcctatctttgtgagttattagacccctatggagacacttctgttttatcactgagaatcctttctatgtggtgacttatcttctgatctaaagttgcttttttgttggcttttgattggtacatgtggcgccccttcgatctttagagaaaaaatcattaatttatacaagacaaaaaaatgcttacaaatcatttgtgatatttttttcacaagaaaaaaaaatacacaagtatgagtaactagacattcgtgatctagtggtggaaaaggtgattgacagggaaaaaaaaagtaccaaacccgtcacttatggcttgtttagttggcaaaaaaattttgcccctgcatatcacatcagatatacggacacatatttaatgtattaaatgtagtctaataacaaaataaattacagatttcatcagaaaactatgagacgaatttattaagcctaattaatctgtcattagcaaatatttactgtagcaccacattgtcaaatcatggtgcaattaggcttaaaagatttgtctcgcaatttcctgacgaactgtgtaattgtttttttttcatattaatacttcatatatgtatccaaacatttgatgtgacaacgcgaaaaaatttgtttgagaactaaacatgcccttactccatccgtcctaaaatataaggcacttccgatcaaactccaacgtgatgggtaagaacagagatgcatgctagctattagccaacctgccttctccagccagtaggcaagatactagcctattttacttcagtgcgaaatgtaaatcacaattcacaacagctaattgagttacacgctgcaggttgtagcatcagctaccaacacaaattgcaactgcgtactaatacatcaactgaccagagatatattgccctgactagcctgacattattgaaaagcaacaaaacacacatcgatactaacatgtacagctatgaatgatacacaacttaaattgtagaaacaagcagctaacagcaatactttgaatggttttcagaagctagtggtcgtaagagtggtcaccatcaccatgcaatctgtaatagtaaaggctccctttaaacttctaactttttggtcacatcaaatgctcacacatgcatgaagtattaaatatggacgaaaaaaaccaattgcacagttttcatataaattgcgagacgaatcttttgagcctaattataccatgatttgacaatgtggtgctacagtaaacatttgctaatgacggattaattaggcttaataaacatctgctttaatttgggtttagtctatgttattagtctacgtttaatattttaaatgtgtgtccgtatacgtaaaacaaattttggaaaggaactaaacacggcctaatacttattgccaagttttcatctcttggctgttcttgtctgctgttataagctgatgcagtgacagctcccctcctcattttctctttgctgcaacatgctaggatggaatttgtcaacaaaaagggtgcaaatattttcgaaaaaaaaaggggtgcaaatagcaataggcaacattatattgctaggaacaagcagtaattactgattaccttaggagctatatttagatctcgatttcaacttcaatttccactgttccaaaaaaaaacttcaatttccactatctcgctttcgatctatgcctattattcctctgttcctctcacctctcttcgatctccacgggcagcggctggcgggcacaggcgagcagtgcgcaggcgggcacaggcggcgggcgacgggcggcaggggggaggagctgtgcaggcggtgggcggcggaacggtgcacgggcgggcaccggcggcgggggaagcagcggcacgggcggcgccgctccactgccttctctatcctcctcgagctcatcctctctcgcccctgcccctgccaccgccgacagggagaacagctcactgccgctggcgagatcgaggacaaagtgagccattgctctatcaccgacttcctccctatccgctggccgtcctgcccagacaagagtgagagagagagaggaggaagggagagaaccggcggggcggagcggcggaaatccaccgacggcgcccccaactccctgcgccattatcatagcgcctcctccaccgagctccactctcgtccgcctttttttccacgactgattctgtcacgccccgaactagtcctgagcggaactagcccgtgacgctccaaattaacctgttaatcgataccagtcccaggaaacagtgctggtatcacaggaagacagaatatcatagcaacagaggtctctttattatagagtaggagtacggtcatgttgggctgcggacagatcccgagctcacaactacattacaaaagggaagcggaagccaagacttggaccaaacatcacaggcgcgacttgggaactaggccgaaaccctaaaactcatcgtagccggcttgctcctggaggaactcctcgtcaacgggttccgcttcatcttcttctacaacttgggggggaattatttatataaagcaagggtgagtacgggagtactcagcaagccatgggaaataagtgtttaatgcaggcttcaaggaaaggctgttgtttttacaattgattttatttgaactcctttctgaaacaactaagtgagtgcttctcaaacgacacggatgagacagtgcgtctcgtctggtcggagtaagtgcaatgtatcagtcttttgaattgatcaagattggcacccggccaacagctttcaaacggccacccgggcctggctgatcccatcagccgcagattttccaaatatcaaacctattccacaacagcaaatttcacaaggcagtagtcaagcaaaactacgctaggaatcacctcacatccgcccatgactgtgggcacggctgttcgaacagtttaataacctctgcagagggggttcactttacccacacgatattactaacccggatcatccagcccgtgcagaacagccacgactagagaccttaaggctttcatgacaaggcatttcgaaagccgacacaggttcaccatatgccaacaagaggggtcccagaccaacaccagattaggtcccagaccatactatgccaggaagcccaggggtcctccccgacaccaccccggcgaatccacatgtctcttggcatcatggctcccccgattagctagttactcagtcaggggtgtcccattccacccatgtggtcgtacttgtcttatgttcggatgaaattccaaggaaacggtccttaagtgcaagagcgggaaaccgtacacccggtacgttcctcggtccgcgattttggaaattcatttaggttcgcaagcaccgacccaggagtcgggttttccaagtgttttgtaaaacccaagttttacccaagatgtttctcagattttaagtttgaaggcgaccgtcgatactcgtgctgagtgcacggtttccgaggtgcaactaggtggttactagggaacatggtataacaattacaatggaagggtcaaatgcaacaaattaggtaggtccgccaatctgccttgcagacgggacaagcagattaagtacgatcctatcaatgcataatattttccaagcaacataattaagttcaaatataggctcaagatgttcaaaggtggcttgccttgctcgagatcttgagcttgatcgtcgaaatcctcgcactgcgggtcttcgggctccgaaactatacgcgaaatgggacaactcagcaaacggcgaaaataaagccctattattgacctctaagcgtgccattatatagatctcgagatttgaagaattttgaaagttgaatggagtcaaacggtcttacggttgggaagatattaaatttctaagattattgtatttttggtctaaaggaaaaggatttatttaaatcctttttgaaaaagaaaagaaaagaaaagaaggagggagggaaattagacttcccttgggcggctagggcgcggcccgagagaaaggggcggctcggccgagcttaatgggccggccggcccgagaaggcggcccaaggcgcgcgcgcgggcggggaggggagagagagagccggtgggctggatccatcccgcgtggtcccgggtgggacccgcttgtcggtgactcggttcaccgtgagcgaggtgcacgcggggcgtgctagggtttggggaggggaggcccggcgcatgcgcgcggtttgcggaggacgcggtgcggtgggcccacgcgcagcctcacggctcgcggtggaccgcgcgcgcgagggagggggaaacgaagggagcggctggccgggtcacccgatccggtcgcggccgaggtggcgccgacgtggcgcctacgtggctgccacgcgggccgtcggaaggtacaccataacgctggccggaacggacgacggacgacaccagcgagcggcggagcgaaccacggcgatacaggcgaaggcgagcacaccgggatgttgcacaggacgaggggagacgagccaacggctcggattcgccgaggaatgctcgacggtggcggattgcggtggcggcaaccggcgacgagagaagggggaaacggcgacggcgcgacgagagaccgattcgggagagctagagcatctacgcgactccgggagtccgttgctagcgtcggattgggcggagctaccccgagcgaggccggcgacgagcgggtgctacggagcacgggcggcgacggcggcgagcacacagcgggcggcggcaatggtcggggcggcgccagctagctacggggaggctactcgtgctactacccgagtataaggggaggagatggaacgaggagggagaacggagggaggcactaccgtgcgggggtgatggggcgcagtgacgagaggccgacggcacgggagtgatctctccggcctcgggccggggaagaggaagaagacgagcgcccggagtccccttccgcgtcctagcgcgcaccggctcctctggcacacgtgacggcggcggttggcgagagggacggcaatggcgcgggcgagaaacggggaagattgggaggggaaagaggaagggagggcgcctgggattaaagggcggcaatgtcggtttggaaaccgaccttgggcggtcaaggcgcgagctggcgctcggcgctcgcggccaaaacggcaacagaggcagatgacgccggcggggaagagaaaaggaaaaagggggggagagaaagggggcttgcctccttgctactttggggaaaaggaggagggagagggggcgatgcggtagagggaggaggagctcagcctccgtcccttggaggcatgcgcggggagaggcggggccgagtcgatgacgacggcgatgacggcggaccggtttggagtggagcggcgacacgggcggcaggcgcgggcaggcgctgacggcggcggcgactggctggtcggccaccacggcgcgcgcgcgcgggcggcgtggcgatttgggcggcaggcgcgggaacgacagcgagagcggagagggagggctcggcgcggctcacggtagagcggagagagagagagagagagagagagccggggagggagagggagatgggccgagagggattcggcccatcgaactcgagggaggcgaaatagacttttgcggagggatttggatttgggattgaacttgatgatagatcggggatttgaaatctgagatggcacggacactagacaacaagcaaagaaacaggtttcgcaatttagggtttttttagagatagttttcccgctaggcgccacgacggaacgggcgctacagattcgtccgccttcttgaggtcgtcgtccccggtgccgtggtcgacgctgaggaccttgtagtagtcagcccctatctccctctgagc

SEQ ID NO: 5030 - DNA, 20824 bp, Oryza sativa
gctcactgccaccccactctgtcccgctagcttagcgtggcgctggtggccacagtgaacaaaaccagcgccacatagaacaaaaccgtgtgaaatactgccctgtgactgcttgtgaccggttttagtaaagttaagggaccctcgatatctggttttttggttcgaggatgttttttatctcggtgacaagttgagggaccttcggtgtactttttcctaataatgacataacttagctataaatgggcctagtataaagggcccatgtctgggccggcccaatcaatttggatcccatacatagaccgactcggtgacgtcagcgtccatcgcgactcaaactccaagtccctatctcccggcgatctctgacttttcgccgctggtaaggcagtctcgtcgcccacgatcgaaccatcactacatcgccgaacaccatgtcggctgaggaagaagagggtccaacgacgacgacgacgatggatccaaacgacgccgccgttcccacgctggcggctgccgccgtcgccgccggcgacgagaagaagcctcccgccggcaaggtgccgatgcccgacgactacatcgccaccatcctgtcgctgaagagggagccgccgccaaaacctgagtacctgagcctcctctcgccggaggagcgcgagaagcagctggagttcgacgccgtctgcgcgaaggaggacgacgcgctggaggagctgcaggccaagatcctcgccggactcaggaaggacggctactacctcgtcgacgagagtttcctcgagaagtcggcggcgatgcgggcttacgtgagtgaagaatgggccaagatggactgggcaggcagcggcatcatcttcggctactgggactacgacgatccgcaatgcgttcagtacctgtgatttgatttcagttttgatcttaattaggctggcgtttgccatatatttgtaagctagaatcttttgtttcatgttggcaaagacaaacagcgaagtataattattacttttttgttttaggctaatatagtttcgaattcaccacaatgaaaaaaaatactcctccggactaataatacttgtccttttagataagggtgagcttaaagtttagaatatttgattatgaatcatttttaaaatatttatcttttgactatatatacatatatatatatatattagttttaaaaagtactttaataaaatcatatagtatttgttaacacttttatacatcttataatggaaaataatgataaagttgttttttttaaaaccgtactgttatctaaaacgataagtattatcaatccgtagggagtatgatctaatggttaaaaagagaaagactgatcggtagataaagggaaataaattaaaattttgaaaccctacttttcatatcaaaattaaaaagaaatcacacataatcataggtgctatggtcgacgtgtttttataaagctgccaccttattcaagccttaattaatttcagcatacctgaaaccatgtttttcaagtagtaaagcgaagatttaaaccaacaacatggactaaaagtttcacactatatttttaaaatttaagtaaatatgtgctcaacatgtatagggataggattttgtaaaactctagaaccataattcctaaggttatgcatcgttatctgagggtatatacaactttgatcataaaaatacagggtttcctatttttcttttaaaaaaatcagccctttgacaacaaacagatcaccaagaaatttccacatcgattactgaaaacatgcaaaggaagtaataaaatttgcttagacaagtttctcaaatctttatctctactattataaaaatcaaagatgtttttgccggtaatttggtaagttatcttatataagtcggtttttaagttcgatcacttttagaaatacaaatccgtatttgagtcggtttttaagttcgttcgcttttgaaaataaagaaagagtcatataagaattctttttaaaaaaaactcgcatgctaagacgatcatacttctaattacagttcatgattttctaaaaaaattatatccaacaaaattcccacagtgaatttcaccttaactagaccgtataataacaataaaattaaaatagccttcacctattgcaacgcacgggcattttttctagtcttaacctattataaaaaaatatattgtttttactgttcgttcatcgttgcttccgcatccgttttggtttgtccattttccgacgcacacaaccagatcacccatggctcactacaggccctatacggccaaatcagcagattggcaacggcagcggcgccaccaaatccattaaccatcccagctcaattgttacatgcactttgaatcaaatcaaaacaaggcgcaaaggccagaggttgagtttgatgtgattcgatttatttgtcacaaacacgatagcggttcatgttcctcaatcactttctttgctcgatccacggccacgcgccgccggatcgcccgttctctaaagagggaatcgccacaaaaatgatccacattagcacgttacctccgttgtgtgaaaatgacataggcggtgacagcacgagaccacgtggtaatgcagaacgaaacagtgagaccgaacgtcacgtccaactgcacagcttaattagtgattaattaccctaattagcaattaattactaattattattagtgattaattatcctgattagagagtaattaaattaatcaattagaatcggccaggcttcctggaaatgcaataccattcagtctcgcagcctcgccacgcgaaatcgagcggtctcgcagcctcgtcgcataacaccgcacggtctcgcaccgtcaccgtgtgagaccgcccgtgttgttatgcccacgttattttcgtgcaacggttgtgcgaaatcgatggtatatttgtgtcaaacaaattatatctcaaatatttctgagaaaaaaaatgaacaggatattttcaaatttaattcaggtaaactatatggatgttttgatattgatagtaaaagtagaaatatttgaattagaacaaagctagaataacaaaaagagagagttgttttattgtattctgaatgaagttttaaatgcaaattaccagttgccacttttccttgaacctggacgtgtccgaatcgaagcccccaaacatcctgaatcctttcggactcagaatccgaatccgactccttcacaccgaaccatgcatgctatcaatcaaagagacaatctgaagcgagagagcatcaagttcatcatcagcagcagcgtacgtgagatcgatcgatcgatcgagcagatcacaagcaaccgagttcgtcgacatacgcactccaagtgaatactgatccatcatccatggacgcctctgcggtggcatcagccgacgaggcaaagaagacgacggcggcggcggccgccaccgccgccggcgagccgcagaagccagccgccgttgcgccattattggcgcaggggtacgtcgactccatcctggcgttcgagagggtgcaatggccggtcttctccgacgacgacctgaagcacctctcgccggagcagcgccgggagatcgacaagatggccgccctgcacaaggctttggacgacgacctcgccgtgttccaggccgaggtcagccgccaggtcgaggacaacggctgctacgtcgtcggcgagagctacctcgccgatcaggccaagctcgaggctctgatcaacgaagaatgggccaagatcgactggagcgccttcgaattcgagtagccatgagatattgagatgtgtgtggacatgcagatactgatcgatcttgtgatgaacagatgattcaactagtcattagttagtaatccaaaaaaaaacctggtcataagttcattatctagcatgatacggagtatgatatatagtatcagctatatctactgacctgtttgaagaactatgatgctggtaatatagggagatcatgtagcctatattatgaatgaattaaatgtggtataagtatttgcaatcctatcagggtttacaattttgttttgcatatttacgccaaggaggcaccaaaatttctgagatctcggaaatttcggaacaatgtcttttgaaaaaacattagacaatttttgactgaatttgactatacttttaaaaaaatataattaagactgactacacatttttaagctctacatcatgaaataaatttgtaaatgtcccgaagacccgaactaattaatgtagagcacccatttgaagctccgcgtgaaaaaaaatattttctccgtttaagattataagacgttttgactttgatcaaattcaaactactctaagtttgactaattttatagaaaaaagtagtaatatttttaacccaagacaaatatattatgaaaatttatttaattataaacttaatgaaactatgttggtgatgtaaatattactactttttttctatagagttagtcaaactgagagtagtttgactttttaccaaagtcaaagcgtcctataacgtaaaacagagtaattcgaaggtaggaatatatattagttaggcatgaagtttcaacacaaaattatgaactttccattcaaataattgttaatattttactagaattttttagataagaaaaagtaagagagaagtccatcaccagtccctaaacttgtatcactgtgccatcccggtccctaaactcgcaaatcgaccgtttaggtcctcaaacttgttcgattgtgtcatcccggtccctaaacttgcagatcactcgtttaggtcctccaacttgttcaattgtgtcaccccggtccctaaacagaacggtctaaaaactttatattaaaaataattcataactttttcatgtgaactctaatgaagacaaactttatatcaaaattgtagccctagacgtgacctacaactttgtagttgaaaagtttttgaattaaaactgtttagggtcccaaaatattgtttcatgtttatagattttgaaattttaattttaaaattacattttgggacaaaaatgacttaaaataaaaaaatatcaactacaaagttgtagatcgcatcgagggctacaagtttgatataaagtttgtcttcattagagttcacatgaaaaagttatgaattgtttttaaatataaagtctttagaccgttctatttgacccagatgatattcaaatccaagtttagggatcggggtgacacaactgaataagttggaggacctaaacgagtgatctgcaagtttagggaccgggatgacacagtcgaacaagtttgaggacctgaacggtcgatttgcgagtttagggaccgggatgacacagcggtacaagtttagggaccggtgatggactttactcaaaaagtaattataggttgcaacttgaaacgctttccttagaaagtctcgagtaagaaccctataaagtgtagttctagcttcacggaaaattgttttaaactgtcgagtggatgtatgtctgtgtttgctcatcatgttatttccacgctatcaatttctgttattcttcatcttgctcctgggcacctctctaaacaactccttcgctgtagtgacacgtgccgttgagatactaacatgtgggcccatatgaatttaggagtttgcaattttgattcagacaaatttcgtaaatttaggtgctaccgaaatttctgaaatttcagcactttttggaccaaattatttaaaattttaataaattctgattgaatttttataaactttgatcaaatttaaaaaaaaaagagaaaatctgatatttttgaacgagtcattgtcagggattcgaaattttcggaaatttcgaacagaaattgcaatcactagttaggacccacgtatcagtgacgtaatggctgttcctataggcccacgcgtcagtgtctcaccgcgaagacggactatatacgctcatcgccgcgagttgagaacacacagcgcgcgacactatatatatcaagaaggcggagacgatcgaccgacgacgcaacgcacgtttgcccgatcagcagctagcgcgcgcggtcgcttgataggcaagaagcaggggcttatggacgcttctgccacggcggcggctgcgccaacttccgacgaggccgagacgacggcgacggcggccgcagcaggagctgtcatcaccaccaccggggagtcagagaccaccacggtcgccgaggcggcggcagctgaaactaccaccggtgggaagtgttctggcgaggcctgcggcggcggcgacgagcagaagcagccgtcagcgaagaagatgatgcagttgccgcaggcggagatcgacttcatcctggcatggaggagggagccatccccctacccggacgacgaccactgggcgctcctctcgccggagcaactccagctgcgggaggagatggccgccatcggcaaggagttcgaggacagcttcgaggagtttcaggcggaggtccggcgcgaggtcgaggagaaggggttctacgagttcgacgagagctactacgccgatcaggccgagatgcaggctcagctcaaggaaggatgggccaagatcgactggagtgacgtcgtctgcgccgactgggatgacttcaacgaccccaattgctgtcgatcgctgtattaaaattttataacaggatcacatgtctatcatgtcgtgtgattgttgctgatggacttggacagggtgaatctctcagtatctctcacctctataaattaattttttaccataattttttttaacacaaacttggctagattgataaaatcaccacagactaccggtacattattttaggaacatagactagcttgacatatattgagattgacgaaagctatcaacatgacatatattgatattaatgaaatcatcatatatgactcgctatcaacaggtacgtcgtctatcatcgaaagagtaattaaccgtaattccataaatgcaagcactcatgtcaagtctgaaacttgaaccctgataagttggttccaccacacggaacctaaccggttaattgagttacgctcactttgcatcttttaatcttacttactgttgtacaaggatctttcatgttactagtacagttctaatggacgaatttatatattaggatagtgaagaaaaagttttgagaaaattgataaatagattatattagcaagggcatgtctggctggagggccgctgaatgtggatgtcgctctcgcggccaaggtcatcgctgccgtcaccaagccatatatggttcttccgccgcgtcgtaccatacatcgtcccaactcccaagtctagacattgattgtaattttggttcgaaatttcgaaccccaccagcaaatcaatataccgaccaaaattttcaggttttcttaaattttatttgaagttgatcatattttattcaaactgagtcaaaatctgttaaagttttagaaaattttggtccgaaaagtgccgaaaatcctaaaaattccaaaatttcggtcctaccgaaaaatttcgtcgaaatcaaaagtggtgtaaaccctgacggcccgtttggttggagggagtttttaggagggattaggagtttagagggatgatgctattaattgttttgtttggttgggagacatgagaattttggtgggatggggatggggaattgagaaaggaactccctccttttcaatagggcaggtaattgggagggaatttctcctttactttaatcaagcaaatctcagccatccgtttttattaatgacctaatctccaactaaactccctatcaattccatcacctctaccaaacaagatattgagattaaaaatcaaattcccatcttaatctcatcatcaattgtaaactctcaatccctttccatcgagttaccaaacaagccgtgagtcaaagtggtgtaaaccctgagtcgggggtagagtcggattcgaagccgactccgtctcctagctcgtttccgaacacaacggcgctatgtcatcaaggtggctcacaagtcagaagcaacgcagcaaaattgaggaacaggcggaggagagacgcgacaacgacgttgaatcgatctcagtagcagctagcgttccacgtacgaaaatatatggaatcttcggtggcggcggcggtggcagcggcagccgcctccgacgaggcagcagcagcagcagcaacggtggcggcagcggcagctgaagccgccaccggagtggactgtgcatgccgacgatgcggcggcggcggcgaccaccgtggacggagacggcggtgacgagaattcgaagcagcagcagcagccgtctgtgaacaagctgcacatgccgcaggagtacgtcgactacatcctggcatggaagaagagccccttccctctccccgacgacggggagatcctctcgccggagcatcgcgagatgcgtgagcggatggccgccacctgcaacgagttgggcgacggcttcgaggagttccaggcggaggtccggcgcgaggtcgaggagaaggggttctacgaggtcgacgagagctacttcgccaatcaggccgagatacaggctcagctcaaggatgggccaagatcgactggggcgacatcgtcttcgccgactgggatgacttcgacgaccccaattgctgtcgatcgctgtaataattgagtgttattgacatggtaattaacctgtgatcgatgatcatatatgtgttgtgtgctcgatgttttgctgagggagcggatagactatataaatgtatttgcagttatgcagttatgtgagcttaatggtaattgctaacttgcaatgtgtaattacatatttattttcacctatacgcataaaagattgtatgcaaatatattagaagaaagcatttttgaggttacaccgtacaacggccgcatgccattgctaggtgggcgggaggcaagagacgacacaggataaaaagaaaaaaaattgagagaatggaatactaaaaactacacctagaaacaggtgtgacagcggcggagcaccactatcctcccaacagaaccccaaaagccgcggcgccaatagttaaccacaaatgaccttcttaaaagatggaggctagtaccattgaaaccgacgagacagagaggaatccaataccttgaagtttctctccttccacagctaccaagaaaccaagagaactagggagtcgaaacatttacaaagatgttccggttggcaggtcctagaagtcggtcatcaaatctaaagcgtgcaaccgcaagaacaaagggtgaggtcagaggggagagagaattaatgagaggcatgcaacaataatagtttactgccctcgactagtttaaattgccagttcacaatcaatagcaatagtgtcattgtattttttttcaaaccggctatgatattattttcagtgaaagtttaaactgaaccggtaatgataagatcatgatgattgtgtggtagtataacaaacgccatcaattaaaccaggtagatataacaaataactagtacactaattagctgtcagtggttgatgaggagcaatatctttattgggcaagtttaccacaatatctttgttgatttcaacataatgtgaaaaaatatatattttaatttagtcctccaaactttttttttgccacaacaattgacttgctattgaatatgattcacctggacttcgttttacttcctaacggtattttctctatataagttgtattttgtaatgaaatttggtgaggttcatagatgcattataagttacctcctaacactttttagaatttgtttttatcatatccctatttacatatattggaagcaccgagactgatttagacatagaggcttcaaatttctagcaaattatcctaaaataaataaaaaatagtgtggatcattgatatgggtgttatcaatggttgtacaaagttttagcttaaaatattatccaccaacaaagaaggggctaaatactgcagtcgcattcactactgcctcctcaccggagaactccaccatgataggaaccatggcgatcgaggcgccgtggcgattaccgactcggagtcgcaactgaccggagtgtatcgtacacgccgatctccattccagaccgagtccgagttctactagggtttgcgtccccccaataaattcaacgccgccgccaccgcttcctcttgcttcttctagctacagccacaatccccaaccatccgtacgagcttagtagacatctccagagtactccaggcaaggcgaggcaaggcgaattgcagcggccaatcgagcggatcaagcgcatggaggccgagaagggtacgacgatcgtgaagtcggtcaccggtgctgcagccgaggagatcttcaccgagcaggaggatgagctgcaggctctggtcagcgaagaattcgccaagatcgacctgaagagcatcaagttcggcgactgggactacgacgacccgacttgctgtcacatgccgtgatatatcatgtgattttgtgtttctgatggatggacgatcgactgagtcagactgaattagttaatgtctcttactgtaaatcttggaactaatctgagcttaattattactactattagtatgctagtgcgagtagttgctgatcagttcattactttatttttttgcaagtgatttatgcagttgttttatattataagttgcttgaactttttccccaagtgactaagggcccatctggtatcactccagttcttaaatttaacctcagcttcaggaggggtggagttgaagtgaagctgtgctaaacagatcataagtttgtagaaaaatttagcaacactacaacaacaaattagttttattaaatgtaatattgaatattccctctgtccctaaatataagcatttttggacttcgacacggtctctgagatgctactttaatcaataatatctacaaaagtaaaatgttttaaataaaaagagttgtagttcgtttaatgataaatatagtaacatcaaatttacatgattaatctttcttaatttatcgctattaataatagtcaaaatttaaaaagtttgacttgacactattctaaaaatgcttatattttgggacggatggagtatattttgataatatgtttgtgttgaaacttaaaaatattgttatatttttctacaaacttagtcaaactaaaaaaattaactatgaaaaaaaaacaaaatgagttataataaaagacgtgaatattaggaaaggacccaatatcaaataattagaaggggtgaggcttcgaacctcgtctcgcctaccaccttgtggagttagccgaaagatccttgggcgtttctcaaaatgagttataatatgaaaagaagagactacttgctaagagtcattttacggcccttcatgagaaacgggaatgtaccacatttttaagtgtaaaatttgatcctctctattctctcatgctagaagatagcaaatttacactacaatctttgatatctctgtttatatatgtttgtagctacgtttttagctgagtttggcccatttgttttcgtggcacgcttttcaaaccgttaaacggtgcgtttcgtgcaaaaactttctatatgaaagttattctaaaatagtatattaatctatttttcaagtttgtaataattaaaacttaactaaacacacgttattaccacctcattttacatgaaacacttaatcttcatcttcatcttcaggagatttaaacaccacctttatgtaacgctccgcttctcgtgagacgttaaaaactaattcggcaaaatcctaattgcgaaaatttcattctttgtgtgcgagtctaagtcgtgccgtggatctcagtttaaatccatcattgttccctcccgtcgccatcaaaatcctctacctctaaaatgtcaattccgattcaacttcctagatcaattctgaaattcaatcgcctcctttgaatcctcgccaaatacttgtcccgattccacaaatatccgagtccatcttgaatccattccttgacttctccttgagtttcccttgatacatccctaaaccctcgagttcgaatatcagatttgaattcgaatccaaaccctaaatctctccagttctatccaaatcagttttctctgtgaaagtctagttgcctcccccaagttctatgggccgaacgcccctccccagcccattccctccctctgtcgtcctcctccctcctctcgcacgtgcgatgcatgcgcgtgagccgagccaagagagagttctctcgctctctcgtcctcttcctctctctcgctgtttctctctctctcgttcgatctctctctcccacgccagcgctgccgccatcgccgatttcccgctgccgccattcgattttcggctatgccgctcgttcccgcgcgtgtgctcgctcgaggccagccgctcggtcgccgccgcgtcagccctgacgccgcccgtgaccgcgcgtcgcccagccccgactgtgtgcatgcgtccaagggatggaggcagagccctcggcctcgctccctctcccttttctttttcccgaatcagcaaggaaccgtgctcctttttcctccccttttccacttttgcccgacaccaccatccctctgccaccgcctggccgcttgcacctatgaccgccagccgagctagcgtgaccgcagctcctcctccttgaccgccaatgtcggttcttcctccctaaaccgacattgccatctattaaacctagccgccccatctccctctcgttcattccctcgccaccaccgtgcccttgccgccttgctaccgctgtcctcgcctcccccctccatcgcgcgcgctggtgaagccggcgtgcgcgcgaggagctgacgcgggactccaggcgccgtctccttccccttccccggcccgaggccagagagctcgctcccgcgtcatcggccgctcgtcacagcgcccgtctcggctcggtagtgcatctcccgttctccctcctcgctccctctcctctccttagctctgggcagtagtgcgagtagccttccagtagcaagctggcgccgccccgaccgccgccgctgctcgtcgtaggctcgccaccgtcgctgcccaaactcggtagtagccgctcgtcgccggccttcctcggtgtagctccacccaatccgactctagaaatgaactctggaggtcgcgtagatgctcaagtacctaggaatcgagctctcgtcgcatcgtcgtcgtttccctcttttgccgccgccggcaagcaccaccgcgattcgtcgtcgccggcctccttccggtgaatccgagccagtggatcaaccccctttcttctatctcgtcgttccggtgtactccctccctcttgaatcgtcgggtcgtgctcccggtgaagccgccgccgtccgccatccgtctcggccggcctccttcttcctcctctcgccggcccgcgtggctgccacgaaggcgccacgtcggcgccacatcggccgcgaccgggtcaagcacctagtcagccgcccccaccgccctttcttctgtgcgcgcggtccacggagagcccttaggctgcgcatgggccctccacctcttggtccacccgcgtgccgcgccgtgagccgcgtccgcaaaaccctagcgccccgcgccgcatgaacccttccaccgtgcgccgagtcgctgactcgtgggcccgtcccgggacccggcatgatggatccggtccacccggacccatccccctctctcctcccgcgcgccccgcccgcttgggccgcgccttgcccggccatgggccgcctcctcgtgcccgcacccggcccattggctcggccgcgccgcgcttatcccttgggccgtacccgagccgcccaaggaagtctaaatccgatccatccttccttttcttttccaaggaaattaataattccttttcctttagacagaaaatcaaataatctttagaaaatccatatcttctcaaccgctcacccgattgcctccattcaacttccaataattccgtaaaattgagatctatataatggcactactaattagtctaaataggatctttcttttggtcttttgtttaggctttcgattgtttgcatatagttgcggttaccggattttcgtcaatcgcgggatttcttgaagattcgtgaagcacagtgaagaccttgagcaaggcaagtcaccctttgaccaattgctcctataattggaaaatcattattattttgtttgcaacttgcattagtagaatcacacacttaacttgcttggcctcggtttgcgtgccaaaccgacggacctacccagtagtcgcactaattcctgtaggttgttctaccctgattccttgtcgttccacctttgtggtacttcggtatccgtgttctctgagcgcgtataccaactattccacatacaccgttgtttgtcgataatttgggaaatgggtttgagaagccttgaaaacccgacatgtagcgtcggtgtgtttgaaaacaaaatggattgtgaaaacttgcgatgctggggttgtgcctatgtggtactgtcctgtattcacatataaggaccgattcctgtgggaaattcatccgagcatataataagtgcgaccacacgggtgcaatgggacgcccctggctgagtaattagctaatcgggggagccatgatgccaagagacatgtggattcaacggggtggtgtcggggagaaccctcgggcttcctggcacagtatggtctgggacctaacctggtgttggtctgggacccctctcgttggcatatggtaaacctgtgtcggctttcgaaatgccttgtcatgaaagccttaaggtctcccgacgtggctgatctcacgggctgggtgatccgggttagtaatgtcgtgtgggtaaagtgtaccccctctgcagaggttaactaactattcgaacagccgtgcccgcggtcatgggcgtatgtgaggtgtttcctgtagcgtagatttgtttgcctgtgctttgtgaaaagttgttatggtgtgggaatcgttaccagaatcagcctatgtggtagatggatgacctgagtggtcaagaaatgaatctgtgtgattcgggatgtctaccggcatcatagactaggcttcccgagtggaagcggattgttgtgctgctgggcagctggactctaggagttcgagaaaatgaaaaaggctctgggagccgattaatcaagtggaatggctctgggagccgagaagtaatgatctgacccaggaggtcggtacattaccaaatgagctgttaaaaaacatctcttaaggtcgaatcgagacgcaagtctcttttcgagccaaacttagaaagaaataaatcacttagtgatttcaaaatgatttcaaaacaaaagatttgcaaaaacaaccttgcctctcttccaagcttacattaaacacctaaattcctgtgacttgctgagtacaaaagtactcacccttgctctatataaatatatatagttcctccgcccggaagttgaagatgaagtaaagtgaagattagggtttcgtcctggttcccagccatcgcctgtggtgttgggtgttagtccgttggttccgctgctgccgctgttgttggtgtttcctcgtccgcgtcatcggttgcaatctcgggctgttctgagctgcaacctaagttaagataaataagtcctctatttattttaaggattgtaatgattcatatttgtcaccgtgggtaccagcgctatgtcctgggactggtattgagatcgcggtttcgtaggaagcggttctcgccgtttttctcacgacacgctcctgtcaggtgccgttgtacggcggtgccagattagggtgtgacactttatatatgtttgtaggacatatctcgaagattaaattatgtttccatggtacaacgttagtactgtgtattccctctgtttaattttaaaagtgtgatgttgattttggacacaaagtattaccctttttgttatgtttctcacagtagttaagcggttggttggcgagcctatatagatcggtttcttcgacctgttcaagatcgagtccatttaggtagtgttttttttctataacaagtacttcctccgttttacaatgcaagtcattttagtatttttcatatttatattcatgttaatgaatttagacacatatatatctatctagattcattaacatcaatataaatgtggaaaatgctaaaataacttacattatgaaacggagggtgtaataccaagttatttctaagataatgactagtgatactaactgaatacacatagacattttgcaaacactaacagagatagcataagggccaagctgaatcgatcctctcctaattaactaggtctgtcagttttgtccacaatgacagtttagcatgtggtgtgtggcatctgatcgatcagtcctcgaacaggatgccgctctaagttcaccttggcccataattcatcggagagagcctgggcttcttccagctcggcgaagtaggtgtcatcgaccatgttgtcctgcctagctaggacctccacgccgcggcgtcggagtcagggttcatctatcagttgaggcgtttagacgtttgtattagggggtcactgaaattctgaaatttcagtccaaaatttagagtaaattttagttgaatttagtaaaaataatatcgtattgaaaaattaaaaaatttcggtccgaaatttccaacctggtcagagtcggattcgatgtcgttgtgtgtccgagtcggagacagcaggtagcctagctttgacgttggccggaaaataatgtgtcacgcttcagtggttttgcctcaacgaccaatctcgccgcacttaattacgaacctcatgagtttctgtagttgataggcacggaacaaacaaatggtgcctataacgcgtgcgcacttattcggatgaacacttattttgaaatgaaggatagaaaaaaaagataaataagaaaaatacccaagatttagaaagaaatataactgcataacacataaaaaatgctaaaaggaaaaaaaacatctgaatagaccgttggaaaaatataggaagcaaatgggaggagaaactttagaaaaacaatctaagagattagagcttttcctagaaattttccacaaatgatttaaaatcctctaagaatcctatgttttttctaccaatcaaaggtagcctaacaaaagtacttgtaaaaatctaccaatatggttttttttcaagctaaatatttgagaattattagtgatcaaggtttcaaaattttgcatgcataatatttaataatgcaatatatttaaggaattttgctatgtatcactagtgtattttttttggtacgcactcgaaattgtgataatgatagaggtgatgacaacaatgaaatctaacataatgataaaggtttcctttgaaaccttgattgatagtcatttcttactaaatgataggatcacagttcacaagttaacaacactggataaatcactcgcaactcaccagcttgtgacactgaatttaaatatactagccaagaggccatgctttgcaacaaaaaacaaattgagtttatagcttattaactcaatcaagcacgtatttagtgcaagcagtacttttactatttttcttgttaaacaagtaggcgattttaagattttagagagatctagcaatgaaacaggagagaactcattggaggatggtgtaataatatagattgtgggatctaaatatcagtggtagggatggtgtggtaaaatggataccactacttagtaagactataacgcgtgcgcacttattcggatgaacacttattttgaaatgaaggatagaaaaaaaagataaataagaaaaatacacaagatttagaaagaaatataactgcataacacataaaaaatgctaaaaggaaaaaaaacatctgaatagaccgttggaaaaatataggaagcaaatgggaggagaaactttagaaaaacaatctaagagattagagcttttcctagaaattttccacaaatgatttaaaatcctctaagaatcctatgttttttctaccaatcaaaggtagcctaacaaaagtacttgtaaaaatctaccaatatggttttttttcaagctaaatatttgagaattattagtgatcaaggtttcaaaattttgcatgcataatatttaataatgcaatatatttaaggaattttgctatgtatcactagtgtattttttttggtacgcactcgaaattgtgataatgatagaggtgatgacaacaatgaaatctaacataatgataaaagtttcctttgaaaccctgaatgatagtcatttcttactaaatgataggatcacagttcacaagttaacaacactggataaatcactcgcaactcaccagcttgtgacactgaatttaaatatactagccaagaggccatgctttgcaacaaaaaacaaattgagtttatagcttattaactcaatcaagcacgtatttagtgcaagcagtacttttactatttttcttgttaaacaagtaggcgattttaagattttagagagatctagcaatgaaacaggagagaactcattggaggatggtgtaataatatagattgtgggatctaaatatcagtggtagggatggtgtggtaaaatggataccactacttagtaagactaatgaaaagaattaatctcatgtctaattaatggcagcaactaatctactcctaactgcaatgacagatttcttcagttcgtgaagaataaaaaaaatgaaaaaccacaagtttgatcaagatttgaactaatccactcctaattgctgtaaagaaaatgaaaattttcatcaaggtttgaactaattaatcttgatgaacatttgttcaatttgttgaaaaatgaaaacaattgcaatggattgaaacattttaaaaatgaaaaattaaaaaaattaaaaattatgtctgagcccaggttcgaactggggacctttagtgtgtgagactaacgtgataaccaactacaccacccagacaattcgttctagatatttcaacacaaataattaatagtaacttgatctgcctgttttaaaatgggccagtatttgtctaattggaacaattccacaacaactctttacaaattatccagaacatatttttaattgtttttatatagaccagaatacccatctcctacaactcaactgtactgatcagaccaaatcatatagcacaaaattgaaattactactgcaaaataattagagataaaaaaaagggaaatagcgatggagctcaccgccatgacctcaggcaccacaacgatgagcttgccgccgctaccggacatgccatctccgtggccttgccaccgccacgacgagctcaacaccgatgttgaatttgctcgcgctgtgtcttctgacccgccatctctaagacctcgccctcaatgatcgatgtgaccgccgctcctctattgtttactccaccgctcatgctgctgctctcaccattatcgatgctgcttgtacgccgcggacgtgaccaccatcgccgcccatggttgctcgctccaccaccgtccccaccgctacttgctttaccacagtcaacgcccatttcccaactggatgcagttgacgcgaccgtcgctactctttccatcccaacccctgttgctgctccgtctaccgctgccacccctaccacgctctccgccgctgacacgccgatatccatcttacgctgacgccctacgagtagacaaggatattttggttcatatatgtttcaggtgtatagcatagcatgtttcgattttaacatatttacagtggcatcgttccaattaaacgaattgcagtgacattttctaaagttataatcgcatgatccaattaacccaataattaatcttgttttactagtaaattatagtcgctgttcgcaactgcttagccattccattccgccgccaccacgagacggcgaatccccaatcccccggtcgccgccgccgtcgccgccgccatggagaaaaagaaagagaaacccaaccgcaaacgccgcaaacctcggcaagacccctccccggactccggccccggccccgactccgactgctcgccgccgtcctccccgacctccctgcgccgcctcctcgacccctactccaagccccgcctcctcgcgctcctctcggacgccgccgccaccgccggagcgggagccgacgacgaccccacgctgctggcccgcatccgcgccgccgccgacgcgtccccctcccaccgcaggctgttcgtccacggcctgccaccgcacgccgacgcccccgcgctcgccgcggcgttctcccgcttcggccccctcgccgagtgcgacgtcgtcgcgcggcgcgccacgggggcgtgcaaggggttcggcttcgtcacgttccagtcccgcgccgccgcccgccgcgcgctccgcgaggtgggccgcggcggcgtctccatcaccagccgcgccgtctccgcccagtacgccaccgccggcgcc

SEQ ID NO: 5031 - DNA, 5284 bp, Oryza sativa
tgcagctgctgtgctgaattctgcattggcatccactacagctgcgctgaagccgaacccagcagctgcatcatccataaatccggctgctgttgttgcccgcagtagtccggtggctgcacctgcaatgaagccattggcacctcggagtccagcagctgctgcagcagcggtggtgccatctccggtgaagattgctgctggaataagcggcggtgcaggattgcttgggccatacaagccaccgtcctcgccaatgttggcttcctccattggacaaagggatcagtgctgagcctgtgaacctcgcttctgggtgttcaacatggtaccaaatcggtttgcttgcccaagccctatggcttgagtcatttttgtgctgatgatagtggaatgctgcatacatagcttagttcaacttaggaattttgacctcttaaaccctagattgaaccattgacatggtgggatatcttcctttccaaaaatgatgcctttttgtaataatcatactagtaggtggtagctacattgggtcagttacatggttggatattttcgtaatgcttaacgatgctatagccaacttaggaaaaaatattcatgtggtccatatttgcttagattttagctattcttggtattcaacactgttttacacttccctggctaatatgttgaagtaataagaatgtgtttttcatgtgagacctaaattggttaattttccaaatcatcttttgttgatacaagaatagattacttgtttttttttccagatacacctgtcttgtttagccaagtaactctacactactgttaatacatatcctcaagcttagctgaagttctgaattctgaccagatcaagctagcaaagtagagtagtagagtacggagtacctttaattctgtcatagtgcagatcattaaaaactttcttgcacatcttgattaacctccaaaactacagctttggttagaacttgaatatgggtgttgatatctgattttggatggcagtaagatgacatttgttaggatgtgtttgcccatgttatgggaatgaaaaacaaaatgcattaggcactgtggcctggaacatcagatatatagcaaagatctagtttcaagtcttatattaatcagattggaatcatgatgaaccttctactgagataattcactattcagcttagtgttggttgtatttatagttggtttaccttatgctcaatgacacttgaatttgctgcttgatgtgatttatgtccgagaaccattccagaccacagatttatgcaagcttgactgaatcctgtatttggatactgatgtgcaggtatggaccaatggagtatgggagcagcaaatctacgtcacactcagaggcttaagttgttgcatttatgcctcaaaccctctaggatgcttgtcagtagatgcctctgtctttggctctttgctaacctgaaccatagatgcaaatacagttcatgaagcatccatgtgatcctctgatcctctcttcaactttcggaattttgtacagtgttccgtactatcttgacgaaacacattctaaggaggttatgttcttattcattagattttagcagttctgttcttcagggttacttgtaaccattttgtgttaacatgttctccgctccaactgaatctaacctactttgtgcagctgtcttggtttctcatttgtttagctattgctggatgttatcttgagaaaacaacactaaatcaatgaacatgcttttttaaaatgttaataagcaatcaagagatgatatagactgcagttagtgttcaattcccaagtagccatctgagtagaggatctaacaggagatcatccttggacctgaactattttttcccgttggaaattcaatcccagtttattggcttgtattcacctgacctgttagcactccaaatatgttttgggatatttgggcatttgcatttgccgtgctcttattgcgatgtatagctacaccttgccatgaaagggtacaaattttagctcctttttcagggaaaaaaggaaaatctttgttgtgccaatcttctttgccatgtaacaggagtaatcgttaattcacagggttttctgtgtttctgattttcggttgtatatgacaatatgtagctgcacggtagttcatcattgaaaacttctccaacagcataaatagggcttcctgtagttcattcatgtgattcttaggatagacaaaaacagagcattttgatctgcttcctttatcttcagtataaccaatcagtataggttttacaccatgatataattgcccagctgcagtaactttttacaatgtgtggttcctccgtatgggtgaaagctggaagaacatgaattggtattgctacttgatacaaaataaagcatgcctccatcagaaactgcctgcattatgtacaaggtcatgtatcatttcctgctttagttacagcatttggtcctcctatgatgctactgctaggattacttcctttctgatgtatgtacaccagttgctagtgatatatggagtataatagcattacagcaggccatgcgcctgccttgtcactggtgtcgcaaatgaggtgtatggcaccgtggatgataccatgaatcaggattctcacttccacctcttcgcgtttttcagcgatttcgatttttgcttgctttgctggaatgcctgcatcttctgcttctttctggcaattttctctgcctgtattacagttagaaaaaagaactgtcagttatagaagctaaacccaattaattgtagttcgcatccaaattcacatcgtgaaaagacagtagagatattcacctttgacatttttgacttggcctttactttgggggctttctcctcgagctcttcctcacgtgcaagttccctctctctggcctcaagattcctttcaaggtaatactgcaaacacaaagaagaaaataacatcatttctgggtgttccagtatttttcagtgttccggcaccctaatatgaaaaattcagactcccctctgttttttgtgatgcctctggccctctgtaggatttatatcttgatttctaccattagtattgctgaagttactgggataattatgatctatatcttggtggcctgaatctatatcttttactgagcactagtttggcacgtgatgaggtaagagtttttatataagatgaagcatttaattcggattatgtggagaaaactatagattatgttgctgcactatgggaaactattataatcaagaagagttaaccatatttcactcgaatacagcaaatacaggttgcaaagtaatattgagtaacttatatcacaggataactcacattgtaatctccttgatagtcctgaatagtctgatctttcacttcaataactctgttaacaatttgctttacgaaataccggtcatgagaaactgttataacagtgcctgtgtattctgaaattgcctcctgccatgcacacacaagcatttactgtaagtacatgctaaacaaggaactgatggatcataagaaaaaagttttgctatgcaggagaactgcattacaatttttttaacatacgagaattgcatctaacctcaagcatttctttcgatggaatatcaaggtgatttgttggttcatccaatatcaataaagtagatggagtcaccaagaacttgcagaaggcaagcctcgcctggggaaataacagataaattgtgagtaaatatacagtaacactacatcatacaaataaaagaaattcactggcaaacgtatattaccttctctccaccacttaagaattgaacctttctatccaacatatcatccctaaaattgcaacgaccaaggagacctttgatatcatcaattttccaatcctctgctgcttctgctacagtatccagcacagttttctccaaatcaagtgcttcagcctggtaaagatcatgtacatgaatctagtcaggaaaaaaatatttttttactactgaaataatgaaaggttgatgatgcgctgcaattaatcaataggcttacaaccacttgacctgatagcttaatcaaacagtgaaaatcaaatatatactactgtacagtattactgtcatgatgaaaccatagtgaaagaaaggatatccatttcagggatttggtgtacctgattttgctcgaaataattaggcaatacattatgctccccaagaagtacttcgcctccttgtgtcttctccatccccaaaataagcttaagtaaagtgcttttcccacatccattggggccaattatggctatcttttcacctctctcaactattagatttgcattattgaacaatttctggagatgataccaaaggaggaattaagagcattaatacaaatagttggggtacggttaatcaaaaagaaattgactctgaaacagtttccaatagaatgaacctaacctcttccccaaatccaaattcgagattccttattgtcaatacagttctaccgctttgcccacgctctggaaatctgatcttcaactgcttcctttggaaaggcttctcaatcaatccttccttttcaagcttttccaatttctagtgtttgaaattagacaaaagttattagtaagtaatgacagatggctgaaataagagatagattgtattgatctgaagcatgccgcaatcatgcaattgtagtggttaccttctgctcactcgatgcacgccctgcgttaactccagccccaagtctgtttatcagttcctttgtctgctcaatctccttctgctgcttctcccatgcggcatattgagtctccacccaaatcgccttcgccaaaacgtattccgaatagtttcccttgtacgttttggacacgccgaattcagtttccactatcttggtacacaactgatccaggaaagccctgtcatgagaaatgatgaccatcggcacttcctgcgtcttgaggtaactctccagccactcaatggtgtccaaatcgacatgattggtcggctcatcgagcagcaacaaatcgggatcctgcacacaatcaatttcagcattggaaatgcacacagacactaaaaactacaattcaaattcaacaatccagaccaaattcatcaccaattggccataataccactcatttttctctccatcacaatatgacaaccattgattgctacatgtagagctcaaattttctttt

SEQ ID NO: 5032 - DNA, 11384 bp, Oryza sativa
agggggggaggcgaagggaggagcggaggagcttggaggagaggagctccatgggtggcgccgccatggatggagctcctcgcgcgcgagaggttgggttgggggaagaggggtttgggtggaggagggagtggccacaccacacaaaaataaaagcccaaatgggagggagggaaggggagtgtatgggtgagagaaataaagagattgatggagttttttaatagttttttcttttgaaaaagttttatcaaaaacaatttttgggcgatttttttagaggagggaaagacttaacagtctcattattttgcttatgcttatacttataagctaaaatttaggtgagagaggaagagatcatggatggagttttagcagtttatgaaaaaaaaagaaaaagttttatcaaaaacaaaattttgggtgggtttttctgttgggaggggaggtgagagaagggttatttttttttcaccttagaaaagaacctttttactttcttttatgttgattttattcacatatgccacttttgttttgtagtgggaagtcatattcttatttgtggtagataggagaaaattggagaaatggtttatattttttgcggtttgtttcgtgtctgaatattatatgacgcatagaaaagttctccaaaccaattgatctttttttacgtgggctggacacccaacgtgtaattgttacttatcgatttttttttctcccattttattgttcgagcacttgtgctattgaaataacgtacgacaagagggatttctccacgtaattttgtacatgctagttaaactggatgggttatacaactcatagcttctatttcttatatatatgcaattatgcatacaagtgttgatatcaatcaataatgttataatttggtccaaccacaccctaatggtatggaaatggttttttattaatatggtaatttctatgtcatcggacagaacgtgatgtcatgtttttaagctatctttatctttacaatataatacagagtaataaaatagattgtacatctattccctgtttctatttttcatggatcaatgttatttctaagctatttgtgatgaagttcttaatatcatacaaaagaatagtagcacgattttttaaaggataagttggtgttacatttaatcttaaaagggcattgtagatatacacatatctgtatgctttggtcccaatagagatgatttgatgtttaacacaagttaaagtaacgctttgcatcatgtcgatgtctatgtgtatgtttcagtgctaatcaaataaaaactttgttatcctaaaaggaagctgaagaaaaatatctcaataaaaccaccatatcaagttgaattccactcctaccttctaaactcattgtcaacatttcatcgtgtcaaaacctaaaaccacataaaccactgtacgcaagccaacacactaccacaaatctccgaccaatttttctaccgattttcatttgatcacgacactactctctagaacaaaaaatgagccgttttttcttgcctcaaaagaaagaaaaactaattttccaatcatgaacaaaaaattggacgtggaagtgtggaaccataaggaaaattttcttgtggcctaggctcaacgggaggaagacgacgacgccaattgccatcgtcagttcgtcaccaaccaagccgttgctggaccgagcgtgtggccctccacggaatcgtgcgagctcacgcggccacacacgtgtcacgcggggataaagcacgcagctttgccatccattgctacaggctacagcccttgctccctgaaatgttcagaaaaccatgagcttacccgcacaaagagagagagagagagagccagtggtggagtcaggaatttaaacctgtgagaaagagccagtggttaagaaatactgttcccagtaataaacctgaaaaaaggaaggagatattaagttttgatttgtggtgtggcaatgaaaagttgaaaacaccagggcaaaagcacaaacattttcattgcctgagaacatgcatagacaggattgaggacaaatcagagagactatatgggctcaaaaggaaaaaaaatgatgcaaaaggaccgagttgtaaggaggtatgggtatatctgcaaggaaaaactggacgcagggaccagaacgtgaattctaaaatgatgatcatttgtgggtatatccgcaaaggtagagactgagggtgcaattgacaaggaaatgtataaaaaggaccgagttgtaagagttggaatagcggaaggggcgtatctgcaagaaaaactatgggctccagggacctggttggaaatctcaaaaaatttggaccatttctcgatttgtgcgtgtcatccttgcgcaggggccatgctaatcttctctgtatcgttccaattttatcggatgtctccgaagagacaacacaagcggcagcgcgcggggttataaggtgggttcttcattgttcggtaggcgaggtggtactaaacctgtctcccctcaacgctcccgcgacccaccgatccccatccaacggcccccgcagcgcccagcggcatcccgcgcggtagtacacgctcgtcggccgtatcctccgttacggcccaaacaagcagagagcacactaggcttctctcgcctgcggcctcgtagctcaagtctgagccccatcatccatcgtgaccattcatgaataaaaccggtttgtatatgtgctcctttttttttttgtccggcttagttcgttcttgcataacaactgaggttctaagtggcacgaaaaagggataaaacaattaacacatgatgaattaattattaactattataaacttgaaaaatatgttcatttgaatttttaaagaaaattataccgtttaacaagtgtcctaatgaaaaacaagcaagttaagtttaggattgaagtaaactgtaaactatatgtctgaccgcttgcagaactactgattgaccagcttgattgcgtccaaaatcaaatggtagagcgagagccgaaggcaagcccagctggtttaattagcaatcgcctatataatcagctagcgcaacaactgttagttagttggttgttgatgttgtgcttcaagaaatcaattaattaattagtctgttcttattgcttagtgtactacacactcttagctggagccctagccatgggaagaaattaattaaatccccagataaacacatgaccacgaaactgcattgctgtactaaagctctgaactagctagcaacgcgtcttagatatattccaccaagcaaaagccacatcatgctgtgctgtgccgtgccaaattaaaaccacatcgtggccttcaagtttctgctagcttcgtccttcgttgctaatcccagccagttaatcaattaattcgtcagatagatagatatatatacgcgttcatcagcgtacgttcttatagctagaactcatcctgctgtgcaaaacctgcatcactagctagctagctagctctgaatcctctagttgtctgatctcgatcgatcgatcgacaactatctcgtccacatcaagaaagcaaagttttcttgagctacgaatcaatcgatcgatcgatcgccatgggcaacagaaacgaggtgagtgagaaaatctgaattgatcatgcaatttcagagccaaattgaggtagtagcttagctacatgtgtgtgtggttgcattccagcagcaggaggaggagcaccggcgggcgagggtgccggcgttcggcgagtgggacaagatgaaggccgccggcgtgctgccggactactccctcgacttctccaagatccgcgccgtccgcatgcagcgcaaggagggtgggcccctcaccacctggtcctccaccgccgccggcggcgtagaggtcggcggcgagacggagcggcgctcatcgtcggccgccggcgtcgtcgtcgacggccgtgatcgccgccgccgccgccaccgccaccgccgacacagcagcgacggcggcgccgacctccgccggccgctccggcacgaccgtgctgcagctcccaaggtcagctaattaattaaactgctaattttcatgcgttttggtgttcttctgatggtttactaaaaagtgaagattccaaggtctgtgttactactaccatgttaatcattttaagctgcacggttataaccatatgaacttatccgcgattaagtgaaattaataagcatgattcgttcaacacactggtcaatttgttttctcaacacaaacgtacactgtaaatgtcaacatgctgcccgttagttaaaaattcagaatgttcttggggcaaactgacgtatgttaatcccgcgtttaagatatttttatgtatatttgttttttgaggaaatgtttatgtatatattttactctgctgaaactgctgcaaattgattaaatgcgacatgctgcgcacttcatcgctccttttaatatttctgtctgaatgttctttgggacatctgattgaacaatgtactatacttaaaaaattcagaacacacaagtcgtcgcgccagattgtcatgcttaatttgttgaactattatttgtttaattttgattctgaccattgtttagttttgatcctagcaggagaggagcaagctgggctacctgttctgttgcattgctggatgaagggcattggcagaaaaaaaaaattcaaatgcaagaaggcaattcaagaaaaaacttagtgctcatacatgtttaatttctccctcgtatttctgccatctctcaccgatcgatctgttggtgatttggtggatgttggtgttccatatataacagctcgttgcatctgtaatgttaggctgtctaggaattctttgctgtaaaaaaagaaaataaattcttggttaattttgattttgcctgggatgaaagccattgatttgtagcctgtacattgcacatgttgtaaatagtgaagtcgagagttattttcgcaatttttaaaattaaaatggtttcttccgatctctttgataccacaggcgggctaaaaattagtagtcgtttggattctgaagaattcatcggtgcagtgaacaacaagcatactgatcttataggattcgtaaaggaaaaggtgaaatgatttcagaagagacgaacaaaatgaaacggaaagttaaaaaaatgtcaaattaggggtaataccagggacgatattgaataatgtaggtagccaaaagctatctgtaatggaggaaaaacgagagactgcaaagtggcaaaaggacccacctgtagaaaaggggaataggcaagggcgtgatgagaagatcccgggggcatatatgtaaggaaaaccatggtcgtcagggactaactcgtgaattcacaaaattgaccatttgtgggtctgtctgcaaagggagagattgagggtgcaactgaaaagaaaacgtggaaaaaggaccgaattgtaagattcgtaataggcggaggggcatatctgcaacgaaaatacttgtaactcagggacctggatggaaatctcaaaaaaatttggaccatttctcgatttgtgcgtgtcatccttgcgcaggggccatgctaatcttctctgtatcgttccaattttatcggatgtctccgaagagacaacacaagcgacagcgcgcgggtttataagttggtcgcgttcgagttagctgggcaatgtggtactaaactgttcctcccgcctctcgcgctcacactcgccctgtgggccgctcaccgtgcacgtacttgggcctcccgctcccccgcatgcatccagcccatcacagcgaagagaatcgggcttttcttctccccatctccctacacaaccaccaaatacagccaggccgttggttcatgatccggcggcagatcgacatctacctcttcacggtctcacgatgcaagcgcatcatcgaaacgtgtaaagcacccataataatactgataaattattcgcagtttcacacccagattactccataaaaatgatcaataacacatgaattatgatttatgcttgcttataattacatagtagatgacaaggcttactctgagtaactctctttttttttttggtttcatttgctgaattaatctgtgctactacagatgaagaagctagagaacattttaggccgacagcatatatattgatgcattacatgagtaggctacggatgaggtcgggcacatctgcgccgttgatggcgagatcggacggctggaggaggaggagctcggcgagcctctcgctgagggcgtccgcctcccggtgaagcctccggatgtagcggcacgcctcctgcagcacctcggcacttgacgcctgctttgattaatcaatcaaattttagcgaggaatatatattaatccctacattataatgggatatataaattgtacttgcagatggggaaagggaaaaaccaataaaatgatgtgattataaacatgcgcatattacacgtcatgcgtgtgtgtttacaataacaatttagtgggatcagtgagacatggaattgtggtctccagctctttcagcggaatggtaacacggggatatgctagtggggctggcgataagcattgtgtgcgtgtgcattttccgtacaactgacgaagggaaaaaaaaatataaacacatatatctacatgtggattatcacgtcctaaaaattcaatatccactagccacgtaatgattaacctagtagctcaagcgagtgagttagtgacaggcacaattaatgacggatataaacccaaaagggaggatattatatattaattgccaatgcaatgcatgcatgtatatgcatgcttggtttgtaactgatcctttcgcaattccgaccttatggatcatcgattgcatcgtctagctatggagtaattaaactagggatggagatcgaactcatgttaatattttcccttttctaacgtaaaatattcccgcaatcccaaatagataaaccagtacatataatatgataatatattctaatctacgaatcaaaaccggtttaatttgatcgagatcgatcaaagatcaccgtcttaccttggcattggcctcgccgccgcgggtggggaggacggcctgcagcttcgagatgagctccgccatctgctcatccgtcggcggcggcgccgccgccaatctcgacgatgtacggctccgccggctcgacgacattgctaatcgagagagagagagagcttgagcttgtgagcctagctaggcaaagctacagtcaaaggagaggatcgatcgatgagcagtactagtacatgggcagtccagtccatatataagaagagcacgtacgttgtgcatgcgtacacgttgcgttggggacaagctcacatacggtgatagagacatgcatggggacatgcatgcatgttggtagctagcaacaataaataataatattagccatgtcagtctcacacggttaaagtgttagtcaggacatgtttagtataactccagcttctaaatttagcttcaggagttgggtctagagtagaattgtggagcggcctaaatcagctccacctctctagttcattttgtaagagcgctccacccagctccggggctgaaactgtttggctgaactccggctccagaagaggtggagctggagctatgccaaacagtctcttatagtatagtttaaggataaagatatcttgtggttgtagcccgttgtaattaaaatgatcgatatccgttatcatgtctttttttttcttttctaatatttgtatgatgtgtaaattcagctatatttgcagacgtccaaaatagccttggattaattgtaccattttagttcaacggtatgagatcaataaagtttcttttatcaaaaaaggtgttagtctctaagagattgagctagccatgttacatgcctaactgggagctgctacaataagtacacgtagctagccagtgcatatatgcatatacatgtgtgtcgttatgtacataaagttgtgagaagtgaagaaagcaatgccagcttcagcttcagttggcactgtactgatccagtggaccagtggacggacaactggtgcacttatgatgttggatcgatcaatcggcaattgtgtggggccaaaggcagaatgtgtcataagttctttaatttatttttaattatttccccaagtttaacaaaataattaattctcagttgaatgatatatgaagatactccatttttttcccatatggaaaatggcatgtttaaacgatgtcatttgatttgcatgtatatataggtatatatgatgctcatgcaaagaacaaaaggccagtttggttagtttgttcttgcatggatgatcatatatatatcttatttgctctcgacgatcctttcacgtgctgccatgcataaataaatagtttatcagatattagggcactcaacaccaacaagatgtcgatcgggtaagagtggaagatcatatgaaaataatcaaaagtatgaactgcattgtaacaccctccaatatgcagttaagatcgagctgacacgctgcattatgcatgtgctgatcagatcatccggagatttgatctgtgattgcgtatcatggtcacagaattaagcatttttgctttgtcaggtggactcacacgctcacacacaaactttaaccaacagattaaattaaatttcagcttgttggtcaagacagcccggagatgggccctcccaaaaaaatagtaactgagaaaatcacatggtatcagtacgaagttttagaggattttattgccgattaaaaatttaaaataacctcgtctatatattcttattcatgtaagttgagtattgccctctctcgtaaattaggattgacatacattatttttctattacaggaagaacgcatattcgtaaccgcactaacgcctccacgaatgcaccccttaacaatatatgctcaaagagaagagatagaaacctctctagccttactagaaatcccattgtgaaacgggatggacctgtggcaactcattctcgctaaaaatattatggtttgtgagactgcatcccataacatagtactttaggcatcacgatttaaaactctggcggtggagctatacatacaccacaactctactcgaatctggtgcttccactaatatgtgaatcttttttttattgctcaaaaaccgcatcatgtatgcactcaccaaatttacacatctatgaatcatgaaagtgtctcttaacacatgcttaaagaaatgaaaactagtgacaattccctagcctcttactgattaaaatcctattgaaagtgtacatctaggctagtcataacccaaccttactaaaattatattaaaaccgcacctgcatgtatgtagtatttctaataaccggtggtggagctatgtaccacgacgatgcttccactgacacgtgaaatttcaagattagttagacgcggaattatctcttccttatattctgcaggtgcttccactgacatgtgaaatttcaagatgaatgagacgcgaagttatcccttcctcataatttgcatgactctatcctatgactcctgtcacatcctcaaacatggctaacttcaaagggattaaccattcacatgcatagcataacttgttggctacatgcatgcatgaaagcatgaagcaccataattggacagcgcatatgaacaaatcaagaaaagaaaaccatcaatccattgtattgcgaccattcaacagggatggaggaagtgaattaattcccaaagttgattgattgattgggccgtctttccaaacctgtgggtaggttgcaaccatattcttgatttactttttctgaagattatgttagataaataaacatgcatgtgccagacgtccaaggttatccatttttaatttccttttaacttctatatgtagtttctttatggagaaggttatgctccaattgtatatgttgacttcattccttacatcaaattggatgcttgatcgtgaaggttatttggttgggagaggagggtgcatctgcatttttaatatatgtccttgaattagcatatgtgttttgtgccatttaattaacataaacatatatgtttttcctccgcaaacacactacattacacatggcttttcctcggtgtcagagacaatattgctacagtatttaattcccaaaagggttttgattaagtggttgttaatttggtcgacagaccaaggatgcacaaaatgcataatcttgtcaaactttctgtggggtacgtatgtgcatgctcgttacccacgtaaaaactcatttttatagtttatcttttacttgctagtacaaaatttgaaacaagaaattaagtagaattaggataggcaaaaagaaaaaactcgtttgtctgtccacttgcatccctacttttctaccactcttatcttaagatatgattagcgaaatgatggcacatattgtattagctaggaaaaaatgtcactttttttagtgaatgactttagggtaaagataaaagagaaaatacttttataggtgtggttgtgaagtacaaatgagttgtctggttaaacttgtttaacatgaagtgtggcaaggaaaggcaatgttttgccattaccaattatactctgatagacctaagcgccatttaggataaacacatctaaaggcccctttgaatcgcaggattgagaaaacgtaggaataggaaaacgtaggattttgatagaaatgtaagtgtaaacagaggataccaaaacgcaggaaaaacacaggaatgaccgtttgattgaaccacaggaaaaacacaagaattggatgagagagatagactcaaaggaaagttagcaagaggttgaagctcttgctaaatttcctccaaaatctctataggattgtccattccataggaatttcaaaggattggataggattcaatcctttgtttcaaagggcttcataggaaattttcctataggattgaaatcctctaaaattcctatgtttttcccccaaataaaaggggccctaagtgtatacgacatcgctagctagttaatcactaggcacttgaaaataacttgttagagcatcattaagagtatcccaataatcaattcccaaaacaatgttttttggatctcataaactgaatataggaagtgagaaaacctatctctccaacagaaagcttcattgatttcctataatgaaaagtaggccatccctttaactaccaat

SEQ ID NO: 5033 - DNA, 675 bp, Oryza sativa
cccaacgtattctgggtcatcgtagtcccagtccccaaagttgtagagatcccagtcgatcttggcccatagttcgtctatctgagcctcgcaggcggccgactcagcgaggtaactctcatcgaccagatagtagccatccttgtcgatgccgtcacggacatccttctggagcttctccaagtcgtcgtccagcttggagcggcgttcagcactcttcaattcctcactgcgcttctcaggcgagagggagtccaggtactcgaaggtcggccatggctccctcttcagtgccaggatcatggcgacgaaattctcaggcatgggcaccttacgcttctggtcgccttctccacccgcggcggcgacggcgacggcggactcggcgttgacaacctgagcagagccagtcgccttctccctcttcttgtttgcgtcgcgctccttaagcggaggcgccgcttccgccttgccgccgccgccgcccagcttactcgcgcgctccaccaccaccgcggtctccgtcgtggtaccctcctcaagcgccgcctccgccatgaactcggtgatgcgcggaacagcagcaccggccatctggaatcgccagaagatctctctctctctctctctctctctctctctatatatatatatatatatatatatatatatata

SEQ ID NO: 5034 - DNA, 878 bp, Oryza sativa
tcctccaccaccaccaccaccacccaagaagagcagtccgccgccgacgacctctcctccctcctctccacctccacctccgacgagccctcctcctcgaagaagaagcggtcgaatagcagcagcggcgcgtcgagcatcccgacgggggtgcggctggagggcatcgccaagtcctacaagggggtgaccgtgctcagggacgtttcttgggaggtgcagcgcggcgagaaggtcggactcgtcggcgtcaacggcgccggcaagacgacccagctccgcatcatcgccggcctcgaggaccccgacgccggcgccgtcgtcaaggccaaggacaacatgaggatcgccttcctcagccaggagttcgaggtgtgcgcgtcgcgcaccgtcagggaggagttcctcgccgcgttcgaggaggagatggaggtgaggtcccgcctggagaaggtgcaggccgcgctggagggcgccaccgaggacatggacctcatggggcgcctcctcgacgagctcgacctgctgcagcggcggtcgcaggacgtcgacctcgggatggtcgaggtcaagatccagaagctcatgcccgagctcgggttcgctcccgaggacgccgaccgcctcgtcgcctccttcagtggtgggtggcagatgaggatgtccctcggcaagattcttcttcaggtacagataaaaaagaaaatttgagctctacatgtagcaatcaatggttgtcatattgtgatggagagaaaaatgagtggtattatggccaattggtgatgaatttggtctggattgttgaatttgaattgtagtttttagtgtctgtgtgcatttccaatgctgaaattgattgtgtgcaggatcccgat

SEQ ID NO: 5035 - DNA, 12496 bp, Oryza sativa
aaaagtcttttagaagattgaattcctccaaaatttctccgagaaccgaagggagatgggggtttgttccgtcacctctttaatttgctttatccttacgtacacgatactcgttaactatgtgcatcgatgatacagaggccagacctaacgaacaatgggcggaactaagattccatggtttcgttggatatatatatttaatggtggagaaataaatcagaatcatgtctggtcctccatgataattgctgcctgacatgggacgacatgcctcaacttgggggcttggttttcagctgctagctgctagcaaacgatgtactctctctgtccaaaaaaaactaacttacgtgagaatataatttcacctaagataataaattggataaaaggttgtccagattcgtcacctagattgttttttaagacggggaaagtaatattagtagtactccctccataaatgcttatattttaggacgaagtattatcccgcaaatgcatcagtagtataaactctcacaaagtcacatggatgggatggtgattgtgacaagtacagttatcagtgcaggcaagtgaagatatatatacaggaagaaatgggattaagacaagaatcaatgtatgtagatgctgttatattagtagttaatttcatgtcaggaatggtttctgcaatgtgcccacatgttgtgaaaatacttggaggatatctctgatgaatcaactgtgtcaatcagcaattgtatcatatatatgctctccaagtttccttcgttttgaaatttgaaggatttgtctagttggcgatttgtgatatgtaagaatcacaaattcagagtgtattcaggccaacagacaatctaaaaggcacatgatcaaattttgagatgttaggtgcagaaatggagatggtaatatacaatattttcgtaaaataagatactagtacaatgtattttttgtaaaagcaatgacaaattcagtatgatgtgtagttgtgtacagatccaagtgtgctggaaagattaccagaaaaaaagaagagagaattatccacacttctattgaactgttacagcattttgctaggataaatgcacacaacatacaaattccattccaggggttccctcgccatgctttcaatattcaggcctcagcaatcaagtcagggagaagcttgaacctgttctgctgcataacagagaaaactgaatacacatggacaggcaagtatgtgcaaagaatgaagaaattcaactacaaatttaactatgcattctttctctttctgtaaggactgaaattttatgattttatccttgtagccaattgatcagcagatcaagtcaattttatgattttatccttgtagcccttactacttgccaatgaagtactgtgctaaaaggtccgcgatagagtttttttgggaatacgcaagcggcgcatctttgtattaagaggaataaagtttataaacaacggatccgaaaactgaaaaaaagaaggggacaggttacaggacacagaatggagctaaaggcctaatctccgactagattttgcgaccggggaaccaagctaggaagaggcaattctggcaccgctgcatttactaagtgccatagttccgcctcggcagccataaccttcgccacttcgacccaaggcttctgttgttggttgaagaccctgttattcctctccttccatattgatggagaatgaagacttattgatggaagaaataagagatcaagaaataactactttcatttgcattatctgctaacaacgtcgaatctaacagttgagagaagccattatcattcagtaaagactgagttatattacttatatagttctagcgagattaatctctacagggttgatgagaatagagaaccaacagcctgctatccgatggtgactcccggattatcattaaaacaagacagtactgtactaacacctattagtctataacaagcattagcatggcactaactttgttgaaggtagcagaagtaattaatcaatgaggatactagctcacaagctcagtggtgagatcaatcattaaggaaatactacagagatacaagatgaaactacatgttcacttatatgttatatttttggcggacagccgaaagattggccgacaaaatttcattaagatttagggaagattattacatggttttgtcatgacattaaatgtcgagttgatggtggttaaatgaaatttagacaagctaattgtttaagcgctaccgaagcttttacatgaacaagatcacttttgattaaccaaaattaaagaaagatatgctctcctgtctaaaaattggcaaactgataatcttctgacaaacaggacaaaactgaaggcaagaaagaatcaatattatttggatatcattttcattctaagtttctaactaacaagttgccattttgtaaatcatattctaataaaaatcataaacaagaaaatcacctaacataactccagcatcatgcaaagcactttcttctctgcaaaaacaaacataagttaacttagttgatcacatgagctatttctttggaatctgcattgaagtcatagcgtaagaagttttccccttaacatttctagcataagattctcacccatctctcaacttctgatgctgattcagaaagtctcctcctaagaatggacttttctgcttcacagctctctaaatcaacatctgcataagataacaaaatgtccagaaatgtgaacacttcaaatccgaattacaaacatctacatataaaactctgtttatgccggctctacacatatgcactataaaatatatggataaaatatactgcatatggatgtgttgatataaaaatatagagaaacattggaaaatgtaacatagaacaggtcaaaaaatatatatatcagaggccttaatcaggacatgcgtaataaacatggcatgataaaagcgctagacaacttgcaagtacggtatcagaaatccgaatatggtaagacattttggtgattgggcagagatcagaataattgaactaagaatatggcatgaattaatactacttcattattacgtaaaggtcagaactttagatgctaacattatagtttcttatcacatgacagggttgctttatcagcgtggtacacacctatctaatctctatacatacccaatgccaacaatattcaaatttccacctgcctgttccactactagagcaaattcaacatttgaatggtacaaactaaaagcttgaaatctaaaaacatatactatttattaaaaataaattctaaaacgttgtaaagatgatctcatctcaaggacatgcattctaaggaaacacataacactgtatgtcaaacattatgtgttacataatgctaaattgcatttggtttgcattataagattttagaagcaccaaaagagataaataggagataaaacaagaaacgtttaattcttttcaattccttaccataatagtatgttgacagaatgctgatacgctcaataggctgaaaataaccaaaaaaaaaatgttaatgtttcatttcatcatttgtcatgtatgtaatacactttgacacgaagttcaagaatataatagaagtgataagattgcgtaagggttcaagtatttctaaagccatgcgtgttcagtgagcctgcttggacaaaacacacactaatgaggcaaaaaaaaaaggaatatctatctgaccaaaaacttgaatacattattttaactacaaaccttttacagaggatttgcagcagagaaatcattatgtgatttaaggaaaaactaaaggatgttttatgcctacataaaagaaaatgctgtacattgcaggtggacgtatacataccattacaaatatgccttctctacgagttggaagttgctcaagttttcttaatgtatcatcaccttttgtgagccttccaaatacagcatactgaaattattatgaatcaatgtttaatcatttaagcacctggtatttaatcatgaaccactgaagaaattgttgaacacctgtccatcaaggtgtggtgcatctccaagaaggatggaaaaggaagaaccaccactgtttggatcagagtgccttggagaagggggggaaaaggtgataggtgatgttatatcattgcaggcatatgaaaataagtgatttcataaaaaaatcaagataaacgccaaggaaattagttcatgatattttctaggactactttgcccaataactatcgcattcattttgatttagacaaatagacaaattaactatggaatatataaaggatcttcttcaatacctatccttttatcaacctggtaatcattgataaacttttgagggattacagaaggtactacatgctcatgttgttttggctataaccagaaggtagcaaaagtgatctgttaaaacatcaacaatgtattcacaaattgacaaaggaaataccttcccatggacagaatccccctgacatgcttgacagtactaaattcaccaacaaccgatttctctgcttcctcttgctgctcatcattcatgggggcagttctaccacccacaacagaagcaacttgtgcaacaaaacccttgtcaacctgaacccagtcatcgaccctttacataatgaaactgacaaagtcgtttagcaaaaatgaaaggttagcactaagaggtaattacccggaaaaagtgatttgtgttgtagcacccaagcctcacaagtttgtaaatgtgttcaactgtcttaggagcaacatgaggaaagaagccaaactcaatgtcaccatgagttgtctgcagatcaaattgcctaatcagaaataagaacagatactaccaactttggatgctatagaaccaattttgcctagtgtgtattagctgcaccaggacattagccaaggcatttcataacaaattgaaaaataaaatgatgtgatattataacaccaatacgagatatagaatctgaaatggaagaacatatccaaaatattaagatatcctgttattttaaatcctgattaacgagataattagcttcagccctgtcaccggcttaaataataaagatgcatacttcctcttcctcgtaagtgttcttgttcatttttaggaaatcagaagtttgtagcaacgaatgccacatgagactggttgcctgatcggcgtcctggcattctcccaattgcacactaggtggcatacatctaaattttaacctaatcctagtaaaatctcgcaataagcataggaacggacagttcaacactgcctgcgcatgaggattgacaccttgtaccccttgttttgcaacatctaattgcaacacaactcttaaatttccaacacagcactaaaccgattctccaacagtcggacgaatctggcgaacagcaagagcaacggcgtcggaattcagcgtagatcttcactcacaactcacaattccgaaatctttgatgagcctacgaatctgaccgtgccaaaatccgacttttggccccgttttctccatgaaccccggtaaaaaccgctcctttcctccctgatttagaacagcaactcgggaaaatgagggagatcgtggcgaacctggaagacgacgcgggcggatccgaggtttgggtccgaggcgtagaagctggtggcgccgtcggtggaggcggccgccgcgatgaggaggaccacggccgccgccgccgccgcggcgtggcggagcaaagccgccatttttttcttcccagttcccacctcctctctctctctcctctggtttagctgcaattgtgtatactgcagaactgaggagagacacaaagacaagtgattttttttaaaaaaaaatggttatccacaatttcacaatttttggcaatctttttacatctcagttccctttcttcccatcacaacccaaacctccaggacagccgccaataggtagggagaatagtgttggctgacggggaaaagctcgacggcggaggccgctggccgacgtggctcccaacaatctggagcgcgtgcgcggtgcggcctggtcctacctgtaatggcaatgtcatctttacctacgcgcatgagggctggggcttccgccttgtcaccttgggcaagctcctatcccggcccccaagctcaaagccacccccgccgagctgctcaaaaaccgatgtgttcagatatccctgagctctgcctctccttcatggaggagcactggtggctctaccgcatcgtctttaaggtcaattccatcttcgcgccgccttccactatcaagcttctcgacagctgcaagccttctccccgcccatcgctagttgtcgtcgtcagggttctacctaccgccgctgcccaacggccgctgcccttctccctatcggtcgccagccaccgcacacctcttccgtgactcaacatccaatgtcctcttcatgcgcacggacgctcatggagccagtggtgctcgggatcgtgctcaggcatcacaatgtactccatctcctgtctcttggagatcttctcgccaatcccaatggtgtggctgacacgcgaccctgaccgagagagggaagagcgcgtgcgctacgtggatccggtctgcggcggcgtgcggaggaagagatgcgacatgagccattggatctcatgatcgtacgatttagtattgcgtgtatatgtcagggttggagtcaccgtcaccactatgcttttttttaattatattagtaagtatatattattccttccgtcccattttaagtacagttgtggttttttttccaacgtttgaccgtctgtattatttaatttttttatgattagtatttttattattttagatgataaaacatgaatacttattttcttaagtttttcataaaattttcaaataaaacagatggtcaaacgttgaacacttcaacgtaaactcacaaaataggatggaggaagtatgtgctaatttaccgttctgatttacttgtcgagggaaaaggttcccaacacccttagcttcaaactcacccgagttcttctccctccatccaagctcaagctaattagccaaacattgaattcaacatgaactcgggttccaataacaagttggaaaactgtcctaaaattccaactgatgtttttgcaaggcattcttccatgggcccttggagcccaacgggccgagccggcccaaatccttctctcttaaagccgaacctgatctcgtcactcattgaaactagcagctcttcaccgtcagcaacaacagcatatcattcattatttttgtcttatttttctcctctttttttgcagtgaaattaaagcttctcgatttcgtcttctttttggccatctctcctttggccttttggcaacctaggtagcctctcgatcgatcgtcatggcgtagaaatcatttccatgtgttgtacacggtgcatcatttgtctgcactcgcggtagagtacacacgtacatacgtatacatgtattttatgtttgtatgtatgtattgtgtatacctccttttggtttttggtcaaaattaaatgatttgtttgtacgtccttgcacaaaaaataaagccattcacgtacctgacatgcatattcttcctagtatgatgatgtgtgtacgtgtatatatgctttaactttggagaagaaatatttgtaacgaattttagttttaaaaaaactatgggtttgtttagtttggaggtaatttttaccctactaaaatttggttacttagtaagtcttgacactatcaaatttgattgtagcatataatttgaactagtatgaacaaacattggtagcaaaccaaatatttgtttgattttagataatggaatagaatatccccgtctttgctcaacgacagcaagcatatcattttgcttaatattcgtttgatactactgaagttgccgaaattttattcatgcagaaattggctccaaaaccaaacatgccttacatatcttgcggattttcaagcgtaacttggcgtgcagataatttttataattaagttcaattagatttgatatacactcttgcttgtgtgttctctacaagtacattttattttgtaatataataactatatacataattaatcatcatcgttcagcgtcaaataagttgattctttgtgtgcctttctgtatgtttttatcagcctcatctttttattatgcttatacttattagctaaaatttaaatttttaatctaaaatttaaagttgattttagggtttttcatcgtagtttattttttagcatttgtttttagatcgttaagaaaatgaatataaaaattttattcacaaattatttttcatttttcatttacagatatgttgttttgctttttttttctccaatatgccaaacaatgggactatatacagatatgtaagcgggccgacccacaaatctacttatttgtcaataagtggtaatccgcgggttttcacgtcatagtctggcttgccgcacctagagatataagtgggtcgatccataaactcatttatagatcaaattagtaggtaacccacgggctatccactaattttgcctataagcagcttagcctgcttacagcctgtatatttttattgattgattttgcatgtatatatgaatgcatggtatatgatgcatgagcacaaatgtatatggttgcaatgcatggtcagataatctatgtcatgtagcatgatgatgtacacgtatgtacttttggggctaccctctgtggtccacggtatgacgaatgcagaagtccagaaaacgaaaaatggacgcttaaattagtacgttacacaagtatataccaaaaaatgcatgtttgcattgtgtgaaggaatttcagacttttttcagggtgaaatgatatatcaatatatgtgttcagtcatatgcctggtcccaaaattggaaaactaaatattttaccatgcctagctaggcttcttcacttgttaatttgtttgtttgtgcaagtgcactccaatcatcagcagtgcatgccttcataattaatttacagtctagattgcatgcattgctagctactttctggtttcagattgatatgtaaagctgcattatataatcctgttatgtgaatacatcatctgtggtgtgcatgtttacatttggggccacttcatataaagtccatgatgatgtgaccaaatggaacactccaaataggggaaaagggtggttataggctatacggccagcaattttggaaggaaataaatgtaaaccataattgtttaacaaaggcctcttagaggaaaacacttttgctacatcctcacacatgtcgacgttgaaagaacatcctaaattttcattaaatgtccaagaacttcgatgtgacaacgcgcataagaaaaggaaaaggggaaaggtaatctagttcctccgcgtcgtcgatcaaatttttcgtgagtacatgatgcagtgtaaacctatagccctttataaatggacaaattattccttctctcaccctctctcaccatatgaattgagcatccataataatgcaacaaaaaagctactgaccaactgtttttggaatttcttggacactggagggataggatcaatttggccactttttccccagaggcatttgtgcccttgcttgtgtgggcccccagctgcttgcacaccttgcatcatgcatcctttcaccatttgaaacccatgagcattttggcatgctttgaggtgttcttggtctctaagcaatctccctttttttttcctctttacttgccttgccaaactacaaggcctactcttcttctctcttagttacatggaaaagacaggccagggggtgcctaggctattaggtgtgtgccttgtgcactctatggtccttagttgtcatgaccccaagaatgggctcaaaagactttagggagaaaaaaggtgccatggagtgtagtactagctacttgtacgttgtttttagtgggatcaagcctctttaattttatttttttccgaaatggagtggcagcatgctgcgtgtatcaacaaatttgaaagcaaaaataatgtccttatttgtgaaacttaattttcacttaagagtagtacatacgtaagacatgttcaagatatatataggaataataaaattaaaaatcttgtaaatataatggcacacaacgttatcttaaaaaaaatgctccaacacttgaataagaaagagaaaaaaaatatgtttaaaacttatctagaaaagcaaagaaagggtgagtcagatcaaatgcgggtataactcacgaaattgtaaaaatctgtgtgtgtgtgtgtgtgtgagagagagagaggcagatacaaagagagagatatagatttggaactatccatgaaaattttcatgatctcacctcattttcgatttccaccaaaccatatataggggaaaataaccaaaagagaatgaggaaacatttctccattttcttttactgaaagtattataggggaggctctcatcgtcaaatttattaaaagatgttatatgtgtgtgcatgtattctagtgacggttagttaaaaaaaattatgtacaaagattacaacaatattcctccatttcgaatattaaagaaaatattttgtttggattaatacatgcaattctcccttttcttttctcatttttcctttgatccaaactggttctaatgaagtattacttaataatatttttaggagagtactagctacttaatattagccattttttaggaattgtttttttaaaaaaataccttatgaatcacttgaagtttgacatttcaccctataaatcattttgttgcaaatatttaccccatacttgttgttgttattgtttttgttgttgtcagtccacacatgtttaactcaatcaacatgttttttttaccaaaactaaacatttataggagtacacttttcttggagattccactaatagaattgttgctgagagcttaaacattatcgtaccgagttttgctatatgtataaaaagtttaatgaaacatgaagaataagtctaatgcaagcacttggataaaattgattcggctaacttaacctgtggttactctacatgagcgataaaatgtctgattcggttaaataggtgcgcaattgggtggtttttataataaaaccgaggaggtgggggtggatatttgtaacaaaaataacttaattatggaatgaaatattaaattttaaatgatttatgggtggttttccttttattttaggaaatattagcgtggttaatatgcgtagacatatttggtcaataaccagcagtgaatttgtgttcatgaattgaaaggcaagctgggtaagacactcagctcgtgtcatcatcattaccagtcaaagtgacttaagactgcacttacgtgcgtactctttaactgcggcacacctaattaattcgcattaaccagtcaaagaaaattgagaatatctctttaagtggttgattagctaatattttttttaccctgctgtcaagtgtgcatatatatatgcacgctgacacgcagtcaaaacataccaacaattaaaatgttgtatatttgcctctgtcaatactcaagctagtcactgtcattaaccggtcaaaagtgaattaagagtgacactcacgcactagttaatgctcctatagcccgccaagccgccggcaagatattaatataatgttgaacttttttcataattgtcggtctttccaaggctgacacttgtcatgatctatcatgatgctcagtaagaatggattattggcacaaaattattttctaattatttatgccgcacttcggaaagtgcattttttcaaaaaaaaaaaagtcaacatctgcatttttctagactttgttttaagctatatgttagatttatctttttttaacggaaagatttcattaaaaaattaaattacaaccgatctctgcaactatttgttagatttatgatatattatatttaattctttcatatataaaaggaagataattcatcgaccttctgccttcatccacatttctctagtattataaaaattgaagatattttttgtcggtacttcgataagttatccgtgtttgagtcagtttttaagttcgttcgtttttgaaatacagttccgtatttgagtcggtttctaagttcgttcgcttttgaaaatacagaaggagttgtacaagaaatctgtttaaaaaaacccgcatgctagcttgagacaattggacactcaattgcagctcatgatttatatatatatatatatatatatatatatatatatatatatatatatatatatata

SEQ ID NO: 5036 - DNA, 10017 bp, Oryza sativa
  unsure (1)..(10017): unsure at all n locations
ttggacatcgatgtctaacgacatgctttgatcaggacggaacagttaaaaccatccaggatgcatcatatgtacgccatgcattttcaatttaattaccaccacgcatgaataaatgattgtgactagccggctttgctacaagattaaacctaagcttgtttttttaataatgacctaagcttatatatgaaagctcctaatatctgatgtgacggtggccgtggaaagagaggcttcatgaatgattgcgtttaattttttttgtccacgaccgaaagtattgacgctgtgttgaacggtgtggatcatcacccatctctgatggagatggcacattggagatcatcagagagtgatcactagtcaagagctagcagcaggaacagaagaatacacacacgacattagtggtaccagccatctattttctatataaaagggggaagagaaggagtctcggagacgcgtgcatggatagatgagttcttagctaactgtaagacacgtagctttctccctgattttgacatgcatatgtgtagtttacgtggtttgttcacattttttggtcgtcatggttttttgtttgttgacgatgtcaaactgttctattaaccactagattggctttgagatcggcggtatggtctaaaggtttgctttgagattcgttattaattatatggtttattttctgggagctaagtaaatggaactgatcatggtggatagtgactgcatatacatgtttccttctacatgacacaacatgagatgattagtagccgatcacttcaaactttaccttccaagctttaacgaagaatacttagggagtgcatgcatcgagacaatatttgtgcatgtctacgggaagataatctagtctggattaacatgtgttatatattaacttattttgacccatagcaagttttcttaccctagctagtagctatctattttgacacatgtccttgatcgatcctagatgaatgaagcaccggtcaagatgtactacatacacacgcacatgcacaccaaaacaaaatgaaatgtttctaatcaataggaaaaaaaagttttccattggtcaacctctttagctctagtttgggtttgatttacaccctataatgtaatacccagtggttaattaaatccgttgcaaattatgtccatataactgttcaagcgagcatttcttttggggcgccactccatctatcaattcttttacacatgccatcctcatgattaaattaattaattgtagaattctcgcatgcatgcatgatttcctttcatgcatcgatcatcaaatcgcattggcccacacaccatgtgaaatgccaaatcactcaataggctcacaaccatccttggacatgatttgcatttttttatagtaaagacattttctaaattaaacaatatcaaataaattaaacctgaactaggattgatagactaaaattagactttccttacatctaattaaacaagttaaactattcatatccccacaatcaaaagattaaataccttcttggaacgggttcgtatcctctaccataatggtactaccattataaacactaacatgtggggtaatagaatagtgtgacccatgtaacagtgattttggaattttgcatatggatttttttttgctggattttaatcaattgatttaattaaaaaccctgcaaaattctaagaggtctaaacttaaactactcattcaagcattaactgtaattaaccatgcacatatagtaacagcttctagctgcgtcaattgcgtccctctccttctctcttttcagattccatttcaatatatatatatacactatggcacatgtgggaaataaggctggcaaactctcttgcaagtggcaagcccttattagcagggaagcaacagcagccaatccaaaggccctcgtcgcaaagagactggttccgttcagttcatcgccgtagaaaagcaacagcgaaagcgtcacccccttcttccccgtttgagtggctgccaatagacctccggttcgtgtcaatggcggaaacccccccctaaaggttgcaatcttcatgcatgcggtgatctgctggagctagcaccaccggcgccagccgcctgtcggtgtcacgcgcagctagcgaatagcgataacacatatataccgacggggttgtggctgtacttgttgatatatctttttctccgcagcaatgtgcggggtgttttaaaagtaacccttggcacgtcgcccgttgtggacggtcgttagaacggtttccccatcgtggcaatggtgttgtcactaggacatctctccaaggattgttcttaattggcgcgtgagcttttacttcgtgtagagaagtttagggtgctggctcgaaacggggtttgctgcacattgtgtgatgtgaaaggtggctttgttagggtgtggctgcgcatcgagggtgttgcctaactagaaaggttttgcttaggtttgcaattttttttaggctgaccaagataggtgtcgtggcttgttttagtggtagggttacttagtttagcacatgagaagattgataaccaactttaccctactcatttacatgcagcatgtacgtgtgtgtatgcatatagctgcatgtgcatatatatctaattttttgaatcaattaattagttattttgttgataccaaagttatcttaacttttaaaggaagctaaaatatatttaacctgacttgctgaatgtcgtgctttgcaacggatgaaagaaaatatactataatattatataaaataaataaatatatgttttccacaaaatatggtgttcctatccttttgctctacgaaatatttatcttaatttgattttacatgtaattatccatttagatttgattgtcttttaatattatgaagttggaatagtaatttgcaaaaattacaaataaagtaggtgaggtggcagattaacaaccaccacgactactttttttttaaatactaatatagattatccactaacaatgctttccaggtggtaataattagttcacgccctccctctaaataattaagcgtcccaactgggatttcaatagaaatttagtgagatcaacgatgtatcattggtgtttcattggtgtttctatctctttcaatgcgggttgattaggggacacatttatatatgtgagcgcgttgaggactgaacacaagttctctacttaacttggttatcaaataattagaaaaaagcttgagcgtgttgagaattgaacacaagattatattgaggtcaaaatcataaactcatcaccactacactatcaagttcatttcttctctactgtgtaattaaacttttgttatagtgtgccaataaaaaggaatagggttaaagctggccttctaccaaatattctcatatttgtttcatcgtataattgtttaacattgtgtaacgtactaaaatcaatagataattcggaatgatatatatgctgtctacctcaggttgatccaggaagataatcataattagacgaccacaacgtgagatatcttcaaaacctttggagacgcgtgagtacgcgttagacaaaatgaaaacttaattaccatgtgctcgtaaacgttagcatcacgaggactaagattcaattacgctcatgtactctccctttgaccatttcaacttaaaattgatgttttctctaacttagtacttaattaactagtaatttaatatcattaacatatactccctctatccaactgaataaggcgtgatcagatttaactcggtctccttaaattttttatatactataatgtttatagcaacaatataataatcatatgagagcaaattcaaatgttaatataataatattatttttatcaaataaaatttaatttataataaattattttttgttcaaatgcttaaagagctaaatcttattccgtgggatgaagggagtaatagtttatctaaataaagatcagttgaagtttctcactttatacataatgcatcatgtacgtaattaaaccgagctctgtgatgaaaattgtgcagtagaatttaattcctttaatttcatttggcctctcctttttggagttcgaggtaaatgtacgcaaggcaaaatcatccatggtacaagtagcagaggaacaaaaacggcaggcagtacagagtacactgtcaaattctaccctttttgggaatgaaaccccatcaaatttccatcgtggagaaaagggctctgtgcctctggtgcctgtcccttttgcctatcacaggataaaaaaggcaaggaccacacagcaactactagtgtaaggttggcatacaaagctgcaaattcaattgccccaatttactactactagcattgaagtatctaattaaaaccccacattaatgtgggtaaactctttgcgcacataaacgcaaattattctcgagaggaagaaccaacaaaataaacgttggaaaaacaaacccgcttaataaaaagaaccggttacgtaaaaaattcaaaaaggacgtacgtgcggagattggttatgtggaattagcgattgaagatgtgcgtcgtggttattccaatgcaacctttttggagttaatgttaatatctttacctgtcagttgattgaacttaacaaagattgactaggaaaaatatcaaataacctataatatgaaacggagaagtattttgcaatggatcacattatactagtgtatagtgttggggttggggaggagttgcatggtacacctagcctgagaaccaaatatgatggtgagacactgagtcagtacttctgtactgccttttgctccatccaaaatgttttggctcgagagaagtgtacacaatttacgagagtaacaccagctatcaaagtagtcctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagtattcacttgcatcatgtatgagctaagcttcaccatcgctttcaactaacgaggggtaaagtggttagtttcatcggttaatcaaacaacattggagaagctgtaactctcgtagatatatttgttctattggcaaagcctgatacacactcaaatgagttgtgttgaacctctcttctctctgtaaaaaacaaacaatttctagattttaatttttctctcaaaatagttgttttttctctcttttacctatcctctatttgtaaaatgagaagttttatccctttaatactccttacctactcaaccaccaactacttttctattaatgattttggtcatttttcctcctactaaagttgtcttggaataagagttgcttttattttggaatatacacagggactacatgtgtctaggagaagctgatgacattgtccattactagtacagtagtacttaagcttttcctcttgttcattataaaatactttctaaaattattgaaaacgaaatattattttagcctttcttactagcatactttgtataaattctgaaaaaaaaggcttgaatatatgaaatatatagacaagcttggatttattctatatttcttgatggcttaaaaatgaagaaaaaaagaggggagaaatcttcatccagtctcttatgggtgactgctaccgattcaataagagtttggcctaggaaccattgtttaagtcggtgttaatcatatctttttcattggaatatatcgcgtaaggttcctattgcatgattaaaaatacatcttcccactgccacaattgataatgtaaatattccattatggcttgacgaactgttaattgtgactattaatactatgcatatgttgtatgttgtcgtgtagctctttgaacttctatttaacgccttctatccctttgcgacttttcaatcgcaagactgggatagagggttttccttttgctcccatgtaaccctccttcgtaggtaatgttattcattcctatcttctataccacttattttcataagtatttctcatggaattcaatctccccctctgatctcctttcattttctttgctttcaatactctggaaaatctcttttaatatcccatggaaagtctcatctagaccaatgttgtatatttaaatttgtgtcactagcatgttgtttgtgcgttacatgagattttaattaaagaaaattatcattaatcagttattaccatcttttctgtatatatcatttcttaattgctgcatatatttgttactgacatgtgaatcctttgaccttacaatatactttttcctccccacagaaagtaaagagttgttaggggtggttgacatgtgtgagccctctagccccacctatcttttatgttttatgctctcaaaaaagtagggagttggtggtgccaccaccacttcctccttttcagagagtatagatatgaaaaacatggtctagtatgtatgatattttgccatgttggagatcgatcgatctataagatgatttaagatagttttaagcttcttactcatatttatatttttcttctactaaagtttgacaatttacatttaaccataatatcatagcatagccatctcgatgttttcattgaaacatttttagacacacacatgccgtttccttcccaatcaaaataaaattctaccaaagtattttgttgatacttatgcagggaaaaacaaaacatcaattgttagatcaaacatatgtttcgattcattgatgtaagatatccagccacaaaaatatcaattaattcaccagctttcattctcttgtaaaaaaatattaactctttgatgggagatatgaagttgaacagtaaaaactgcaataaataaatgcaaaccttatgcatataaattctaacatttaatttaacaaatacctaccaattatatatatccctaacattaatacataaacaccatgtatatgtgtttaatgttagagatacaggtggtgatgtgtaattttgtctataactattaatgttagggatacgtctagtttgtattttgtttgatagcatctttaaccgtacattcatgagatgcaggtaaattaaatgtttgagttatatcttgtttgtatttttaagatatgtagatttttagtgttggagatacaattgttatatatttaaattcattcatgactagagatacgattaaccagatatattcatccatagagattagtgggtatatttggttgatcacatctgcagccatcaaagaatttaaagatataacagttatatcaccaacattaaaagcctacatcttcttaagcatatctttaaagatacacaatccagcaaaaaaaaaaatacaaacaagacgtatctccaacatttaatttacctacatcttttaaacgtatcgttaaagatatcctctgacaaaattacataccagacgtgtatctccaacattaatagttgcacacgaaatccaaaaatatacacatcacccccctcccctacatctccaacattaatagatgaatttccctcacatctcccatgtgtgcatgcatctttttttgttgtttgctggttgtatggttttttggtattaggctaaaactgtggttaaatcagtggtataaaaaggggtagagggagggtggcctccatcagtcaccacaaccccccccccccctctctctctctctctcctctcctccatatttttctttctcatctcatcacacttggagtttgccaatagaatacaaaaacagcaggtgaggagagaggagagaaaaaaaaacagagctttctctctctccctccctctctctctctcttcttccaatctgcggcgcgaggcggaggtggtggtggtggtggtgggccccgccggcgagatgggcccgtaggcgccggtgtgggcggcatcctgtcctcgccgaccacccgcccccgccggtgcggcctcgccggcaagaagtctttgtttttcttttctttttttttttcatctttgaaggtgcgtcgccgactacctccttgtgcttcaatctcggttcgaatcgaatggaagattttgtttttcgtgagaaatttcggggcttgagatgaacacatgggcgctcgagccaccccggtgcttgtggggagcagacagatttttctttcttttttttttgggttgttgttgttgggtctatttgatgcagggattaggttgtgtagatcttgtttctgaaacgcttgcagtttttttttgcggtttttttttctgtattggttctgatcgttttgtgtgctgtcgttgcagattggatccttaatttaggggcgaaaagaggggagtttgcaagaggaatcatccctattgggttgtttcttgctgctgggtaagatccaatccagcctctaggttaggtttgtttgctgttggtgaggagattgaagggttggctggtcatgttgggggaccagcgcaggaaattcctgctagagtcagcgagctcatcatctgaagaggttgtttcaagaagccggaaccttgcggttgagagctcggcggtggcggtgacggcggcgggggtgaggaagggagaagaggtggaggaggaggagctcttgaaccgtagaagcaagaagaataaggttgccagtgattcggggaattccggtaccggagtttgggactcagaaatgcaggatgctgatcagaatggtgaagccaacacaagcgagctcataggcgcgatcgggcgggagctggccattacatgcctgctccataccccccggtcttattatggtatgatagcatgcctcaaccggtccttctgctcccttatgaggtccgggcagctgtatagattgcggcgggaggctcgcattgttgagcacatgatctactgctcctgcaatgtgcttgagtgggatggctttgatccgtgccgccagcgctggttcaacatcccttccatgcctcccatagagtgcttcacgcttgctgataaggagtcccttgctgtgggaaccaatatccttgttttcgggaagaaggtggaggcccatgttgtgctgaggtatagcctcctaagtaactcttggacaacaggagatatgatgaactcgcccaggtgcttgtttggctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5037 - DNA, 675 bp, Oryza sativa
  unsure (1)..(675): unsure at all n locations
ggacacgccgaattcagtttccactatcttggtacacaactgatccaggaaagccctgtcatgagaaatgatgaccatcggcacttcctgcgtcttgaggtaactctccagccactcaatggtgtccaaatcgacgtgattggtcggcttatcgagcagcagcaaatcgggatcctgcacacaatcaatttcagcattggaaatgcacacagacactaaaaactacaattcaaattcaacaatccagaccaaattcatcaccaattggccataataccactcatttttctctccatcacaatatgacaaccattgattgctacatgtagagctcaaattttcttttttatctgtacctgaagaagaatcttgccgagggacatcctcatctgccacccaccactgaaggaggcgacgaggcggtcggcgtcctcgggagcgaacccgagctcgggcatgagcttctggatcttgacctcgaccatcccgaggtcgacgtcctgcgaccgccgctgcagcaggtcgagctcgtcgaggagcgccccatgaggtccatgtnctcggtggcgcccttcagcgcggnctgcaccttctncaggcgggacctcaccttcatcttctnctcgaacgcggcgaggaacctcctcctgacggtgcgcgacgcgcacacctcga

SEQ ID NO: 5038 - DNA, 862 bp, Oryza sativa
caattgtatctattaattaggatatcttatgtaatttccttagagatatgtttggccaaaagtctgccgcaaagacttatggtatcttagagtttgttagagataagagtcgtgtccggcaaggacatattttgtatctcgggtataaatataacccgtacccatgtaatcaaatgacacacgttcaataacactttcggcacatcgccaccctttttactttcgttctatttcgacgagttcttacttttgggttgagctgcatcgattcgatcttcaactagaggtaaacttgtcatgacggtttgtgttctcgggattagtgcttccatctttatgacactataatcttgtttatgtaattcgtcgagttatcatatatgttttataatctctgttagtttcgttatataacttgccatcggctggtttttactattagaaagtagccgatagggttagatctcgttattaatctagattatatcgtatctctaccatctcttagaggttttcatcatcttgtttagatcttacagttatctttatgattaatgctgcatcagatgagtttgatctattaagttttatctataattgtgatatctagcttgttttatgataacccataaagatagtatcggagtttcagccgatcttacctgatttagctattctgatcttatatgcttgactgctatgctaaatttgccctttatattaagatcttgctacattaaagatagagaaaatcccctgtgtacccataaaagttcacctaatcccttttatacccctgaattttgctgaatcccttacatacccctgaattttagtttggatcccttccatgccctttccg

SEQ ID NO: 5039 - DNA, 9987 bp, Oryza sativa
ggatggacggtggatggaagcaggtgtacgtactcctaggtgtatagaatcattttcatatatatatatataaaccatgcagcaacatggccatgtaaataaaaaaaaagataggtcgatctttagtcccggttttaaaaccggactacgggggttaccaaccgggactaattagggtttctcccccagtacatgtaagagcatgcatggaaggctatatatatatatatagctggattattaaatctttatgtgattgatgagggagctaacggtgttgaaagtatctccatgggttttctcggcggggagatcatcgctgttctagcacacctttctttctaatttatccaatggttatagcatcttggcatgtctttttggtgttgtgatgtagtgccatgcttgcaattgtaaactactatattaatgcaactaattgtccatatatagacagcctgctcgctttttgtttcttgtccattcacttagaaattggcgtctatattttgacaaatccttgcatttttcctggttaatcattaggtctagaaatataatgatatatagtttaaattttatttaatataatataagaatatctacaacaatctatttatcttaaccaatcacaactactactgctcgtttaatttttctcacataactactcatctcattcaataataactctttattcacatactcattgttaatctcccaaaaaaagcgccaaatatattgtgagacggagagagtgattattttggaagcaactgcaccacaggccagaagccaaattctgctaattaactactctctctatcatataatataatataaatgattttgccctttaaatttgtccgaaatgtaagatattttgtgatcccacgacaatattttatacccaacctatcaacttcgtgctactttttttctcatctactaatttttttactaatttattttccatctatcaattttttttattctctccgttctatattgtaaaactttctggccctgccaatataatatcaacccaattgatgagagagaaaccacataaaataagggactacttagagaactgtcgacagttttttaaggagacaactttcaaatctaactatagtataattacaatataatttcgtatgtaagtataatggaactcgtatataaatattaaaataatatatgtaacactatatctaaattaaattatatagagatgataatatagttacagttcagttacacagtagttacgatgcagttacgatgcagttacaatgcagttacattgtaacagggtgtaactggaatataactaaaatataactcatctaacttctcaaactacacttccaggatggaggtctgggttcgatcccctgcaagcgcacacgcgctgattttttccaaatctcacacgaatcacggcgcggatcgcacggtcaaaaaatcgaaaacccgatcacggcgcggatcacacggtcaaaaaatcgaaagttttcagcctcaaaaactgtcgacagctagctagcacaaccgcaaaaaatagttttgacttgtgtttctcccttcttccggtcttcctccgacactcctctaacgtgccccctgctgcgcgtatggtcataggccatgcacgcatgccccgctgccccatcctcactgctacaccgctttcgccgcgagggcgccgcggccaacaccgcacaatcacgctactgcttctcgcgcacgcgcgaggtaacaggccgcctacacaacggagtcctcaacgtttccgcggtgaccacgtcgtcaacaccgccatccacgatgccccgcccgaaggcctccgcaactgtcatcttgtcactcgggaggcgctcatgtccactgcatcatgcgcaattgtgaacgcgtggctggtgacggcggcaacggtgggcatcgggagtgcgacgagatcggcaaccagtcccgaggggcaccgcctatggaggcgtgcagctcggcgggcgcgtgcgcacccaggcaggccaaagccgttggagaagcacttctccttggtggcaatcactggtgcactggcacccacagtggcgcagacatgagggccaggccaaggcagtgctcaccggcaccagtgagggtgatgacgtggacatacggggatgcacttctccacggtgcacaagctcgccgtgtccatttgcattacttggtaggctacagaaacatttttttttctattacgttgcatatatagtcattctctttggaaatatcataattggaaaatttaaaagatctatacatataattggaaaatttaaaagatctatacatatatagaagtgagtgttctaaagaaacattctctcttatacattcattgtggattaggtgcaaaaagaggccgtaagtcaagcaattcgattaagatgggggaagtaggaagatacagtaaacccattcatcatgagcagagacgaccatttcatgcttatttagttcatagagaggaatcaaattagttcatttagatcaaacacaaagacaacaggccgtgtaggaaatgcaaaataggtgcacccattaatcaatcgttttatagagaggagtattgaattaaattatacagcgaaactattgtttcagaacaggtccatatcatgttgtgtggtaacacaactggatggaatcagaaaatgaaaaggagcagcaagactgctagaagaaatcacaagaagaaagatagggacttgactcctacaaatgaagggattcatcttacacgcagtgcggacattatgggtaccacatacctacatggcacatatatcaacatattttggttgtcatatttttgtgtagtttgttttgaccagaaaaaggttgctcaaaataaaaagaaagatccatgcaagctgaaataattcacacgattgataaatttgtcggtgatatgggcccgggggtatcaggtttagagggaggaggctgccccccgatgccacgtggccctcccccgaggggagtcaggcccgaggtggggtggcggccactccttcccaaagactagtcggaggaggctgccacccgatgccacgtggccctcccccgaggggagtcgagcccgaggtagggcggcggccactccttcccagagactggatggaggaggctgccctccaatgccacgtggccctcccccgaggggggtcgggcccgaggtagggcggcggccactccctggccgagactagagggagaaggccgccccaggcgccacgtagctcccccctgaggtcaggcggcggccgccccctcccgtgactaggggtcgggctccgccgaccccctctctatgtcaccacgtacggtgggttaggtgtccgcctccaggtgcccacctacccgcatttatggcgacccgaacggtcgcgccacgccgcatttaatgcagtgtgcagtgcactcaaccggtctgtgaccggtcgaatgactgatgggacccaggatgtcaggcgcaccatcgcgtatgtcaggcgacgtgcagcccgacatatcccatcaaataatgatggtgagaggttctcatcctcttatcccagccggagtcggtcctcccgctctggtcaaagcaaggctcccgtttcccggtgtaataggagcccagaagtcttcaccccttaaatggtgactgacaggggcaccccccgtgtcaggcggcaagatttgacaggccccatcatcaagacgacgtgcgcttggcttcccaagtcaagagacaagacatgcatttaatgcaaagattataatacttctccaccggagctaggttaggttgttgggcccatgtggtaaccccttgaggtataaaaggaggtccaggcctagtgatggagggggggactaccgagcgaactggcgcttgggtctcgcaaccccaaacacttgtgttctacactcaatcaatcaagcatagaagtagggtattacgcttctcagcggcccgaacctgtataaaccccttttgtctcatcgtctttgggggatgaaaccccctcaagatcacacaacttcgctcaccaagccctcgaatctcacccgctgcccccggccgaacttacaaagaggggcctcacggttccttggtggagttctttctccgacatctggcgcgccaggtaggggacgcgttcgtgatttttgaggttctttcgagcgccggcgtgacgtgcgtcgcaccgccaatgcgggggaaggcgcagcctcctcaggagagccgcgccaccccaggcagggggctagtctccctgcatcttcaccggcctcaccgaaaggtaccacggtagtgtcaaccactccgagtccctccagatccacacgacgatcatagaggcggcatggggtgacgaccgggtgaaggcgaatttcttccccatggccctctagggccaagcgcggggatcgctcatgaacctgccacctgcctcggtctactcctgggaggactcttgcagttgagctccgggtgccgtcgaagcccgggaccccctgtgctggctcttccgcagcggctagctttggtcccgccggctggctacggtgcctggcccggctcaactaatcgtcctttcaagtttcaagtattttcaatttttcaattcatcagcttgaaatcttatatttgattttgtcgggtcccaaaactaatgatttggtaaccgacatgtttagactgtattaagccctggatcagtagattgatacaggttcaacaatctggatcttcattgcatacatttgaacaaggctccagagaagataaaatatatggatatttacaaacttgtggctaactaatacagcaggagctatagaatgaaccaactctaatgttttgctatagagttaaaccatctaacaatactagacttgaagactaggtttaaagggaactaacttatgtgattgaactcccagcttcgataagaactccaaattgactctaaaaaaggtggggttgaagtaagggtgagtacaacgtactcagcaagctattatattcaacatgaatgtatgaaatagtagtatttgagtagggctagatttaattgcagaaagcagaggatatagaataagaaagcctgtaatgactttaatgcaacaatatttagtaaaatcttgaattaggtttctaaccaaataccatatgagtcccggtactcaattccatgagcacggctattcgaatagtttcatgaatattctactgcagtagatgtacactttacccgcaatccacgacttgccaatattcattagcttagtcatggcctagtattaggttattaacaatagtggcacctgttccatgaactctagtccccatgcgctctgaacgtaacgttatcagcagcgagaggagttctggcattcctggggtttttagagagaactggatgagagaccccacatcatctcaaccaggtttccataaaatcacacacacaactcatgagtaaaaatcaatatatttacctgcgcctcgataaatatcataggatgccctgctcggcataagattgcctcctgcgcgaggacttacaaaaggaaccactgtatagaggtaccatattgttaattaacataatatttaggtctgtccccattctagaagctgcagtcgtactcgttcttttgacataagtattttgtggccattatatcgaccgagacagtactagccacccgaaaatcaaccaaatcttacgtactgtcccaatctaagttcattatatttttatgcagtctaactaggcagggctaagcaaaagctagcatatctggtttgctatatgttcaggttatgcattcaaaatcatgaatggctaatgcatagaatagaggtatagaatatagggcatttatgctcaaaggagaggaataataacttgccttgctccaacgcaaataaatccgagataggcaacctgattatctgatcctcgaaataccacaggttgccatccaaaataaaatagactctactaagaaagacgaagaaccaaattcaataaaaatcatgaaatagaaagaaagtgatgaagagcaagaagggctaggtttggggtataaatatctcctttaaaggggtataaggttctaaagagttggaggctaaagggagagggaatcaggcaactaaggttgcttatattttatgggaatgcttggttgctgaaaggatagaatgtatattggataattgaactggttcagttggtatatggctagtattggctggtggtaggtttgggtagtataatacctagggtttggttatatttaagccgattgtggatagggcagcatatcgataggctctatattttatgtgtaggttctagttagttggagagtatgtggctgagagtagggtggatatgcgatactggtgggtgtgaaatttggatgataactggaatttgactggcaaggtattagctagggtttggttgtatgctagtcgatgctagagtataacgacttgatttgataccttctctagccggtgtcgaccgacaacatattggctagaggaataggaggttggtgtaggtttgggtggggcggaagtgttaatccgacaaccgtgaatggcagcggagtggctaggatcacatagagcccgagagctaactgtgcggcatgctgtggaggtcgagggaatagtgaagctccgaccgctatacgcatcaaggtgtggggtgacaggagcagcacttcgaccttaggtttggtttttgccgggctttacaaccaacggtccgacgtcggggatagtggaccacgcgaacgtccccatggaaggcgtaaagttccaaccggcagctttttagtggctaaaggttattttggaaataaaagaaaatatttgaaaagtaaatataagtttaaattgtaaattcaattataggattaaatcaaatatttattcaaataacatttgaataaatcaagaaaattcaaataaaatattaaaatagtaaatttggtaccaaaatgtagattttgaatttagatgaatttaggtccaattttcactagaatcggatctacggtttaggagatatgggcttctaaagaatggtatttaaattaaatagagaaaatgtaaaaagtcactgttgatggacccacctgtcaatactttttcctttcctttcttttcttttctttcttcttttctctttctctctccttcttcacgtcttcttcttcctcccgttacacagaggctcgagaggagggagaggagagggaggaaggggcgccggtgttccagtggtggaacagcttcgccgcgggcggcatagggtgttcccgggtgttgcgcacctagggagtgtggtggctggacacgggagtgagagaggaggccggaacggcgagcacaatggcatgaaccggagagagagagagagctccggtgaggctcgattgaaagtgggagtgaaggggaaaagggctaaaatgggttcttcggtgtacggggaggctggtggcgaatggatttgatttaggatgctctagggatggagatcgatcgatggccggcggtggtcgccataacaggagagagagagagaggagctcggctcatgtgtgtggagggaggagacctcgctggctatttataggggacgataggcggttgtcgaaggtcggtttggagggggaggatgaaggggacacggcgacgacggcgtggagaagaagtacacggcgtcggctttgatcgctgattggctggtgatggcggttcggctcggcggctgacgtcggcgagatgaggtgcggctgacgtcgggcagcaattccttggcgtcgacggcggtatagcggcggcggcataaagatgcgggcgacggcgtctctggttcggtgtcacgtctgaaaaattcactagtaatttccgaatttatttgtgcataaaaccctcgtacaggaatcagccgaggtatacaaactgacaatttaatatacaaatccatcataataataacattacatacttacaaaagaaaagaaaaacagcagcggaataacggtctagcgatggctttaactccactcctacaggcaactcaactggggtataagccaaacgttttctccttctggatcctttttcttcaactgaggttgattgattattacaagaatgagcatatgatatactcaacaagctacatagcaaatatgcaagtgcacaaggataccaaaggatggcataatatagggttcatttgcgaaagcagcatttagcaaagatttagaagtaaaacagtagagtaattaatcatcaattttaaccaacattgcacagcaccccaatgctgcacatgcccaaccatcctgaacaaccatacccagctgtacagatctaactccaagccaggagctaagaaaattattaccagttatagcatcaataattattgtgagaggtgtgagactaatcacgaaaaacatttctcaacccgcccatgaccgcgggcacggctattcgaatagttttactctggccagaggtgtaccactgtacccacaagacacagcctcaacatcatgtttaccatgtatcgcgatactggaaagtacccgaatagaggctgtgacaataccccctgcacaacacaactcaccacagtgcaccatacctggatcataatcaccccctctataaccagaggcatggactccccagcgacccccacggacttctcgccgcttctcagtctggcaccccgtaatgaaccatgctatacaaaaggtaaagtcgttgcccacgctggttgtggttggtacggttaatgtctcacaacagtagctcgcgaaccggtccttaattgtcatgagcacaaccttcaaaatcatatgctcacaacccaccattgtcaagttttaattatcaattaattatcataacacgattaaccatcatgagctaccattaaatataatcataagtgatagtgtaacattagttatcccaattatgtgataatgtttctaagcatggctaagcaattttatatatatatatatatatatatatatatatatatatatatatatatagcatttagctgaaccaaactaatatataaggttcaagctaattaatttattacccaaggtattaaagaatagggtattcaatgcaaattggccataataaaggaataggttcataccacccggtgacattcgaaaataaatgcacagttgaaataaatagagaatttaaatataggatcaacatgctcaaaggattgtgtttaggatctgtgtgacttgccttgcaataatcagtcttcaattaatcttcttgaacacttccgacgcactcacgaaccttcgcaacgacggaaacggcatgctaacacgcaaaacgaaaaaaaataataaaaaccaaataaacagtacataaaaagtaaacaaacatgtagatcatgattttagataaatttagagacttgaacggcctcattccgacttcatatgaattagttatgaattttacaagattaaactgattttaacatttatttttagaagggaaaagggctttatgacatcatcgatgacgtcatcacctgcgagaggctctgaaccatgaggtcgccggagctagaggactcggccgggtcttccgaggactccaacgcgaagaggacgacgatgcgaactcaccggtgcaaagaacaacgacggacgacgacgaacgacgaccggcaacgagctccgaacggcggcaaagtcgggacgacgacggcagtggctttcctgcgacgagcagcggcaacgtatgggtggacgggcttcttctcggtgctgcgatgccgacaacggtctcggggtgaaccagcgacgaccgcaacagcgaggaggatcggccggagatcaaaccgg

SEQ ID NO: 5040 - DNA, 21504 bp, Oryza sativa
tcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtgatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccacatagactgaaggccgattcggaggacaccgtcaacacgggcaccgtcaacacattccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgtcaccaccttggattgaagacgatccaccccaaatcctacccactgtatcttcttcttacctgtagtggggataggagggggtctctgttggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaattagcaatttcaagaaggttgtgcaaaattatattagcagttggataataaacttgtgacaaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctcatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccatcggggcatgtttcctttatctcgtcgaagttttgccacacaccggaggttctcgatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccggaggtatcgtcaaaccccgacatgtagttggggtcgaaatcacccaaggtgaatgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtcagtgcgccgctggcccgctttcggcctgacgggccgccggcgaaacgggccgtgccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctagcggcgggcggcgcatcgcaggaggataggttttcttttttttttctttttcggcggcggtggattcttttctttttattttcacttactttcactaaccgctgtttaccgacgtgggaatctagggttgaattttaatataaacagttgcatgaatagatctaagagtcacgagagggaggtgtttgatgaactagtgctttttatattagtatggatgaagtcgaatgaaaaaatgatatataatgtagaattgagagttgggaatatatgaaatggaaaattgagaaaaaaaaatgttaccaaaaatcttggataacaccactaatcgatcatggtaattaacaagtataattaataaaataatgtacttctacttagtaggtagctagagagcatgcatggaaggctataaatatagcttgatttattaaagctttatgtgattgatgagggagctggcagtgtagagacaatttccaagggtttcctgagcggggagatcatcattataagtgtacaggtaacctgtctcgcaatcggacccagccgcgttccctccgacgtagtgtttgtccacccctttgatccacttctgcacattctccagatcctccttgctgcgcttgccatctccggcggcggcaagacggccgaggctgtccagcgcctccttggtgatgttcacgttggtggcatcggtaaagccatcgacgcaggccatcaggttctggtcccccttgccggccccgtcctggaccttgcgcaactcgtcgaggtaggccgagaggttgttgctcaggatggtggcggccacctcggtgaccttcacctggttgcctccgaaggagtcagcgtatgggagcagctcgtcgtagcaaaagctggaggcgtcgcgctcggccggcagggcggtttcgcagcaggagcggacgaacgctgccgcctccgcgaagggcgcctcccctggcgccgccgctggtggcagcaccaccactggcttctcctccttcgctgcggccgcacatggtggggataaaccgccggtgctgacgaccatcaacaccacgaggacggtggccatgctcgagctcgacctgctcatttctgtatattctctctctatctctctgcttgtttcgctactgcaggatgaattacttcataacaacgaggtacaatttatactagtaggctcgattggtcgttaacaaattaaccacaacctttctttctaatttattcaatggctgttctagaatcacggcatgtctttttggtgttgtgatgtagtgccatgcttgcaattataaactactatattaatgcaactaattgtccatatatagacagcctgctcgctttttgtttcatgtccattcacttagccgcctagcattggcgtctatatttttgtcaaatccttgcattttttccttggttaatcattaggtctagaaatataatgatatatagtttaaaatttatttaatataatataagaatatctacaacaatttatttatcttaaccaatcacaactactactcgtttaattttctcacataactactcatctcattcaataataactctttagtcacaaactcattgttaatatccaaaaaaaaaaagctccaaatatatagttagacggagagaattattattttggaagcaactgcaccacaggccagaagccaaattcagctatataactactctctccgtcccataatataaatgattttgccctttaaatttgtcccaaatgtaagacatattttgtgatctcgcgacaatattttatacccaacctattaacttagtgctactttttttcccatctactaattttaccaatttattttccatctatcaattttgtttattccctccgttctatattgtaaaactttctagccctgccaatataatatcaacccaattgatgagagagaaccacataaaataatagttttgtgcttatgtttctctcttcttttggtcttcttctgacgctcctctcagttctcacgcgcccctgctgcgcgtaaggtcataggccacgcacgtgtgccccgctgccccatcctcactgctacaccgctctgccgcgagggctccacggccaacaccccgcaatcacgctactactcctcgcgcgtgtacccccgctgcgtgtgaggtaaaaggccgccactacaccgcggagtcctcatcgtttccgcggcgaccatgttgtcgaccccaccatccacgattccccgccagaaggcctccgcaactgtcatcttgtcgctctggaggagtaggtccctcctgttcatggtgtcgttgaacttctgtcggattagcttggcgaagacgtcgatgatgttgaggccggtgtcaacctcgcttatgtacaagaacaagcggtcgttgtcgaccagtttcgaccatcaatattatccaatatatgaagactacctatgcttgcaatgcataattcccaaataaaataattacttccactatatgctatgctaataacatgtatggaggagaagcactcataaatgaagagaaggaggtggaaatatatcgatcaatcaatcgaaagtctgtcggtgatctgcaattgcatgagaaggcccaaaagtccaatttaacaatcacaaatgggcctagaatgtatgtcacggatttgggggcccacttgaaagtctcctgaagaaagctgggggccagaagagcccataggtggttggccaaccccttgttgagtccaatccagccgcattttggctaagagataagggaggccgaggaggaagcagcaagccagaaaccaggcctgttgggccagtctagggttcggccgaaccctgatctcagccgttggctctcccctttggcttggacgttccggatgaactcctgacggcggttgcggggcatttccgacaattcccatctctacaaccgtcattttgagctataaaaggacctcacctccttcactttcaacacacactcaagcaaggattgaagctccatttctccaaagttagaattagtatagtactagtggaatagaattagagtagttccgagttgcggaagcttcaggaagttcggtaaagttcttagcttttcctttctttttttgtaagacttcctttttattaatataatatttcttctttatacaagttcggtactttattccaatcatagaatatgagtaccattcttagtttatttataatcagtataatcttagtagttaaaccttttgtgatttgcactgatgctggtataatgtctgattaccgggtcataagtctgctctggataggccgagagctatggcccggggactcagatgctctgcatcgattgcaaggctgtagagtaataagtagtaacttaagcatgggtttaggttatcacttatcattatttgggggtatattcgccgggagagtagcaggccgctaatggtgatagctcagtacgagcgtcttccctgcagtttatatttctacatacaatttcctggggttggatacacctctgtatcctacttcagttggagagttattgtcatgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataaaataaacggcgcagacggctccactccacaggcagcttgaccaaggctacacctaatcgtccacaccatcagcctcacggtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtaataattaaacaatattaatccaacgctatacaacataccctgttgtataggcccaaccattctgaacaaccaccccggctgcacagttttaactccaaaccaggaatataccattccaaaccaggagctaatcaaattattaccaattatagcatcttctattatggtgagaagggtgagactaatcacgaaagacattgttagacccgtccataaccgcgggcacggctattcgaatagttttactctgatcagaggtgtaccactgtacccacaagacacaaccccacatcatgttaccatgtgcctcaataccaccacggtacctaggaaaggagttgtgacaataccccttgtataacacaatccattacagcgcacctttcctggatcataatcacccccttataaacaaggcatggactccccagcgacccccgtgggcttatctccgccacttctcagtctggtgctccgcaatgaaccatgctatataaaagataaagccgttgcccacgctggcttgtggctggcacggttaatgtttcacaaccgaaactcgtgaaccagtccttaattgtcatgagcacgaccatcaaaaccatgtgctcacaacccaccattatcaggttttagttggcacattaattaactaatcacgattgaccatcgtgaactatcattaagccatcattaaataatagtgagtcataagttatcccaatagtgtgctaatgtttctaagcagggctaggtaatcacatctaatatctagctgaaccaatatatatagcccaactagtcaagttataataacccaaggtatcaaagaagaaagtaatcaagaacaagagggctataataaagaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttctgctgcgaaaacggactctccggaaacgtcagaatctaaacagaaaagagcaaaatcaccaaaacagcacataaacaagcatgaacagtacatgtggatatttttaacatgtagatctcaattttataaaaatttagagacttgaaccaactaaatccgagctaagatgaattagttatgaatttttgaagatttaatcggattaaaacacttatattgattttaattgaattatgacgcaataatgaattatttttgaaaaggaaaaagggatttattgcgtcagcggctagggtttcacggtggaccgggcgcacggcgacggttcacgcgaacggacggccgagatcgatccatccaaaacggacggtcgagatcgatcggtccacgaccggctcacgggagagggcgacgatgacgtcggcgatgacgtcaccaccggcggcggcggctcggcggctcggacggcgcacgctcgccggcgaacggcggcgctttggcacgaacggagggcaccaacgggtagcggacggcacggtgaactcaccggcgaccaaagcgacggtggaagaggaacggacggcgacggcgactaagaagaagcggcggcgctcttcggcttgacgacgccgacggtgctccggcggtctacagcgatggcaaaggggcggacgaggacggcgacgacttggcgaccacgacgacggtcttcccgagcgacggcgacgtctggaacggcggtggcgcacggctggagcgacggcggcgacggcggcgctagggcacacggcgctagggcgctacggacgacgagaggcgaaggcgaaggtggcggcgggtagagaagagctcgggggtccttttaaaggggctaggaggcaacggcgaaggcccacggcggctggcgacgagatggaaagctcgagctcggagagagaaaagccgatccgattcgaactcgaatccatcgatttccaaacctatttagccgatgtttccaaaggagaaaaggtagaggagatctcgaggatcatttcccctcttttgattcggccggagaaggaaaggagcggccgaatttggaagggaacagcggcggcggcgcgctagggtttcgggcggcggcggcgcgacgaagacgacgaccctgacaggtggggcccacctgtcagcgggagagagagaggagagcggcggctcggactgggccggctgggccgaggagagagagagagcggttttgggccgaatttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaaatttatctggccccattttatattggaatttattaattaaaattagatcttctcttctaggcttttaaaataaattctaaaaattccatttaaacaacaatttatatattttgaattttcagggtgtgacagttatgacaaggttgtcgtaagaaactcggcaacccggggtaactttgcgatgcatcgggagggcatagctgagttctggcttagctatgctgcattgttaaaggggttattgttaacgaccaaatttggtaatctagggatcggatatgaagaagaaatcgagaaggaatcgagaaattgtccctgatggcggtatagcatggggcccttcgactggacctgccgaaaccatgcaaccgatggagggttcaagcccgagatgtcgagtgtgtcggggcgaagcccccatggcgaagactatgaaacaaagatggcgaagggcggagaatcgtgctggtatcccataaggttgaaggcattttgggcgaagactatatggtggagaaggtatggcgaaggcggatgacttcgccatagcaagtccagcctcaaggaggcccaagaggccgtctcagccgatcaagcccgggggccactaggccagcgttcgccagtcggcccattagaggcccatgtatctcaattacactgtatacccatgtaaatgtcccgttcataagggcaaccatgtaaatttccctgtataacctaaaccctagtagtaagaacccgtaatgaggctataaatagtctcatggggccatgtaacagggggatgggaagaaaaattctcattttaatacattttactttctttccaaccactgttgagtaaccacgtctttcaacgtatgcagttgtcgttccgacaatagttggcgtcgaccgtggggacctccgagcgaaaccactaagagcgaatgccaccgaagagggtcgtgaaggagaaggttacaaggcgaaaggaaagcgaagtcggggggggggatggtcgccgaacagggagcagagccttcggcgcttatcgccgaagatagaggagcgccgcctgcctccgcacttgcgccatcacaaccgccttcggctcctgtagcttctgggcaggtgccgaacgcggctgacatggcgaaggagccgcgacggcaagggcacttcagaccagggcggaaatcctctcgacaagccaactgctggtgccccaagccgctccgacgcagccggcagcggctccgactgcgctcgccgccgctcaagtcaatcctgacctcgaaactcaagccgaagccgacatggaggccatgcgaaagaacatgacacggctccaggacatgcttcgacagatgcaagagcagcagcagccgtatgaggcagcaaggcgggccaaggcctcttcgaccccaatcctccagtattcgacaggttacgtcccaccccaagtacatccacaagcgccaatccaactccttccgccacaagtcacgcaagcgccagcatacttcgccgggcagccttcgaccacggctattcatccagccccttacgtgcagctgcaagctcagcacgctgcccaagcacattctcaaccgcttggccaagtatcacaagcaatggcggaaggggcttcggctctgcaggcgcagcttcaagctttccttcagcaattcagccaaccccacaatatttcaagtatagccccttcggcccagccggaggggaatacaagtcaaggtgcgcctagttggttaccgtcgaaccagctgggtccgggggcttcgccttggagtcaaggaccgcagttcgacttcatcaatgctgctctggcaccaaccgcttggccacaagcaccaacaccgggcttgggggcaaaccaagcaccaaaccaggccgccatggcgtggccccaacctacgttcgacctgcccatggcggctcaccaagcatcaacaatcggagtcgggcagccgaatgccatggcccaacctcatgcgcaagccgtgacttcgcccttcgccacgctgtacccatagcaaggtaccgtgaacagggcaaggggcgaaaaggggctaccgctgagcgggggaatcaagatccgtccaatcccaccccagttcaagttcccacccgtcccacgctactcaggcgaaactgatccaaaggaattcctctccatttacgagtccgcgatcgaagcggctcatggcgacaaaaataccaaggcaaaagtaataaatctcgctctagacggcatcgcccgctcttggtactttaatttaccagccaatagtatttactcatgggagcaattgcgcgatgtctttgtccttaactttcgaggcacctacgaagagccgaagacatagcagcatttgctcggcattcgccagaggcccgggagaatcaataagggagtacatgcgtcgcttctcgcaggctcggtgctaagtgcaagacataaccgaggcgtctgtcatcaacgccgcttcagccgggctactcgagggcgaactcacaagaaaaatcgccaacaaagagcagcaaacgcttgaacacctgcttcgcatcattgacgggtacgcaaggggcgaagaggattccaagcaacggcaagcaattcaagctgagtatgataaggcctctgtcgccgctgcccatgcccaagcacaagcttaggtcgccgaaccacctcctctcgctgttcgccagcctcaaccagcgatccaaggacaaccgccaaggcaaggccaagcccccatgacctggaggaagttcagaaccgaccgtgcgggcaagcttgtgatggctgtcgaagaagttcaagccctccgcaaggagttcgacgcccagcaagctggcaaccatcagcagcctgtccgcaagaaggtccgaaaagacctctaccgcgccttccacggacgctcttcgtataccacggagcaatgccaaaacattcggcaacgtggcaacgcgcaagatgcaaggccgcagcagggagcagctatcgaagcacctcgcgaagccgttcaagaacaggcacccccggccgaacaacgccaagatgtgcagcgcagagtaatccaagtgattacacgggccgactcgccgggccagttgtcaaagcggcaaaagaagatgcagctccgaacggtccacaacatcacttcggcgggcgaaggggccccgtagtatctgaaccagctaatctcttttgggccggaagatgctgaaggagtaatgttcccgcatcaaaatcctctggtgatctcagctgagatagctggcttcgaggtccgacgaatcctggtcgatggagagagttcggctgatgtcatcttcgccgaagcatatgccaagatgggattacccaccctagcccttaccccagcaccgacctcgctccgtggtttcggcggagaagcagttcaagttctaggccaaacacaattgctggtagctttcggcgcaggcgaaaacagacaagaagagtaagtattgttcgacgttgtcgatatcccatacaactacaatgccatctttggcagtgcgaccttgaacaagtttgaagccatctcccactataattatctcaagctcaagatgcctggctcgacatgagtgatcgtggtcaaggggctacagcctttggctacttctaagggagatctggccataatcaacagagcagtgcataatgttgaggctgaaccacatgaccgggcgaagcacgcgccaaaacccgcccctcattgcaagataatcaagatacagattgatgacgccgaccccacaaagctcgtatcgctggggggcgacatgggtgaagaagaggttgagaacatcctaaaggtactcaagaaaaacattgatatcttcgcctggggacctgatgaggtgggaggtgtttcgacagatctcatcatgcatcacctggcagtcaaaccggatgccaagccaaggaaacagaagctacgcaagatgtccactgatcgccaagaagcagcaaaagccgaagtccaaaaattgctcaaggctggggtcattcaagagatcgaccatcctgagtggctggcgaatccagtgctggtgcggaaatcaaacggcaaatgacgcatgtgtgtcgatttcacagacctgaacaaggcatgtccgaaggacgatttccccttgccacggatcgaccaactcgtggattcgacagccggctgcgaactcatgagcttcctggatgcatactccggctatcaccagatccacatgaacccggctgacatccccaagacagccttcatcacaccatttggtaccttttgtcacctcaggatgcctttcggcatgaggaatgccggggcaaccttcgccaggctagtgtacaaggtcctttacaagcagttggggcgaaatgtggaagcttatgtcgacgatatcatcgtaaaaagccgcaaggctttcaaccacgcgtccgacctacaggagactttcgacaacttacacacggcgggtatgaaactgaatcctgagaagtgtgtttttggtgttcgcgcgggcaagttgttgggtttccttgtttctgaaagaggcattgaggcgaaccccgagaaaatcgatgccattcagcaaatgaagcttccgtcgagcgtatgtgaagtacaaaagctcgcaggccgaattgcggcactcagtcgattcttctcaaaggtagccgaaagaggtttgcccttcttcaagaccctccagggcacgggaaagtttagctggacacccgaatgccaagcagcgttcgatgagctaaagcaatatttgcaaagcccgcccgctctgatcagcccagcactaggaagcgaactgctactatacctggcagcttcgctagtggcagtcagtgctgccctcgtccaagaaatagagtcaggccagaaaccggtctatttcgtctccaaagcattgcaaggagcgaagacaagatacattgaaatggaaaagcttgcttaactttcaggcccacaaagtcactgtgccatcacagtaccctttggcgaagtactctgaggcaaggaagttactggccggcttagcaagtgggtggcggagctatcccctttcaacttgcattttgttgcccgcactgctgtcaagtctcaagtgctagctgacttcgtggccgaatggacaccggcatttgcccctgagcccgagcccgtcgaacaaccctgggtgatgtatgtcacgcccagaaatttaacccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccactccaacgatgcagacgtgcaaggggatacaaggatggtttgtggctatttgcataacgccggttgtaaaacattttattgagcaaaacagtaaaactgttgagtatttagagtaacattaaatctccactgatcaacgctacactacgttgaacaggcccagccaacccaccagaactacagtgcattgagtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagcgacagaggccgtcgcagggcccgtcccgctccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattgtagttggataattacgaccatgaagcatggccagatgtctcgagcacgcagctcactctgatactaaaaaggtctaatattgtaattatcccatcaactgagctagtggtaaataagcatggctaagcatatagttctggctaagtcacataagtaacatgagctagtcgatttattacccaaggttgacaaaggatagatatcaagtaaacatggcacaagcgagcagataggtaaaaccctgatcccgtgtaattagcaaaacatgcatatttatttgcaaacagtaaaacatttgtaaattaggatcaaaatgctaaaggggaatgtgtgacttgccttgcttcttcactttgatcttccgaactcttttccttgcgaccgcggacttccgaaacgacggaaactacacgctggcacgcaaaatgaggaaaaactctaataaaaaccaaggaaacagtacataaaaactcaacaaacatgtagagctcaattttagatgaattttgcaagttgaatggctcaattcgtagttcgaatgaattagatatgaattttagaagttttgggtcatttaaatgaatttctagaattaaacacgatttattgcgcaattattaaatattttctcaaaggaaatggcattcgctgacgtcagcaaggggcgccgacgccgacaggtgggcccaacacgtcagcgggtcaaggaggtgcgggcttggaccgggtccaccaaatgagcgggccccacgcgtcagcgggcaaaaggatctagcccaccgtggaccgagtccacggtagaggtgtaaggcggaggggtgggttggctcgccgaccaacccgaccagacggcggcgcgcggccggacgtccaccggcggcgacaccggcggcggcgcggcgcggcgcgacggcgacacgcatgcggcggccggcgggcaaagagagaaaaagaaagggaggggaggaggagggagatgctcaccgacgcgggaaggacgacgacgacaacggtgatggcggcgtcggcccgacgagcgagggggcggccggggagcggcgaaaacgagcggaggaggcgaaaagggaggcggcggagctcaccgaggggcatggcggcgaaggaggcggctgatggggctcgagcagagggaggcggtagcactccacggggcgaagacgacggcggtgattcggcggtctccaacgaaggtggaagagcggccggggtaccacgcgatgcagcgaagccgacggtggtagggcgcggcttggcagtggctggagcggcgaggagcggcggccggagctcgtcggtgagtggtggagagagggagcgcggtggggaggtggttccggcgatgaaatgggaaaacggagtggggccgaggtgcggcaaggcacggcgaagccggtggtgcaagcggcgcggcgcggggacgtcgacagtggcggcagcggccggctgaagggtcgccggcgatcggcggcgcttgggctcgtgtggggagagcgggagagagcgcggggagtgcgggaaagttggggaaaagggagaggatggccgggggattgtttttataggggaggggaggcgggatcgagcccgggagaggcggagtcggggcggcaaccgccggtggcgtgggcggcatcgtggggtgtgggtggcggttttggaggggagaggtggggggaaacggcgcggacgtgggcggcgaggtcccacggacgagcgcgcgcgcggggtggagaaggtggtcggaaacggccgcatcgtggggcggctcgggcggccatggcagcaacggcagctgccggcctgaggttggggatgacaggtggggtccacgggtcccatctgtcggagagagagggagggagaggccggctggggaggcaaaacagacttgagggagagagagagagccgagcgggccgagggagaaggccggcccgagagggagagagggggggggggggggaattgggccgaaaggggcccaaagagaggagggaggattttattttttttctttttattttaattggttaaatgatcttcgtgactttaaaactatttctcgagctccgaaaattcacggaaaattccggagagtacattagggcacaaagaatattacaaaatatttccggccaatgatttttaagggaaaattttaattctcccattattttacttgattaaattgatttaacttttatttaatttctagaaaatgtattattaattgatttttattcccgaacgaaaatcggggcgtcacaaatctaccccccttacaggaatctcgtcccgagattctgggatggctagaaagaaagctggcattggcgggcggtctgactgatctacacattgcacttccacattctgcttcgaactgactgattaattgagtgatcaaacctgcacgactgaactgattggattcgacttttctgttcctttgctttgccaagactggattgactggttttttcttaaactgacccagaccaggactgtggatgctcatggaacttacttatcttggactgaagtgttgatgctgacaattcaccatgctggctggaagaggatgaagttgttcctgaaacttgcatctgacatttgtaaatcattgactctacatccgcttgaactggtcttgactcgaatgacaagtaaattccaggaaacctgcttgacctgtctttcgtctgaactgcaactgtcctcgctgttgcttctctaagctgaactgttgacatgcttcacaggtgtaccttagaattgaacctgtcgacctgagattggggtgactctgctaatggttcgcaactgactcctttaattactaaccaatttgctgcactgggttgaacctacaactgaaacgacaacgaggttagccaaaactcatctctgagacctaccccccttacagtgggtagtcatactttcgcctaactggaaacacttgaactgctatccttgaaaaacaaccattacttctcggatttacaaaagaccctgactttggaaactggcacttcatcgatcaatcaaaatggagcaatgacgatgcactttcatccaggtcaagacttggaacttaacccttagttgctgataggaaattccacataaagaaattctcatttagctcgtgatcttactaactcttgactacttccccgaccagttctaactgctggtacaactgtcttggttctgacttgatttttgttgtcatatacctaaacagattgcatagttgaccttccttgaaacaagcactgatcacttaacagatcgaactcaagaggtccttcccatggcatgacatttcacttcttcgaccatcctttgctgactcttcctgggttgacggaccatagatcctgcaaccgttttccggaggctattgcaatctgaacaactatcggaaactggcttcgatgctgccaagagtttctgctctttgatcataacaacttcgctttcatatttttggtggagatgatccgttaaaaggggatactctgccatataccctgcttgactacacatttctggacttgactctatatacttctgatccatgtatggaacaattttttttttcaacttccgagaaacattgaaatgattcctggaacttatactggttgccttgaactaaggaaacacatactgaattcatgctcgcaccattagggtgtaactatcgattacaaccccctaacagcttccaaggttagaaagttctcaagattctttatatgatgtcgtttttcaaatattccattactcttttcatttgagtaccactgacactgcctttagagagatcccatcatgttgagtgttgagtgtccaaccattttcactccgttggttaaccactcctctattggctcgcaaataggttttggagctcaacgaaattgcgatgagttagaagagaaactcttggtttcttgagacactgacagatacaaatttggatttgctttttcatgctcgagatggatcagataagtggaaaactaattgactcatactttattcaatattcccttttcattacataactgccatagacatctatatacagagagaagtgctacaaagttaaacatttgtagactgctgctgattagagctgcccttttcacgactgaacttgaaaagaagaagtcttgtctagaactgctattgcttccattattcaaacctgactgacttgtttcttcagttcctactaatagaagtctcaccgggaacgttgctctacttgttgatcttcgatggtggagtggcaactgtcttgacagctgtaacaggtaggttcttcttgcccgtgggattaccaagcggtgatttgctgatgagcctctggattggagcaatacgaggtgcattgctagaactgacaacagttgggcggcctagtgctgacaacacttgctgcgggtgctgacgaaggaccgtactgcctttttgtagctgtagcgagctgttgttctcctggcattgcctaccctactggtgctggtgctgtaggcttgaaacgatggccggtggaacaatgtgacctttgacggtgcccttgacgataatccgttgaggcggaggttgcacattcaggtgtcgattggtgtcatgggcagtgctggtaacttgggaatcacgacgaactgcctttgctgctcttggaagaggacaatcactgaaacgatgtcctggcttacgacagttgcgacagaatcgacttgctgggtctcggggtgcaggcttctgattatgcactttggcagctgaaactggaacacatagtgattcatgaacatccctggcgacgttgcttcttccaaggttggcttccactggagctgtggttggtgaaagagtagaagggttgagactgttgttgtcgaccaccattggttgacgaatgggttgcacggttgccccttgttctttcttggtcatagctaggaccgcgttcaactgacagtccttaggcacatgatctgttccttcacacaagaaacatgtgaccttcctcaaagggcatgcatctgagtaatgggtgtattcaccacagcgacatgtggggaggcataaactagcagtatgttcgactatcccacatctagcacatgctttgcacttcaactctctttccctgaaactgtcaagggtcgcatcatcattgtcatcattatcatcatcgtggtcgtcattgtcatcagcagaaaaccgttctcctgattcatcatcttcgggtctgggtggaccgtactttatgagatgacgggttagctgacgcgctcctcggaaggtatttcttcctctccgacgcttgggtatccttgctgcgtcttcaggagtaaattctgaaccggtgatgatcatggtcctaccattatccatcttccatatcactgtcctattcgctccagagttgcgctgcaaagtaccatccttcttgtcggtagactgacttggagcttggttactccctgggcactgcttctcgtctttttcaggtgacctggcaaacaccttccatggacagttccttacataatgaccttgctcaccacagtcataacaggtagcacttattttcctttggtccgacggtgagttggctgaagttatcttcggggatctggacatcattttgacaggggtcttaggtgccgatattgggaactcctgactctgattcaggttccgggctggcacctggacttgcatttgtggctggtg

SEQ ID NO: 5041 - DNA, 1236 bp, Oryza sativa
tctgattagccatgacttgggattgtggctgatctttgagaggtttgacgtgggaagcttatagaattgagctgagttgatccatgaaactgacgggatcctgatccgttgaaattgcccctcacactgaccatctgctgcaggcacgagagagagggggagggaatgagagggattactagagatgaggtactaaaccacttgcctactgatctgttgtgagtagacttttattgttcaagttgcttaagcaaacaacctagtatggtcgcatccccaccaatgatgcaaaccatacccctacacacaagcaaacaacacacgacctagcagctaacgaaactactcttccaggaagtattgggtttaggtaaactccgggaaaactctccttgatcttcgcggaacgacgactctgaactgaccttcccgctctttgctgcatgaagcttgatgcttgacttgacttccgaacagacacgaagctgacggtttatcctccacggtttaacaactataagaattggagggacagggaggagaattttgaaaaaccgtttcgcaaagaaaagacgaagggcgaggggagacatttttcaaatagggttttcagaaagcttgtccttagggtttgaccgtttggctcaacctacagtcgagttggctctgataccactttgtcacgcccagaaatttaacccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccactccaacgatgcagacgtgcaaggggatacaaggatggtttgtggctatttgcataacggcggttgtaaaacattttattgagcaaaacagtaaaactgttgagtatttagagtaacattaaatctccactgatcaacgctacactacgttgaacaggcccagccaacccaccagaactacagtgcattgagtcgatttattaaggggactaatcac

SEQ ID NO: 5042 - DNA, 4305 bp, Oryza sativa
gaagccattcttctgggcctaaaaatggcgaaagcattgggggttcggcgcttgctaatccgaaccgactccaagctggtggcaagtcatgtcaacaaatcctttgaggtagaagaagaaggaatgaagaggtatttggaggttgttcgatctatggaaaagtgcttcgccggcataacggtcaaacatttacctagaggccagaacgaggaagcagacgccttggcgaaatctgctgcttgtgggggcccacactctccgggcatcttttttgaagtcctatacgcaccaagtgtgcccgtggagagcctggatgtcatggcaatcgaccaggcagaactgggcgaagatccaggcgactggcgaaccccgttcgtgaaataccttgaaactggctggcttctggaagatgaagcagaagcaaagcgcttgcaactcagagccgcaaagtacaagatggtctcgggccagctatactgctccggggtgcttcaacccttgtttcgctgcatctcctttgccgaaggcgaggaaatggcaaagaaaatacaccaggggctctgtggcgcacaccaggccgcaagaacagttgcctccaaagtgtttcaacaaggtgtatactagcccaccgtgttgaaagtctgtgttgagcaagtcaagaagtgcgaaagctaccagtgccatggccgaagccaaactgcgtcccaatatgagctgcagcccattgcaccaatctggcccttcgctagatgggggttggacatcattgggctgttcccagtggcacgaaatcgctacaagttcgcaattgtggccatcgaatacttctcccgatggattgaggccgaacccctcggagcattcacttcggcagcagtacagaagtttgtatggaaaaacattatttgccgtttcggagtgccaaaagagttcatcactgacaacggcaagcagttcgactctaacaagttcagagaaatgtgcgaagggcttaatctggaaatcaggttcgcgtcggtcgcgcacccacagtcaaatggggcagccgagcgcacaaatggtaagatcctagaagcactaaagaaaaggcttgagggggcagcgaagggcaaatggccggatgaaatgctgtctgttctctgggcccttcggacgacccccacaaggccaaccaagttcagcccattcatgctcctctatggcgatgaggcaatgaccacgacagagctaggggctaattcatcaaaggtgatattctctgggagcgaagaggggcgcgaggtatcgctcgaactcttggagggggtaagagtcaaagcactcgaacacatgcgcaagtatgccacaggcacttcggcaacttacaacaaaaaagttcgaccgatggagctgttgcctggccatcttgtcctaaggaagaaggcgaacccggtagccgttggcaagcctgaatcgaagtgggaaggaccgtacctcatcaaacacatgtctaggacgggatcctttcgactggcgacactcgaaggcgaagagttcgaccattcctagaacactgcatctctcaagcgtttctttgtctagaacgggtggcacccaaatcgccaacttgtaaaaatgtacataccattatgtaagcctttcggcactatgtaagcctttcggcacaaaaatacaaaaaaaaagaggaaaatgaaaaaagaaaaaaaaactggatgtagggctattatccatcccggaggcctgaaccagtataaaatctttgtgtctttcgcctttttatttgtgtaattgattatttgtggaaaaaccctaagacaaacgcctgatcagcgaaaataccggggggggggggggggcgaaacgaatcggccgaagcatcgctcgccgaatgttgaaaccgtaacagcttgtttcgggaaacaactaaccgaacaccattgcactcgatcaaaatgaaagcacgaagtgcttcctccaacgtagaataaaatggatcgaaaatggaagccgaaagctgaaaagtcaaaaacatatttcgctaatatacgcaaaggggtcgacacgttccggcccaacgaaagcacgcgaagtgacaatgcaaaaatagcgaaaaggaaataaaacacatctttattgacttcgaataaaaatatatcggagaatacaaacccaacaacatggtacaagtaaaagaaaaagcaatagctttacagcccagcttatagataaattacatcttcgcccccacaatcactctccctttctaaggaagggtcgggcgaactgggttcgtcgtcactactaatatcatacacgactctaagaggagaagggggcgaaacacagactagactgtaacgacgctgggagatcgcctcctgccgatcaatcttcatttgccctagagatgtccatcgacccccgactttgtctatctccatccgtgtacttttgtttataaccagactgagccacaaactaagccttacccactagacatgtggaagtacggtagtgctttgcaacagaggcccgaagaccggtccttatatggccgaggtgctaccatcaaaaccatgcaccccgtgcccagcctaaaaccattttgagggttttgaatagagggggaggtgtgaatccaattccacaataatccaaccattccatagtgtccaggtgatatgaatattcccaaagtctaaagttgtaaaaccacctaatgttgcctaattaaccagcgaagcatctacctaaattcatactagtggtaccatgagtggagtgcccactagttggggttttgtttattctagggtgaacaaggtaataataataacaatagaaataataataaggtcataacaaaggtaaataggcatggctgaataaaacagtgataacgcgggaatttaaataaagcgataatgcaataatttaaatcaaaataattttataaaatgggattcaatatgttcaaggatgatgtgacttgccttgctcgctttcccaaaggtcggcttcaacctccacgaagagcggatcttccgaagctgcagcgtctacacgaccaacggaaagaaaaaaaaggcttttactctaataaactccatataacaagcaggaacaaagcacaaaaatgggttcttgacttcttaaggaaaaattagagacttgaatggtccaattctgagttcaaatggccaagttatggccatttgaaggttatatgctctttaaatgaatatttgcgaattgattcatttaaatttaaatttaaaaagggtttattgcgtcagccgagggggaggggcgcgcggaccgggtctacgggcgccggccgccgtgggccttcgctgccgcctcctagcccctttaaaaggacccccggtgtcttctctacccgtcgccaccttcgccttcgcctctcgtcgtccgtagcgccctagcgccgtgtagcttcgcgccgccgtcgccgccgtcgctccagccgtgcgccgccgccgttccggtcatcgccgtcgctcgggaagaccgccgtcgtggtcgccaagtcaccgccgtcctcgtccgccccttcgccgtcgccgaagaccgcccgagcaccgtcgccatcgtcaagccgaagagctccgccgtttcaacctcgtcactgtcgccgtccgttggtcttccgccgctcctttcgtcgtcagtgagttcgccgcgtcgcgctctacccgttggtgtcctccgttcgtgccgaagcaccgccgttcgccggtgagcttgcgccgtccgagctgtcgagccgccgagccgccgccgccggtggtgacgtcatcgctgacgtcatcgtccccgtctcccgtgagccggtcgtggaccgatcgatctcggccgtccgttttggatggatcgatctcggccgtccgttcgcgtgaaccgtcgccgtgcgcccggtccaccgtgaaaccctagccgctgacgcaataaatccctttttccttttcaaaaataattcattattgcgtcataattcaattaaaatcaatataagtgttttaatccgattaaatcttcaaaaattcataactaattcatcttagctcggatttagttggttcaagtctctaaatttttataaaattgagatctacatgttaaaaatatccacatgtactgttcatgcttgtttatgtgctgttttggtgattttgctcttttctgtttagattctgtcgtttccgaagagtccgttttcgcagcagaagagtttgaagagttccaaggccagcaaggcaagtcacacagatcccaaacaaccct

SEQ ID NO: 5043 - DNA, 2103 bp, Oryza sativa
acatttttttcgcttattaattagagtaataattgtactctattatcaatttgttattgtgtgcctcggctgattcctggacgagggttcacacacatgtaagcgtttggaattttggatagaaattccgggcgtgacaagttggtatcagagccatcttgactgtaggataagccaaatggtcaaactttaatgacgaatttttccgacaaaaatgatttgtgaaaatttctcctttcttccttatctagaattctttgcaaattatttcattgtctactcccctctctctttcaacttgagtagttctgagacattgaaacttgaagacgccaatgaggtctacttatggaggtcagtcgagtggatcgaggaaggaccgaagtgccaagtggtcaagatggaatgaagtttggatcctaccttagaacctatgccgccaaagtgtctttgaagaatagttagtaggatagaacgtttgttgcttgtttgtgtgtaggtatggttgcattcccatcattggagtggttcattgatgagtgtgtaactatactaggttgcttgcttaatcaacttgaacaatataatggtctacacacatcagatcagtgttaaactggttaaggtcttgtctttagtgtaacctctctccttctatcttctctaatatgcaacagatggtgaacactcgcgctagtggaagtggaaacaataataatgaagataacccaactcttgctcaagttctggctcaacagactcagttaatgaacatgatgatacagcagatgcagaaccagctcaaccaaggaaacaacaatgctccaccgccgcagaacaagttagctaattttcttcgtgtgaggccacctaccttttctagcactactaacccagtggaagcaggtgattggttgcacactattgagaagaagttagatttgcttcagtgcactgatcaggagaaggtctcatttgcatcacaccaattgcatggccctgcctctgaatggtgggatcacttccgcctgaataggactactgctgaacctatcacttggcttgaattcaccgctgctttccggaagacgcatataccatcgggagtggtgtctctcaagaggaaggaattcaggtcgctcacccagggatctcgctcagttacggagtatctgcacgagttcaatcgtctggctcgttatgctccggaagatgtgcgcactgatgaagagcgccaggagaagttcttggaaggacttaatgatgagctttcttacccactcatgactggagattatcatgatttccagaagttagtggataaggctattcgccaggaggacaaatacaatcgcatggagcagaagaaacgccggattgctcaattcaagacacaacaggggaataatcagaagccgcgtcttactttaggaccccagtctatgccacagggaggttcttcgtctgttgttcgtccgcagcgtcagttcttcaacaacaatgctggcaacaacatccgtaatcaagctccacgtcctgttgcagcctcgacacagcaacaacctgccaagagggagcaaggcagcaagcccgtggtgtgtttcaactgtggagacccaggacattacgctgacaagtgtccgaagcctcgacgtgtgaaggttgtccctgcccagagcaactctaccgcaccagcgccaaaggcccgtgtcaatcatgttgctgctgcagaagctcaagatgctccagatgtgattttgggtacgtttcttgttaacttagttcctgcaacagtgcttttcgattctggtgctacacattcattcttatccatgagttttgcgggaaatcatgggatagaagtagtgtttgccgtttcggagtgccaaaagagttcatcactgacaacgacaagcagttcgactctaacaagttcagagaaatgtgcgaagggcttaacctggaaatcaggttcgcgtcggtcgcgcacccacagtcaaatggggcagccgagcgcacaaatggtaagatcctagaagcactaaagaaaaggcttgagggggtagcgaagggcaaatggccggatgaaatgctgtctgttct

SEQ ID NO: 5044 - DNA, 681 bp, Oryza sativa
ccaattttgagttcaaatggccaagttatggccatttgaagtttatatgctgtttaatgaatatttgcgaattcattcatttaaattttaatttaaaaagggtttattgcgtcagccgagggggaggggcgcgcggaccgggtccacgggagtggggcccacgcggcagcctcacggtccacggtggaccgggtgcacccgggctcacatcggacagcgccgtgggccccacacatcagccgcacccgagggcgcgggcggctgatggccgggccccacgcggcagccactcagcacgcccgaaggcggccatgccagcgcggtcggcggtagcggcggcgcccacgccccgatggtcgccgccggcgaccaccggctcggcggagcggcggtcgagagagggaagggaagggggaaaggaggcgacggtccacggctcaccccggggcgacggcggcgacgggggaggctgtggcgcggctcgggtcgacgaggacgacggtgctccggcggtcggcgaccgaaacagagaggtggacgaggtcggcgaggatgcggcgaagccgaaggagtcggcgccgaggtggaaggcggtccggggcgacgatggcggcggaccggagctcggcggcgacggtggagagagagagcgatgtcgcgagctcgaatccggtgaggatg

SEQ ID NO: 5045 - DNA, 6510 bp, Oryza sativa
aactttgtttatttcttcttaattattatttgtgctctgaaaattccactaaaatttatttacacattttaggcttttaggaaatatacaaaaatcctctaagccttgtttgacttttactttgcacattttaatttttggaggctttcacacggattttaattgttctaggcataatttaaaggatatattttagggttgttttggcacgtcacaaacctaccccccttaaacggaatctcgaccccgagattcggaagaactggcgaggagatcgggatgggctgccttcagctcgtcttcacgttcccaagtggcttcttcctcggcgtggttgctccattggaccttgcaaaaacggatgacccggttcctggtcctgcgctccatggtgtccaggattttcactggcctctccacgtaggtcaagtcttcgcgaacttcaatttactctgaatcggcctgctcggatggcacacgaagacatttcttgagttgcaacacatggaacacatcatgcacgttgcccaatgaggcgggcagctccaactggtaagctacttctccgcgtcgagcaatgatgcggaaaggacccacgaaccgaggtgcgagcttccctttcgtctgaaacctgtgtacgccccgcaatggcgtgacccgaaggtacacaaaatcgtccactgcgaattctaggttacggcgtcggttgtctgcataacttttctgccgagactgtgccaccttagattatcccaaatggttctgactttagcttcagcttctctcaggatattagtcccgaacatttggctttccccaacttggtcccacaatagcggtgtccggcatttgcgaccatacaacgcttcatagggtgccatttgtaggctggcttggtagctgttattgtaggagaactcggcataggggagactcttatcccaggtcttcctgaaatctagaacacaggcacggagcatatcttctaggatctgatttagacgctcggtctgttcatctgtctgcgggtgatacgcggtgctgaaatttaatcgggtacccaactcttcttggagcttcttccagaagtgagaggtgaattggcttcccctatcagatacaattttcttaggaacgccatggagactcacgatcctagcgaagtagagttcggctagtttgttccctccataggtggtcttcacaggaataaaccgagctaccttggttagtcgatccacgactacccatatagaatcatacccgccttgggtttttggaagtccggtgatgaaatccatcccaatttcatcccatttccattctggtacttgtagaggttggagaagtccggccggtcgttggtgctctgccttgacacgctgacacacatcacaaagggccacgaactctgcaatttcccgcttcatactaacccaccattatttctctttcaagtctaagtacatcttcgtactgccagggtggatggaataaggactttcgtgagcttcctgaagtatcagctatttaagttccttgtcgtccggaacgcatacacgatttccgttccatagggttccatgttcatcttttgtgaaaccagcagctttaccctgtttcatattcttgacgatcccatgcatatctggatcattcttctgagcatcgcggatttgatcgagcaaggtaggcttggcttctagagtagccaagaatccatggctaacgatgcttaggttcagggcttccatctgttgattaagttccggtggaatgccacggacgccaagagtgttgcaacggctttttcgactcaacgcgtctctgaccacgttggccttaatagggtgatagtggattcccacatcataatccttgatgagctctaaccatcttctctgccgaagattcagatccgactgagtgaggatgtatttcaaactcttatgatcagtatatatttcacagcgattcccaatgagatagtgccgccagatctttagagcatgaaccacagcggctaactccaaatcatgggtagggtagttgccttcatggggccgtagctggcgtgaggcataggctaccacatgaccttcctgcatgagcacgcaccccaatccttggcgcgaagcgtcacagtacactaggaagtccttgcgagtatccggtaagattaacactggcgaggaaaccagcttttctttgagagtttggaatgccttctcgcattgcgggctccacacaaatttttcctccttcttcagcaactgtgtcatgggtcgagctattttggagaagttctcgatgaatcttcggtagtatcctgccaaacccaaaaaactgcggacttgagtgactgccttcaccggtagcagcacttctcctggtcgtcaccatctgaaaaccccacaaagaaccagcaaacagagagagatgacaattaaaactagccacccatgactaccacaattcttgaatttattactgctattaaattggttcattaaagttcaagttgcttaggcaaataaaataaagacaggctccgacacagttataccacacaccggcataaccatgccccacacgactccaacaagaagacaaacgagaaagaacacacgcgcaagcctactaactgctcgtctaccgctgcgacgggccaggacggaaggtgagcagcagcgcatcctccgtgctaccaacgccggaggctttcccctcctgaggaaccacgggcgcgggctcggcacgaggggtctccacgaagcaggtccatgccaaggattggcgaacaagctcgggcctggaggtactcttgcaggcggtgatcttctggctgcggcagacgcggcgacgcttggggcgacagacctctccctgggcgatcttgagctgatgcagctgcgcctccactgcgtctaggtccttcttcagctgcagattctcctgacgcagctccaggatcttcatgttgttctcgaccatcccacggcgcaccatctgatggaagtcgatacgagccgcgtcgtacgcctccaccatgcgcgccaggtgcatgatggtagcggtagggcgagtgctgcaactcgtccgggtagagctggtgaagagtgccgatggcgaggagtgcggcgttctggcaagcggcggagaaggaatctccacccgcggtgaccgccaacgaagacctctcgggtgagccagtgaggatcactgcagtaacctcccgagcagcgtggggctctgcatcgtcaccctcctgctccgggagctgcttgccctggtagtccactccatgcggataccccaggacaatgcacatgccccgcagctccaaaacgaagccagtcaggtccagaccacgacggttgatgctgccggccatctacaaacaaaaacaaaaagaaatgcaacattttaaaggtcagattttggcgataaatgaagcagcaggacagagagagactagaggattttcacaaataacaaaggatttttttttatttcgaaaatattgctaaggcttgggatctaaggcttgtcctagggtcaagggggctctgataccaacttgtcacgaccggaattaacccaacgggcgttccttacgtgcgtgtattattccttgtcccaggaggcaaggtacaccaagagttgatacatttcagagtttatcaagcggaagcgtaaatagttaatttattacatgggcagcgaaggcccagcacacacaaagacaaacgggaaacagcggaagactagggcgacgaccacaggcgcttgacggcaggcacgagctagacaccaaagccttcatcttccagaggctcctcttctgggtttgggaaaaaattgagcaagactgagtacaaccaccgtactcaacaagacacacccacaagtgcagaataaaatgcaagggagtacaagggagttacaatataaagggttagggtttgcagtaaacagcattaaaagacacttagttgctcaaagctattttgcaaatacggtcctagagctatacaatattattaatcaaggccgtgaacccacacgaacctgccttaacccaaggcctacgatgatttagaccgaactggcaacccgaccctgggtcccagctcgtcccaagccaacccaggccaaccattccacattttagttgttaagcaggttttaagaattaaaacactaacttgggtacattgctcggcttgcccataaccaagggcgcggctattcgaataggttatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgtcctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaatccaattccacaataatccaacaattccatagtgtccaggtgatgagaatatcccaaagtctagagttgtaaaatcacctaatgttacctaattaaacagcgaagcatctacctaaaatcatactagtggtaccatgagtagagtgtccactagttggggttttgtttaatctagggtgaacaaggtaataataatagtaacaataataataattattatttgtgctctgaaaattccactaaaatttatttacgcattttaggcttttaggaaatatacaaaaatcctccaagccttatttgacttttaactttgcacattttaattgttggaggctttcacatggattttaattattctaggcatcatttaaaggatatattttagagtcgttttgggacgcgacactttccttgaagcctgcattaaacacttatttcccatggcttgctgagtactcccacactcacccttgctctatataaataacccccccagttgctgaagaagatgaagcggaacctgctgatgaggagttcttccaggagcaagccggctacgatgagttatagggtttcggcctagttcccacgtcgcgcctgtgttgattggtccaagtcctgacttccgtttcccttttgtaatgcagttgtgagctcggggtctgtccgcagcccaacatgactgtacctctactctataataaagagacttctgttgctgtgatattctgtcttcctgtgataccagcactatttcctgggactggtattgattaacaggttaatttggagcgtcacgggctagttccggtcggtactagttcggggcgtgacataactggactttgaaatttccaaatactttggttaaacccttggctagatctatctctgaccataccacctgtgttgtgcaatattggtactgatattccgaaagcaaatattttcagatttgaaaatttttgggttaaccatgagggtttctttgagcttgtagattgaatctggaccaatcatggaaatgaccctaatgcagctagaaatatttctgctaaattgaaagctttaatttgagaaagggtttgagaatttggagtaaaaacctttctaagttgcagaaactaattcaaaactgtaatgctatgattcaattcctggactctattgagaagtatagagatctcactttgttggaatggagatttagagtcttaattaggactaagcttttagcttatttgaaatacaagcagtcttattgacagaaaagatgtacaatagatgggctaaatttggaggtgaaaatacaaagttttttcatgccatggctactgaatctttttaggagaaactttatttcttctttactagattcccagacttcatatgagttgagatagaaacattcattaatggtgtacctaaatcacaaggatgaaatgcatggacatcaagctatatgtatcactttttctctccgagcacatattgatatattcatatataatattttcatgtgattgacatatatgtatgtgaggctaatgttttgtttgagtcttatcgcttgtttagtctatttacgttgaggatgtggagatgatgaaggtatgcatttattttaatatctataaaaattgccaccacccgcccgtgccatgccaccggcgccgccggagaccttccctccgggcacaccgacactggatctgggagggagagggagagggagaggga

SEQ ID NO: 5046 - DNA, 14460 bp, Oryza sativa
  unsure (1)..(14460): unsure at all n locations
ggaggggctgtgcgcggcgcctccaccaactcctccgcggtacgccaccgacgatgccaacgccgctcccctccgccggatctaggaggggagggcaagaaggggagggagccagagagaaagggaggggccgcgcgcacggcgcctcctccgctgatggtgtgcatgcgccacctcattcgccaccgtcgccgtgccgccacctacgcctctcccctccgccggatctaggagtggagggaaggaaggagagggagccggagggagaggaaggggccgcgcgagcggcacctcctccgccgacggcgcgcgtgcgccgcctcctccacctccggcgccgcctccgttcggtggtggacggcgccgaagccatttctagtagagggagagccggaggagaagaaaaaaaagggagggagagaagtggaggaaaaagtgagggagaggggaggcacggaactggaaatcaaatttaaaagtggtgtcacattttgcagacggaccgtgaaaatcatttttttcagatgggtccgcctgcaaaaatgaaggtagttttctactcagatctcttaagtcgtctggctggaaaaattaaatttcgcaggtggatgacggtctcatccccggttacctttttgtaggcggctgtttagctccgaggggcctacttgccttgaaaaaaaaacccacgtctagaaaaaatggtttttctagtagtgatcacatgcgggcagaaccatctccagagaagcgattttgtagtattgtttgtcagcttaaccattattgcattttggtttttcggtccgttacaacacatcgacacactttgctagtaattacaatattgaaaaaaatattttcaaatattgataacaatgttacaaatgcagcatgcatgcgatatccatgcgcatcacgcacttattacatatatatcatgggaattatccaaaatataaataaaaaaaatttagtggaaggtatatatagctaagattgaagggatgatcgatcgatcaatcatggctttatggcattgaggaggcggatggctgtggtcgtgagcaggtctatgacccaaacggtgggaaccttcttgtcaccgtacttgaacagatcacctaacttgcacttgctcgcggtctcatcgtattgggtctccaaattcttggtccacttgtgcacagtttccaggtcctccttactgcgtttaccttctccggcggcagtgaggcgctcgagcgcgtatagcgtcgagttggtggtgtccgaaaaggtttcgccaatggcaaagaaagacccgcagttattgatgttttcgtccctgatgcccatgtctcttatcgcgtacgcctcactagtgagggcttggatcttggtgactaagatgatggtggccacctgggtgtaggataatacaagtgagcaatctccgtatccgcataaaaacttgattactgctagtttcatttctcacatggtaattaatgtaatccttgaaagaaaaaagaatatgaacgagaagtggaataagcgggcaaaagaatatcccgcttaccatatagagacacacacacctatatacctacctgagtggccttcacttggttgcccttgaatgactcgccatacgggatgagtacatcgtagcagcgggcaccgatcatctgttccgtgaaggtgctagttccaaaatcgcagacttgttgggtgaaccggtacgcctccgttgagggttccttcccaggcggcaacggcggtggcagctcaaggttgagtttatgaagttccccctctggcgctgcagttgcaccttgtggggataagcagacgacgttgatggctatcaacaccaccaggaagacagcggccatgctcgacctgctcattgtatttatatgcgctctctctgatctctctccctctcagtttgattagaagctacaggatggattagtgcatctatatgatcaatcgatgaggtacaaattaatttatactagctagctaggctagctcgatcgattggtcagtactaattgtcaacctttctaatttcttcaatggctgtgatagcatcacggcatgcttgcattcattttgatacaactagctggtgatccgtgatcctctatgcgtttctaatggcatacatcagctattctaaaaatagccatgcaggggcaggcaacgcggccagcacacatgtggcaaggccgctagcgcaaccaacaccggcacgtaccctttaaacctggtacagttgggctggaaaaggccggagttgggctgcagctagcacctgttgatcaacccactatgaaaagagtccacgcaaattgaacaatgcatgttctgataagctcagtctgaattataaccccacctatccccgtgtttccgtcgcattccgtctcagaaaatatttatcccagtgtttcgcactagtaaaaaagggggaagtcattgccggttcatcactgcctacccgtagtgtcgatcatgccctgaaaaactcacttgataaatggaataatagaaattattagaagccattgaagaaaattcaaaaaataaatacgtccaagaaaaatcgaaattttcttccccgaaatttacgtcaattttgggagcacaataaatccctatctctactacttaaaaatacactacatacagtgtaattttacaaaattacatagttaaattatgcattgcgtttcaaaaaaaaaagaggaaattatagtgtagttatagtttaattatgcaatgtctaaacttagtaccgtgcttcatgtaataggttttctatgctttattgatgctaatttagtgttaatcatactgattgttcgcaaaattattgtttgtttgcaaagacactcacagctgttctatcctgtgatgctgtgttgtttttcagaagaaggatgacgcaaatgaacttttaatagctcttaaagctgagaaagaggaactagaagcagcacttaacagggagcaagtgcaaactatgcatcttaaagaagagattgctgaagcagaggctagaaatgcagagctgacgaaggtgagcctcctgccctccttgtacatattttagttgttctacttctgctcctagtggctcttttcctgcataatctttcaattatgcaatgaaactatttttacagattcttctgcattaaattattattgttacattttcatttgttttgtaatctgctatgtaacctatagtctgagtagtacacaaatcctatggcactatttaacacatgcactaggattgagcttaccctttactgaaagtgtgtgatgttcattgctagcggtatgtattatcactgtttctaacatgtcttggtcctggcatatagggaaaatatgtagtgcaaaccacatatgtagtggaaatctggaaactaccgttggataaaaaaaatgaacgcatgagatttgtctatgtcaccaagagtcatggttgaatctaggagtaaaacttttattctaggcaacttggacaaatctcatgtgtccaacaatagttttccagaaatgctatttgacggaatcccgtcccaaccgtgatggacgggataggacaacaaccaacaaatccaccgattctatctccttctacctcatccattctaccacatctctcttaaagcatgcgtactgctgcacgagctccggcacagcatggggtgtggatggcggagacgcgtcgccaacgacgagctccggtgtgaccactggcgacgagctcccggcgtgacatggctgtggatgatggaggacgcagccttcggcgacgagctccggtgtgatgtggcgcgtggacatcggaggacgtggccccaagcgatgagcctggcatggggcgtgagggcggcggaatcgaccgccagcaacaagcctggtgtggggcgtggcagtgaaggacgaggctaccggcgacgagctccgacgtggggcgtggacgacgcagaacgcggccgccggcgacgacctccgacatgaggcaaggggcgtggagggtgtggccaccaacgacgacgcttcggttctcagcttcttatacctggtaggaatcacctgatatctggtaggtatcatgtaatacctcacttgtatcacccgttacgtggtagaaatcatctgatacctgataggtatcacatgatacctcactagtatcatctgaaacgtggtaggaatagtcaaatacttgataggtatcacttgataccggttagatttcaggacatgataccttagaggtatcaggacctaatacctaacaagtattatcccgttcgaaaacgggattccgttgtataacaaccctctagttttcagatttccactatgtatatggtttacactatacattttccctagcacaaagtggaaggttttcaacttttcacttcaatctcattcaaaagtatggtttcccaaatttcaggagctatgtagtcaatatcatcatatcatttgatggaggtgtttcaacggttcaaatggagccgcatctttctgatgaatgcgattgataaaagggatagaaagcatatgaattaaagaattcagttagacatcacatacggaaatctatatccgtacgcatgaaggcaaagcaaaaaaaaaatcaactctctttgagtgtgtgttagaaggcgtatctgtgaatgtgtaagtatggtgtatgtatatagtggtggtagcgtattgtgttaacgaccaaatttggtaagatatgaaccaggttcgacattggaatcaaagcggattcggcaaagagatggattcgaagaacagagtatgtatcagctgcgagggcatcggctggagtatgcattggctgagatgggatcggacagaagacaggtgatacaaccgatagagatgatgcagccgattcttatggtgatggcttcaaggctgtttgtagaatcaatcaacgtgcttcacaaggattgccacgatggagataaagctctcaaaaaggcaattgtatctattaattaggatattttctataatttccttagagatatgtttgggaaaaagtatgccgcaaagacttatggtatcttagaatttgttagagataagagtcgtgtccgagaaggacatattttgtatctcgggtataaatatgacccgaacccaatgtaatcaataacacacattcaataacactttcgtcgcatcgccacccttttactttcgttctatttcgatgagttcttgctttcaggttgagctgcatcgattcgatcttcaactagaggtaaacttgtcatgacggcttgcgttctcgggactagtgcttccatcttcatgatactctaatcttgtttatgtaattcgtcgagttatcatatatacgttataatctctgtaagttatgctatataacttgccatcgattgattcttactgttagaaagtagccgatagagttatatctcgttattaacctagattatatcgtatatccaccatctcttataggttttcatcaacttgtttagatctcatggttgtctttacgcttaatgctgcatcggttgagttcgatcaattaagttttatctataactgtgatatctagcctgttttatgattatcgagagagatagtatcggagtttcagctgatcttacctgatttagctattttttatatatcatatgtttgattgatatgttaaatctgccctttatattaagatcttattgcattaagaaatattagacttcttgtttgatatattctgcttgttttgatatcttagtatagagtggtatccgagtattagtcgatacatgccagatctatctgatcggctatgctataaacatttatataattattgctttagtgtatacttcgacttaagtgatttatactgtctcggcgtggcgaccgatctatcccaatcacttagtttaaatatacatcgaaggaaggattatatatccttaatatctacagccgatcgaatagatttagttttatcttatttatttataacagccgatcgatttcaatatgacattggcttgaagataaatgatatgtcatcggcaactagccgatcggctatcatttatggatttaactatggttttcttgtctttctttcttgttgattgcaggatcaaatcaactggcacgctcacgaacctaaaagcaagattttggacgtgcactgaagttaagcagattttctaggccagtgtgtgtttttcgcatcaacacgtatgtatccgtgaatgtgtaagtatggtatacaaaacctctatgtaattaaaaaaatatagagaatttgtttgggtagaagctaactttttttaccataacctaacttgctaaaagtatgataaatcacacatagtatagccaaaaaattgttggcccgtatagcaatatttagctacaaaattatcctatgaccctatctagggaagctttaaaattatgaatacagcttatgagaatttagagatgttggtttctcagcttctggtttttatttttataactatttttagaatctaaactacaatcaagactgatcgagagaagttttgataaatgaaagattctaacaaaatgttacccgcttcaagctggagttacatctccctatcaaatttctaaaacttctcttattccctcttgtcattataattaatgttctaaaacttcccttattccctcttgtcgttatattaaattgtgctattctcatttgtgagcaaagagcagcaactgttctttgttccttatttctgttaatttattatgcaatcttttttttgcaccatacacctcaaattactttatacttcgtatatgcttttaactaacactatgcagatgtaagccaacgcggcgaaaagccacgcttgtacttctagtgatattatcagactaaccaatgactgctatggagatttttgaatttgtgaacgatgtagcactggtggagaaaccctttgtagtcccggttcgtaacccccctttagtcccggtttccaaaccgggagtaccaatccgggactaaagatcgagctgacctttttttttttgcatggccctgttgctgcatggtttttatatatatatatatatatatataaaccatgcatatatatgtttcaatacatatatatgcatacatatatatatatgtatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacactagtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtatattattttctatagtctacttatatacaaggacctaatttattaaaggagacgtatagtaagaaatctaaccgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggcggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtaaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtcgatgttggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacatgtcgattcgtcctgtgtttgcatggcgtccatgctctgtgatcctacctgcctcgttgaggcgcagctgctacggtttcctgacgggctcaccattgcaggaggaatggtcggctggggatcatgggaccgatgtgcgaacatgcgttcatcaaccttccttgccacctcctcttgcatgttgagttcgtagctcgatacccttaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgtagggcgagtgtcagttcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccactttggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttaactttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtaaccttgttcttcgccagtacaccgtactgacaggcacgttatcccgcacaacccaaccgctgtgacgtacatagttcttggcggcttcggccggggcactaggacgtccatcttcttgcacttccgttatgatgtgtcgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgtttccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtataaatgtcgtacattagaaccctacacaaccttacgtgctaagtctaattacaaatcgtgatataagctaagtctaggtgacgtatattgtacaaccctagctagtaaataattatatactaagtctaattacaaataaaaaaatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattagaacactacacaatcttatatgataagtccaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatgttacttgcgttacatcattggcaaggacaaaaggttcatccgagtatccaaccttgttaaggtcaacagttgtcatcccactgtcatcaatcattacgcctccatcagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgtgatcgacccagacggtcccctcgccaggaaggcaagttgttggttgattgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttctgggtgaaggtcgccgcgttgttccatatgcttcagatcattacgtgcttccagtgtatctttcgactttccgtaaaaacccacaacccctctttaggngaaaagggccaaagaaggtttacgcaaaggttcttagtgaggtgcatcacgtcgattgcgtggcgtacgtccaagaattcccaatatggtaactcccaaaatatagagttctttttccacatcgccgcgtgaccatcatcgctctaaatatgctggcttccaggcccctttccgaacactactttaagatctttaaccatagcaaacactgttttcccgctgcgatgtttaggcttcgtacggtggtcggccttatgttctaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggcccatcgttgatggttaccaacagcagcgctcgtaggttaaaatcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccaggggggaggttgtagatacacatcgttacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccc

SEQ ID NO: 5047 - DNA, 1140 bp, Oryza sativa
gatttccaaggtttgagccgatcattgatgatgatggagaaaagatcaccacatgccgatgcatgtccttcggagaagcagcatcggtcagcattgcatccaaactatcggctaagcccttcagcgagtggttcaacaatttttatgacggggttccccagaaacaccaggatctggtttgcatacgaaggatctgctggttttgagctgccaggtgattttcggtttgaagagatcaattccgaaaaatatgacaaatctatagaagtatactcaacagccatcagcccttgcatccttcctgttggcatccaccaaggcaaaaacattcagatgacctacgagttctatcatccgataagtgctgcaaggcaattgggcatgggtcaactgccaattagcctattctttgccgataagatccaaagtagaggagagatcacatcaacactcatgatggatcggctgctgaacatagcaggaccacctttgggtagtatcaacaatatcaagctaaggatgttgagaagtgcagcctttgaccgatggtgggtagaatggaagaaacatttatctcaccaatcggcttcaatgtatctgacagatctgtttcctgaagctgttcctcaagtaagtatttagccccttgtcaattctattaaccacaagccgatgcattaatcttaatctcatgtaaattctttctttctctgcagacaatagaatcttctcctcctcatcacagcaatagtggtatggagattcaatatgctccaggacttctgcccaatggtggtgggcgatctcctccagtcatcggctataatgcccccaagacctcaacactgctgcacggcctgccccgtgtgccgatagcccctgatgctggtaggaagaagagagcaaagtcggctgctgcaccatcggctgcaaagaagaaacctaagaagcaaaagaccactgccgatgaattgccagccatagatccagatgtaacggaattcctggaggatgaagcaacggtagaagatgtagatgaagcggctgaacacattagtgaaacaagggaacaaactactccagctgatccacctgctcctcaaagaacaccatcaccttcagtacgtcccacatacaaac

SEQ ID NO: 5048 - DNA, 13504 bp, Oryza sativa
  unsure (1)..(13504): unsure at all n locations
tgctaatcggtatttgtgttttcagcctcctcgtcctccaactcatgttcctgaatcaagtgaaaacactccatcggctgcagacagccatcatgtggatgaagaagaaaaagctacaccagctcctgctattcctgtaagtatataccttaagtctgcaaatcatatcggctgccatctctttttacataactcataatcccaacgtttctcttttttaggttttagctgacatgttctcttttgacattaggcaattcttggatgaagaggaagaaacaacaagcaaaactctggtgcccttagctgatgatatcaagtcaactctactacacatctcaaaaaggcttgaaggctctctagaaatcttggtgacaagctgtggatccatccgagatagacttaatgaaatccatgacaagatcccggatgagctagcgaatgccatcactccagcagcataccttaagcagcatcggcttaaacttgaaaaagcccaaaggaggattgccgatcagcgtgaaagaagagatcttgaggcaaccatccaagctaacagggtttctatcaatgaaaagaaggcaaagcttgatgaattggaggctggtacaaaccccactcaaactaacattgatcggctgaatgctcgaaagatagaactcttggctgagttggagcagtgcaatgcaccggtcgcccttgaacagcaaaagcttgctgacttgccaaaaggcattgaggatcagaagtcaaagttgaaagtatctgtcaagcacttggccgatctgaccaaatctctgaaggtgttcccaagcactgatgcagccgatgcccaaatcatagacgaagtagatcatattaggcaaagggcaatatcggtcatccaaaaatacatgtctggatgagctaagtcttgtaattccaactttaaatttgcaaacttaacttttgggacgtaatataactttctgcttgtgaagcttgctcttgaattttgcttttgaaatccagacttgtcatatatatttgcccccctaattatgcaatgttgaagacattgataaaattataatttggactaaggacgatatgtcaaatatcggccatcatacatcggcaaagcacaaccgattatgataagaaaaatccactaagggcaatataatctatatcggccatcatatatcggcaaatacagccgattatggtagaaaaaactgctaagggcgatataacttatatcggccatctcaaggcgatgtcagcacatcggctaacatgtatcggcaacacttagccgatcatgaattgatccgaacacttggataatatttctttaagtattttccattacgagctcgtccaaaaacttcaccatcaagttcttgcaacatataagcccctttgtacacaactttgtatatttgaaacggtccttcccaattaggtaaccacttgcagaatttattatcgcgagttcctattgacaagatcaatttccaaactagctcccctttagaaaaggatttgggcaccacctttttgttgtaatgccaagcaacttgttctttatctttagtcacctttgcaagggctctcaatctggactgaactagatcttctgtttcatctaccataagattgtaatactcatcggctgttaagttatcttgtagatctattctccttgagccgattgtagtttcccatggtaagctgcctcatgtccacaaacaagcttataaggaggaacttgaatcgatccatgacaaccatccgataagaccataatgcttcagccaaccttgtatgccattgccgaggaaaatcagaaatctttctcttgattaatttaatcaggctcttgttagatgcctcggcttgcccattagcttgcgcataatatggtgaagaattcaacaatttgatgcccatgctatcggcaaactaagcaaattcatcagaaacaaagattgatcattgatcggttgttatagtctgaggaatcccagatcggtagataatatactccttgacaaactgtattgcatccccagaatcgactttcttcaaaggaattgctttcacccacttggtaaaatagtcggttgccaccaatataaacttatgccccttgcttgaaggtggattgatctgaccgatcatatcaattccccaacctctgaacggccatggcttgattataggattcatagccgatgctagtgctctctgaattgctccaaacttctgacaatcttgacattctttgtaatatcggaagcaatcctctaacattgtcggccaaaaataccttgtacgccgaagcaaccacttcatcttgtgagctgattggtgagtaccgcaaataccttcatgtacttcgcccatcacaaccttagcttgatcggcactcaaacatttaagcaatacctcatcaatcgtctgataatacagctcatcatccaataaggtatatttcaaagccttatagcgcaattttcgtgaagccgactgagatgaattctgcaaatactgataaacatcatacctccaatcatcggctgtgattgcagctacctccacctcaatatccttcatcatcggcttgtatcctaacgctccatgagccaagtcattagcttcaacgttctgctcccgagagacatgcttcaaagtcaccagacgaaaataattcattagttctcggcacttctcgttgtagatcatcaaaacatcatttttgcattcatattctcttgccaattgattgatcactaacaaagaatctcccatgatctccacagcatcggcttcaacctccttgagcaattgcaaccccttgagatctgcttcatactcagcctggttgttggtcgcataaggtttgatagtataagcaaattcaaaacttgccccccgaggagaaattataaccaagtcgataccacaaccaggagtgcaaagtgacccatcaaaaaataaagtccagggcacaatctcaaccgagccgattgaatcatcaggatgttccacaataaaatcggctatagcttgccccttgattgccttgggtgattcatatctgaggtcaaattctgttaaagcatatatccacttcccaactctccctttgaggaccagagccgacagcatatatttgatcacatcagctttgcataccacagtgcattcattggataacaaataatgcctcaactttgtgcaggagaagtacaaacacaagcataatttttccatcggagaataccttgtttctgcatccaagagccttcgacttaaataaaaaatagctctctccttgccttctagctcctgaatcaaaaccgagttgattgacttctcatcggccgatagatacaacctaaaaggcactcccttttgtggaggaattaaaactggaggggaactcaaatatgccttaatattgtccaaagccttctgctgctctgccccccaagtgaattcttgatcggctttcaaccttaacaaaggtctaaaaggttccaatctcccagataggttagatataaaccttcgaacaaaattaatcttgccgatcaatgattgtagttgtgtcttatcttctggaggttgaattttcttgatttcatttatgctcctttgagatacttcaatccctctctcatgaataagaaaacccaagaactgtccagctgatacaccaaaagcacacgtcgtgggattcatcattaggccatattttctggttctctcaaaaaccttcctcaaatcggctatgtggtcctctacctgttttgatttaacaaccacatcatcaatatagacctcaaccaacaagccgatcagatcatggaatatgtagttcatggccttctgatatgtagctccagcactcttcaagccgaaagtcatcacaacccactcaaataagctgattgcaccaggacatctaaaagcagtcttatgaatgtcttcttttgccataaaaatctgattgtaaccagcattgccatccataaaacttataattttgtgacctgaagtagcatcaatcaattgatcggcaatcggcattgggtactcatccttaggggtagccttatttaagtctcgaaaatcaatgcacaccctaagtttgccttttttttcttgatcattggaactatattggaaactcactcgacatatcggcacggttgaataaaaccagcatcatataatcgagtaatcttagccttgatagcatcatacatttgggccttacatctccttagaggctgctgatgtggtttatatcctagcttaataggaagccgatgttcgacaatcgatcggctgaatcctggcatctcataatattctcaagcaaagcaatttctatattctttcaatagctctattaacttggttctgaattctgcatataaattcttactgataaatgtcggccttggtctatccctggaccaatgtcaacttcttccaaatcatcggccgacatgaaaccctgtccttgcttgtcatcgagatcatctactgtgtccttagtgtagaaatagaaatttgaaccctccacgatgctgttaacgccaaaatttggtaagcccgaagtcatcatcggcctagagtcagtatcggcttcagagtcttagaatcggccgatgggagttgtcaagtcgccaccagttgtgttcttgatggaatcggatcaattaaagaaaatttatctagaagagtccgaattcaaggaggatgcggcatgtcaagttatctattaattaggaatagttttttttgccgccggagcagagctcttgcctgcgcaagaccaccaagacaaaccccatcttctcctctacaaccgtgttgacgtataacacgaggcctgggagatctgcttaactccagtgcaagtccaaaactcgccttccggtatgctagcatgccagttgatttgatcttgcaatcaacaagaaataaagacaaagaaaccgtggttaaatccataaatgatagccgatcggctaagtgccgatgatatatcatttatcttcgagccgatgtcatatgtaaatcgatcggcagttataaatagataataaagaactaaatctattcgatcggctgtagatattaaaaatatataatcctggtgtcgatatatacttaaatcaagtgattgggatagatcggtcaccgtgctgagacagtataaatcacttagatcgaaatatatattaacaacaaaactatatatgttcatagcatagccgatcaaatagatctagcatgtatcggctaatactccgatacaactctatgttaagatattaaaacaagcagaatataccagacagaaacttaatatacttagatgcaataagatcttaatataaaaggcagatttaacatgtcaacgaagcatatagagcaaatataattaaaccagataagatcggctgacactccgatgctaccctaatcagcaaccagaaggcaggctagagattgatattctaagcacgacttaatagatcaaactcaactgatgcaacattaagtatgaaaagaagagcaatatctagacaatcaagtcgctggaagtttcacagggtggtagatatcttatataatctaaatcaacaccgatgtctaacctaatcggctgccctctaccgatagatattagccgattgtaggttagatagcgatattgccagagattatgtaagatatataataactcgacgaattacataaacaagattagagtatcataaagatggaagcactaatcccgagaacgcaagccgtcataacaagttttacctcttgttgaagatcgaaaccgatgcagctcaacccgaaagcaagaactcgtcgaaataaaactaaagcaaaagggtggcgatgcgccgaaattgtattgaacatgtgtgttaattgattacatggggttcaggatctatttatacccgaaaattacaaactatgtccatatcggacatgactcttatctctaacaaactctaagataccataagtctttacggcagacttttacccaaacatatctgtaaggaatttacataaaatatcctaattaatagatacaattgacttctcaggactctatccatacgtggcaatcatcttgaagcatatcaactcaactcgatgtcgtacataagtcatattgccggaatcggctgtatcacttaacccagtctgactcggacttagccgatccaatcgtagccgatccggactccagccgattcctactctggttctgcaacaatcttcatctttgattctacttcgatcttatcctcatctccgatactgatataaccaaaaattggtngtaacaaaccgacttgattcaccgnctctcactgcctataaaaggacgacgaggtcgcccttttcttccatatccatccgagctctctctctctttcttcttcatgtcagctatggccggccgtctgccgatctcccttaccggagcgttgtcggccaagtcctcgcgccactagcttcgtctcatcgaggcgaatccatttcacccctttcccctttcccttcctgaaacaagccaccacaacctcctcttttgctgccagagcagagctcttgcctgcaccgttccagcctcctctctcactttctctgccgactgtcaccctccccgggtgcgcgtcgctcgagaacatgttttaccaccgacgttgcagcctctcaaccaccggagtaccggcgcccctcctctcccttctctctgtttgttcatggagaaagagagaagaagcaggaggaaggaggaagaagaagaagaagaaaaagagagaaaaacaaaaagaaaaagaaaaagtctgacaggtgggcccctgcacagtactactttatattttctagatttaacttgaatcctattctttagaagcccatatctcctaaaccgtagatccgattccagttaaacttggacctaaattcatctaaattcaaaccctaccttttgataccaaatttgctatttaaatattttatttgaatttccttgatttatttaaatgtcatttgcttttcaaatatctccttttactccaaaataccctttagccactaaaagtcgccggttagaactttacgccttccatggagacgttcgtgtggtatattggccccgacgtcgaaccgttggttgtaaagcccggcaaaacccaaacccaaggtcaaagtgctgctctaggtaccccacgcctcgatgcgtacaacggtcggagcttcactattccctcgacctccacagcacgtcgcacaattagctctcgggctctgtgtgatcttagccgctccacaaccactcacggttgtcggagtaacacttccgccccactaaattaacctgcacccaccccctattcctccagccgatatgttgtctgctgacaccggctagagaagacaccaaatctagtcgttatgctgttcaacactagcatcgactagcacacaatcaaaccctagctgataccttgctagataaatcctagccgtcatccaaattccacacccaccagtatcgcctatccaccctactctcagtcacctactctccaaacaaccaagacccacacatgaaatataagtgacatttgttgcttgatcccctttctatcttagcctccaaccctttagaacccatacatgaaatattagccaataatccctataccttataaaggagatatttataccccaaacccaacatttcttgcccttcatcgctttcttgttattttctgacttttattgaatttggttctttctcttctttagtagagtctattttggatggcagcctgtgatatttcgaggtgcggatgatcaggtggcctatcttggatatctctgcattggagcaaggcaagttattattccttccctttgagcataaatgccctatattctatattctattctatgccctagccatacatgattttgaatgcataatctgaacatatagcgaactagttatatgctagcttttgcttagccctgcctagttagactgcataaaatataatgaacttagattggaacagtacgtaagatttggttgattttcgggtggctagtactgttttggtcgatataagtttaccaagtacttatgtcaaatgaacgagtacgaccgcagcttctagaatggggacagacctagatattatgttaattaacaatgtggtacctctgtatagtggttcttatgtaagtcctcgcgaaggaggcaaacttacgccgagcagggtgattgtaatatttaccgaggcgcaggtaaatatttgagataaattgtaatatcacgaactctgtgtgtattgtgaaaacctggttgagatgacgggagtctctcaaccagttctctccaaaaaccccgggaacgccagaactcctttcgctgctgataacgttacgttcagagcacatggggactcaagttcatggaacaggtaccacaattgttgataacctaatactgggccgtgactaagctaatgaatattggcaagtcgtggattgcgagtaaagcgtacatttactgcagtaaagtataaatgaatctattcgaatagttgtgctcatggatttgagtattgggactcatatggtatttggttagaaacttaattccgaaacttaaatactgttgcatttaaaacattctaggctttcttactctatattctttgctttctgcaagtaaacctagctctactcaaatattaccatttcatgcattcattattgaatataatagcttgctgagtacgttgtactcgcccttgcttcaacccgctttttcagagtcaatttgatgttcttaccgaagccgggagttcaatcatataagttagttccattctaacttaattctcaagtatagactagataaatggtttaagtctatatcaaaacattagagttgagtcattctatagcttctgctgtaatagttagccacaaacttgtaaataccctaatattattctgtaataatatctcctttgaaaccttgaccaaatatatgcaatgaagaaccaaattgttgaacctgtatcaatctactaatccagggcttgatacagtctaaccatgtcggtttccgaatcattagttttgggacccgacatgtccgcagccgatgttatggtttgagcctaagtgatgagcaactagccgatctcgccttccaaggattgtcagcagctatcagagagagattcttttgccacgagtttgacaaccatgctcatctaatgcaaatagtatcagctcatgaaagccgattacaagaagcaaaggaatattagttttggggttatcaagatcagaaagaagataattttgaagcatgagttctcatactccaaaactggggggcatgtgttaacgttaaaatttggtaagcccgaagtcatcatcggcctagagttattatcggcttcagagtcttagaatcggccgatgggagttgtcaagtcgccagcagttgtgttcttgatagagtcggatcaattaaaggaaatttatctaaggattactggtgtggtggccctgttctctttttttttttgagcttcttttcgttaaattcatttttctctcttagatgtgacatgactaaatacagcgctgctgtaaataaaaaataaacatcttctgttttcattgttttaataggtaaatataaagatttttaagtaatatttaaaaatagtgctgatcaacgacattgtcactttattaaaagttttagtttgttttttctccttttgagtttgggcatataccaatattgagataggtaggctaaagttaattatgttctatttttaatggattgggtttgtaatatcttgcatgcactcatatttgtatgttttgccttgtgagagaaatctatacagtttttgtgtgcgtggatgctgggaatgactagaaattcatagcggaaggtttcaatgaaatgaaagaaaaaaaagcagtgtaggaaacaacgcggaaggcatggacttctagttgtagattgggtctttgtgaataaacctggactcctaacctgctctggacggacctggactccagatggacatgggcacaatgaaggaatgtacatgtaaatttttttcctattaaagagctccgattatgaaaattaaatcaaactgataattttctgttcgtcacatcggtatttcatccgtaaatccaatccagcgatgccctagcctccgttctcgtacgcactttgtccctaccattggtgattgctttccctgcggaaaagaaaaacgcatccgcacggtgcaggattgaatttctgatcgactaggatcgggactgaatggatcgtgttagctcctcaccgtcaccggtgtgcctcgcgtcgttctgcatagagatggccactttgcatagcgatggcctccctggtgggccagcttgttcgtcgggagcacctccgcgacgccgcacgccaagccttgagtgtcgtggccttgagctggggatgaccctggacaggcaaatagccccgtgacactcatctcacggcatgcactgacgccatgttggcggggtcgacatgcttggatccgcggaaaggttgccgatggttgtagtggtaacttatcaacgttgagatacatagcaaatgcaaattcgttgagctacaccctccaaaattatcaccatagatgggctcatcagtaatgctccatatcaacacgacaatatggaattcacacgatttacacaactcatatgtataaaatttggagatatttgcgaggtatatacaaattcaatgtttttatgcacatgtgttataagtacacaagcaatcttatctatcaatatttatattcacccggtgcaatgcacgggtatatttgctagtacagtaataataattcttgttgtagtagtaatcctgggaaaaatatataggaggatttcccatctagaatatccaaaacgaccaaacccatctagaatcccagatttcccattttacccccgggcgcaaaccctcgccgcgtctccccgatggccggcggcggcggcggcggcggctccccctcgccggtagccgcctcggcggcccccgtgcaggtgcgctgcgccgaatgccgcggcgtcctcgccgtggcccccggcatgaccgagttcatctgccccaagtgccgcatggcgcagcgcctcccccccgagctcatgcccccttccccgcccaaggcctcccttactccgccgcctcagccacagcctcatcctcagcttcagccgccgcctcctcntgctcctctccctcccccttcccgccgctccgcgccgcgagcgcagggcgtggaccccacgaagatccagctgccgtgcgcgcgctgcaaggccatcctcaatgtgccccatggcctcgctcgcttccgctgcccccagtgcgacgtcgacctcgccgtagacctctccaaactccgcaatttcctcgccacggccggtccaggcttcgcccctccgcttccgcttccgccgccgccaccaccgccgatgccgcccatcccgctgccgcacatgcccttcctcccgatgatgccacatgttccggtgccgatgccgccgatggcatcgcccgctgaattgcccgaggagattaatgaggtgagcaaccagcattgtactggttacagatttacagttgtggtggaatgtgtgtgttatttcaggccgaaatattacagttatggtcctactgctagctgactgaatttatgtctgaaggcttaccgttttctcagaatctgtcatgtatggatgcccatgctcatgttatgcttaggagagctttggctcactggaacccttttagagtttttttttaattttgctgtcaaatcacctctacattcgtggttacccgatacccatggggaaccgcattatagtacatgtgttcttttaccaggaatcctataaaagatggtattgttgcctcatgctcatcatctatttccccccagttggtaataataggagagcagtgaacccataagttgggtaggctatggcctatgggacacaacttctaggcttgtgatttccagaaacgaaacttcatggaatgaaaagctataacttgcaccattgcatggacatgggcttgatttatttttcttgtttgcttctggacaaacaactcggtatgatgactgtgacttgttacgtcatgcttgttttggggttgggagtgtcggatggtatcttttatgatcctatcaataaaggaattttgagattggcaccagaaacctgtttctacccttgattctataaaatataagtgtggcttctcacaattccatgtgattctataaaatataagtgtggcttctcacgattccatgtgaatggtgaacctgtttttaaccctttgatactgttgtttgggcaactgcccatacagtttggcccacacccagtttctatacgctttccatactgaagacaatgggctgaattattatttaggtatttgtctcatcattttcaatttttttttgtctatatgcaagcatgaaaaaataaaccttatatttttgtttggagggagtatcattggtgcacgtgaagtcttgagtattccataacattctgtcataaacattcagttgttttagcgcattttcactcaagaaccaatgccactgccttcttgctattatactggggttctaactgtagctatcttcaagcaggttgcagttgatgttgagcgtgaggaagatgaaggtggtactgtcggggaaacttttatggattacgtaagattttaggtttttgactgcttttatagaaaatggagggtagttccttcaagtccaagatctgtttctgactttctgttttattttttatgagctctaattttttgccatatttgttttctatttccagaggcctcccaagctatctcttggtcttcctcatccagaccctgtggtagaaacttcatctttgtctgcagtgcaacctcctgaacctacatatgacttgactattatggatgaattggatgagaccaaggtgttatcttgcttacaaattgaaacgatagtgtatgcttctcaggttagttatcttcttgctgttgacacgtccttatttttaaatttatgtatgtattgcatctgttgtaagtctagattcttgtatgcagaggcacctttatcatctgcctactggtgctagagcaggtttctttattggcgatggagctggtgttggtaaaggccgaacgattgctggattgatctgggaaaattggaaacagggaaggcataaggcattgttagaacatatgaaacaaaaagaattcagttacttatctgacaaaagcacctaactatttggtttggctggactcatg

SEQ ID NO: 5049 - DNA, 2300 bp, Oryza sativa
agttatctagcaaaaacaaaaaaagagttgtaactcacttggattgatgctactgtatgcaaatacaatattggagtacagacacagcaatgtggtcgtgtttgaatcttctatccaaacatataagctggcatgcaatgttatttataggccctgcttgggggagcttttggcagctgcagcttctgccagaatctcaagctcccccaaacagtccagattcttactcagattgtgagaatctgtacttttagaatccataaaatggattagaagccagaagctaggaaactcaccttctccagattctcaccagcagattctcagaattttaagctctcccaaacaggggccgtattaacatattagatcataacagagaacaggtgacttgaaaataaaaatgcaataaaccagagaaattatcaaatccatttgtggacatttgcctgcataactaaaacaggaaagggtctaagaaagtaaactcgaattcattttcatgtatatgtcaatgcttagcaagtttacattgggcataaatttctgagagtaccaaaacacaactctgtgcatccaaattggtggttagcttcatggttgttaaggcattgctgtggtgtcgacaaagcggtaagcaggtgcaggggctaaggcgttggctctgctttttaggaaaaccagaggagcaaggaaaaaaggacttaagctcatcatggaaccctagttggcggtgtttctgtcccgcctcagatctgtgctaccatcctccactctgcctcacggtcaatgtcctccctgtcccgtcgttgagaaaattgatagaattccattcttcaaagtgggctttgataagatgatatccccttacattgcactctttaaaatgccagaaattatctcttctatatatttttttcatttaggagattttaagtctgctttagttcttttccatagcctggacatgtggcttagtcaggacctgactgagccgcacccatctgtctagagcacatgtccccgttcctcccacgcaggtggccgcaactgcaagactagcaagagttcttcctcccccgggacttttggctctctcctaacctcacgctgcagccgctgctacgtatctgatcttgcaccaccctgagctgttgctgtcgcattggatgctggatgggatgtagaccagtgccacgaactccagtggaatgggcatgagggcatggcggttgttgccgcgggtggttcggttgtcacttgcttgttgaagaagcctcaagtcatgccttcggagaaaaagggacatgcgagataaatgtgtcttctcaagtacccagaatttggaatagaaattaaaatagacttagccaaagatggcaaaatatacaagaggcaaggtagagtggcattttaaaccatgcactttgaggagtggcctttatgaatcctctcctggcatgggtggagagagaacctgtttggctggagttaagtgcaacgtactatagtgtggtggctggctggatgtaattctgtgccatatcttttctcatttttttttattgtgcaaggcatggctcgcgttatgctgtctgtaaggcagggtcagggtcgccttacaaccattgttagtgctgtcaataaactggcctcggcttcagctcaatacaaaacttagtgttctagggatcctagtgcatgcttcgtggaggcaggctctgagcccagatcaaggtttgagcaggctggtgcttatattaaggaagcttgataacaaatgcggatccaagttctttatctttagttattgtgacaaatcaagtataatcaacactagactcatcaagattttgagaccaaaagagaatggattcataccaaatgcctagatcatgtaaaacatgggcatcaggacatgtctagaacttgtaaattcacagcaactgagctctgatagacaaagctcacgattctgggcagctctagctaggatcatctggagctctagcctagtttgaatcaagctcagagtgggcggagttcaagcaggttgtaattaataagaattatctatttcttaaataattaatcaatatagtagtctagggattagtgaactggtatcctatctgttagtttagaaggctattggtttgttcaagatgttagagatatgatttttggtagttaggcaagtattctattcttgtaggtcaagtactgtacacatcagcagtacccatggctggcatatccgcataaaagtgctcacgtatgcaagtatcaatcaactagcc

SEQ ID NO: 5050 - DNA, 3001 bp, Oryza sativa
atatatatatatatatatatatatatatatatatatatatatatatatatatatatatttaggaaagtatttcagattttaatgctttatctgtcttgtactttcaataattgagtggagatgaaggaacatagttacttgtttgaacaaatatactgtgtttattaggcaaatacatctattggttccatgttaattgctaatatttgtaactgataccgatatatttgttctgcagtgcatgctttaaataagctaccatattctaagatagactctaaggccgttggaatcacaactggagttatttttgtaacttatagcagcttgatagcatcctctgagaaaggccgttcccgtttgcagcaattgatagagtggtgtgggtctgagttcgatggtcttctggtgtttgatgaggtaaagaagactctggtataaatattaatcgattgtgctaggcatcttctagttagcatgcaattttctattcaatccgctgcaaattaatctggtatgcttaaatgatgtgtttcttgcagtgccacaaagcaaaaaatctgattcctgaggcagggagccagcccactcgaactggtaaagcagttcttgagatccaggtgtgtgactatatatatattttgggttgattagatacgtgccattaaaaaaatgtggaaatatgccattactatttgcgtatttgtaacgatgccactgctacttgttgataatcttagtggtgccactgagatacatattttgcttgtattggacgaaatgcccttatcttctacctctctcttccctcatcttctacctctctctcttccctcatcctttcccatctctctgacccgaatcgacgcctcaccgctacttctcgactaggttggcccgtcaacgtcacgtcaggtgccgaggtggcagagagcaccggacaggtccccacggctcttcacgaaggcgatcctcgccgcgtcaggtgccgaggtggtcggcggcggggaggtggagagcgtcaagcggctgctcgctcctcggtcctcgtttcttcgtcgcctagggactcttcgtggtgaggagaggtgaccggatttgggactcattggcctccctctttcccgactccgccttgccagccgcgtagagggataaagggagggaggagatatgccatcggcgccggtgaccgtgagccttgcagtgacatcgtcgcgtcagtgtggagctctacaggagatggtcggcggtggcgcgaggtggagggagacataggtgtcgtggatgaagagcgccagaaagggaggcggcggcgactgcggtggtcatgtccattgacagctgtgcttgtggtcgccgctgtcaagccatcgctgtctcaggttgtcgaagagaagagggggaaaggggaggaaggaagaagaagggcaattttgtccaatctttttttgtacatgcatccaaggggtaaatagtggcatgtctcaaatatgtctaaaattataatggcacggttccaaatacttgaatactagtggcaaatttcaaaaccagcatatttttaatggcatggatctaattaaccctttttttcttgctctggtctccctatgatcaacagaacattactagtatacatttattgcggtcatcttatgtagccgactttttgaatataaattctttggccctggaaagcaaacactttcctagagtgatagcatatacttcctctgtccatgaatataaagcacttttggaacagtgctaagtaatttttttttaacttttgtctatcatcaatagcacaaaaattataacaattgactacataagaataatgtttctagatctatcgtgaaacaaaatatcataatatgcaactctttgtatttaaaatagtttatttttatagatgttattagtcaaagtagcatatcgaagaccgtgttgatgcccaaaagtgcttatatttgtggatggagggagtatttttcaaatatcaaaccagaagtcaatgaccttatgttgtatgttgtgatgttatagtattattcctcattcctcaatttgatagattatgtggtatctgggatgggatgattctttcaaagaaattctactgatgatctgttcttaattattgtcaccaaacattgcaggaaatgttacctgaagctcgggtggtttactgctcagcaactggtgcatcagagcctcgaaatctgggttatatggttcgccttggtctctggggagatggaacatcatttcagaattttcagaaatttctaggtttatttttgttcctttatacttatattttatttttttatatacctttccatttgtgtttgcatgttatcgtaattcatacaaaaatttcaaataattatttccaatgccgaccagctaccatcataataacaatttcaatatataagggcatgagcagtagtagactagtagttgtctcttatcaaagcatagcagtagttgtccactttccctgcaaaatgcgaatcagaagcaggtcaataggctaagagacgaaatgagcagatctttttgctgcattatttcctttttcaacagatagtaaagtactatccgctgtctgtgttcggtaaagttatcttgaaaggcttagtgatcaccactgtcgagcactttttttttttctttgggagaaaaaatatataccaagagctgtttacaactagcactggtattagtggaagaagaatttcctccattcactattgatggacctggcaattttgcccacaagttacccatagtacaacatatcctttatgttattttttgtgcttaaataactatgatgagaaacggcacttgtgaaatccaatagaaaattaagacaaagttcactttcaactctgaattttcattttttggccttggttcactttccccctgaactgcacaggtcaccacccttcatccgatcttaattttctattggatttcacaa

SEQ ID NO: 5051 - DNA, 478 bp, Oryza sativa
acttatgactcactattattttaatgatggcttaatgatagttcacgatggtcaatcgtgattggttaattaattaatgtgccaactaaaacctgataatggtgggttgtgagcacatggttttgatggtcgtgctcatgacaattaaggactggttcacgagtttcggttgtgaaacattaaccgtgccagccacaagccagcgtgggcaacggctttatcttttatatagcatggttcattgcggagcaccagactgagaagtggcggagataagcccacgggggtcgctggggagtccatgccttgtttataagggggtgattatgatccaggaaaggtgcgctgtaatggattgtgttgtgcaaggggtattgtcacaactcctttcctaggtaccgtggtggtattgaggcacatggtaacatgatgtggggttgtgtcttgtgggtacagtggtacacctctgatcagagta

SEQ ID NO: 5052 - DNA, 1554 bp, Oryza sativa
ggatctgtgtgacttgccttgctggccttggaactcttcaaactcttctccggcgaaaacagactctccagaaacgacggaatctaagcagaaaagagcaaaatcaccaaaacagcacataaacaagcatgaacagtacatgtggatatttttaacatgtagatctcaattttagaaaaatttagagacttgaaccaactaaatccgagcaaagatgaattagttatgaatttttgaagattaaatcggattaaaacacttaaattgattttaattgaattatgacgcaataatgaattatttttgaaaaggaaaagaggatttattgcgtcagcgactagggtttcgcggtggaccgggcgcacggcggcggttcacgcgaacggacggccgagatcgatccatccaaaacggacggccgagatcgatcgggtccacggcggctcacgggagagggcgacgatgacgtcagcagtgacgtcaccaccggcggcggtggctcggcggctcgggcttgcatgctcgccggcgaacgacggcacggcggcgcgaacggaaggcaccaacgggtagagcgcgacgcggcgaactcaccggtgaccaaacgagcggcggaagatcaacggacggcgacggcgacgacgaagaaacggcggcggtcttcgggtcgacggcggcaacggtgctccgggggtctacaacgacggcgaaggggcggacgaggacggagacgcgacggcgaccacgatggcagccttcccgagtgacgacgacggctgaaacggcggcggcgcacggctggagcgacggcggcgacgcgggcgctagggcacacggtgctagagctcttccggcgacgaaaagcgaaaggcgagggtggcggcgggtaaaggagacaccggggagccttttaaaggggctaggaggcgacggcgaaggcccacggcggccggcgacgagaaggaaagttcgggaaaatcgaatccgaaacaaactcgaatccacgaatttccaaacgattttagccgatgtttccaaaggagaaaaggtagaggagatcccgaggatcatttcccctctatcaattcggccggaaacggaaaggagcggccggattggaaagcggcggcggcggcgcgaaactagggtttcggccggaggaagacgatgggccccacctgtcagcgggcggacgcgcgcgcgcgcgacggcggactgggccgacttgggctgaggagagagagagcggttttgggccgactttcggcccaaagccaaaagagactttttaaaacctttttcaatttaaattatttcttaaatgcaattccattcattaaaaatacttccttagctcaaataaatcccagaaaaatctaggaattatagaattaagcaaagtatttaatgaaattttatctggccccatttaatattggaatttattaattaaaattagatcttctcttctaggcttttaaaattatttctaaaaattccatttaaacaacaatttatatattttgaattttcagggtgtgacaggaaataaaa

SEQ ID NO: 5053 - DNA, 2620 bp, Oryza sativa
gagttctacagtgaagctgttggtgtggaggattaggtgtaaccctggtcaagctgcctgtagagtggagtcgtctgcgccgtttatcttatttttccgctgcatagatctttattgattgagaggaactatctacctctgtaatgacattttattcgcttattatttagagtaataattgaactctattatcaatttgttattgtgtgcctcggctgattcctggacgagggttcacacagatgtaagcgtttggaattttggatagaaattccgggcgtgacaagttggtatcagagccaggttgaccctaggttatgccaaatggttacccatagaagccctctaaaaatattggaaaagtagaactgttctcctccccttctcttttaattaaaccaaactaatagcacatgcacttcataatctcttttagtggttttcattcgaaagttattccagtgttattagtactgtacatctattactgtactaatgactcatttaccagcaaaagttttacaatattattttatttaaccttgctgcaatgaaataaatttagcatgttgattttataactttcttttatttcttttgaaacttgttgttcaaaagtacaaaatttgtgaccttgtttccaactgtttcaacttatcttgcaagtttggtttactttatttacttaccttttactttgattttctaactttattcaaattaatccaaaaacttgtgctattaatttgataaatgtcttaactccctcctttcacttgtctttagatgccgcgctacaagcctgagtacctctttggtgttgagggatttgtccaggagttgcgtacgatgtcctttgccataggatttgggacagcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgctataggagaactccgcgatcgctattgtgatcagttggccgacactgagtatcgctaccatcctcgccaaccacagggaagtgatcgtggcagctaccttgagattgaaggaattgagaatgatgctaccacaaggcatttggttgagatgctgtgggctatggatgaaacccgtgcggagactgtgttagcggctcaagatcgtgaagaccggaatcgtggtaagatttgcaaactagaagacaaggtggatcgtttggagaaggaactagccgcgttgaagggagaagcaccaccgcagaaggccagggttcgtcttaccgcaagaaagagagctctatttgtccctcgttaccaattggcgccaaaggtccgtgtggtggagaaagaagttaccccagccctagcagatcctccggtcgtcattataagtgatgatgaagaagaagaatccaagcacgcccattccaagatcgagtggggagccactcaagatgatgaagacgagccgaacgagccttcaatcaactccgatgctcggaagaactagaatgccatgtcaagtcgttgtcttagatcgttgtgttagtttgcttgttttaagtttggttgtgtgtgtctcgcatgtgatttacatcagtggtgggatgtaagtgcatgcgtttgtttgctttcgagtgttaggtagttggtgagtttggtggtgtgagagtcttcagtttgtaataatgaaacccacttaagatcaataaaagttaaattaattctctgtcctaagtagttttccccggtttctcttcttgtggtcctgtccatgccagatggtgctcactcgcagcaacgggaatggccctaacaacaataacaataacaacaacaatggagagaatcccacacttgcccaagtcttggctcaacaggcacagcttatgaacatgatgatgcagcaactccagaaccagcagaaccagggaaataaccatgcacctccccagaacaagttagcaaaattttttcgtgtgaggccgcctattttctctagcaccattaatcctgttgaagctggtgattggctgcatgccatagagaagaagttggatttacttcaatgcaccgatcaggagaaggtctcatttgcatcacatcaactgcatggccctgcctctgaatggtgggatcacttccgccttaacaggactactgctgaacctatcacttggcttgaattcaccgctgctttccggaagacgcatataccatcgggagtggtgtctctcaaaaagagggaattcaggtcgctcactcaggggtctcgctctgttacggagtatctgcacgagtttaatcgtcttgctcgttatgctccggaagatgtgcgcactgatgaagagcgccaggagaagttcttggaaggacttaatgatgagctttcttattcactcatgattggggattaacctggatttcataagttagtggataaggctattcgtcaggaggacaagtacaatcgcatggagcagaagaaacgccggattgctcaattcaagacacaacaggggaataatcagaagccgcgtcttacttta

SEQ ID NO: 5054 - DNA, 656 bp, Oryza sativa
gcagcccttgcataaacagcatttaataaacatttcagaatttaataaagcagttaataattaagcagtattaatccaacgctatacaacataccctgttctataggcccaaccattctgaacaaccatcccggctgcacagtcctatctccaaaccaggaatgtaccattccaaaccaggagctaaacaaattattaccatttaaagcatttgttatcatgatgagaggtgtgagactaatcacgaaaaacattgttagacccgcccataaccgcgggcacggctattcgaatagttttactctgatcagaggtgaccactgtacccacaagacacaaccccacatcatgtcaccatgtgcctcaataccaccacggtacctcggaaaggagttgtgacaataccccttgcataacacaatccaccgcagcgcacccttctggatcataatcacccccttataaacaaggcatggactccccagcgacccccgggggcttatctcgccacttctcagtctggtgctctgcaatgaaccatgctatacaaaagataaagccgtggccacgctggcttgttggttggcacggttattgtttcacaaccgaaactcgtgaaccggtccttaattgtcatgagcacgaaccatcaaaac

SEQ ID NO: 5055 - DNA, 5932 bp, Oryza sativa
caattaagcatgtttctgttatagtagaaacacagtgaatcttctaaaatcatatctaattcatccgagctcagtttaagcccattcaagtctcaataaatcaagaaaaaatgcatagaatccattaaaaatggttttgttctctgtttcagtagtcttattgcctgtttgtattgttttctttgtatgtcgcttagattccggctctcccaccgctccggtgtactttgaaatagtcgccgaggttcctccagcagcagagcaaggtaagtcatgcttgtcacttgaacatgttgatcctatattacaaatgctctatcgttttcctttaaatactgcatcgttttataatgttactatgggatgtttacctactgttacagccacactaatttttgtaccatgctcctttgttagctttgggtataacatgactagagattggattagggattgcttagccatgcttagttcaactagcacacaatgggggaaatacattaatacatagatatcagattctagtaatgatgggttaataccaccgctccggtgttggtgaattaaaattaactaaattgtgagctatgggtgcatggttttgatggtcgcgcccatggcatttaaggaccggttcgcgggatgccctggaagaacttatcatacttaccacaagccagcgtgggcaacggctgggcttgtagtgtacctttcctctagttgacgcatcaggcaagggtgagcgtgatggagtttggatgggccctgcgacggcctatgcggcttccggattcatctaggcacgagaggggactgcccgctgccttgcgaggagtgggggtgaaacctgaggtgtggtgtgcttggttagagggggttatgcgaagggtcctgtcacggtctctatccggtatgtcgtggtggcatgtcggcgcacggaaacgtatcgtggggctgtgtcttgtgggtacagttgtacacctctgatcagagtaaaactattcgaatagccgtgcccgcggttatgggcggtcaaccagattcaccgtgattattctcagccaagtctagtctaatggaattgaatagcctaggtggatggttgggcctgttgcaacgtggggtagcgttggacagtgggtggttaatattgatttattattacaactggtttactgctttcaactactatttataaatgctcgctctatgcaaacgaacctctatagctatccctagttaattccgtgcatcatacccctattccggtatgacttgctgagtacagtgggtagtactcagtcttgctctattttccccaaaccccagagtttgagtatgcgttagatggtggcttctccgaggagtaggcttcgtccgtgccgtcaaggatgcctgtggagtggtgttcccgctgcagtccaagtcaaggcttagctccagttatcttttaattttccgctgcatttatgtaagattttatgatgtttgtaagacgtggatctgtttgtcaactttgtcgtttgtgtacctcggccggtcctagacgggggttttaacgcacattctgtttggaatcctattcgggaatttctgggcgtgacaagttggtatcagagccgaccttgattgtagtacaagccaaatggaaaacctaagagtctgaatccttttcattgcacacgttctttgcaattggatttgttcctgtggttcaagggaaaaatcttggtcgcttgttcaagtgagatttgtcaaatcaggtcagtctagggttttagtaaaattatttgagatttatttaacagttagtcgggatttgatgggaggagtgcattaggtgctaactaagagatgtgggttgcaagttatttatgttcctattgttattgttattattagtatgtatctaatttctcattattttatcgctatgtaagtccgtctcacttattcgctctcatgcaaaaatgatctatgcataaaattccgctcttattcgcttattttatttgtgtcctttattgctttatttaaattggatttgagcatgcattgatcctacccctttgccttctctagatggccgaccacccacccaaccaccgtggagaaggcatggatgattttgtggctgaattggcttgcatgaccttggtggtgggctaccccaacgcgccagagtactcaactgttccaccgctcagtggcgagcttcctcaccgtgttcgtctggaggttcatggctatgtggacacctgccttgctaatatggtggttcaggcatctggaggcaccgcagatcacgcctgtcaggaggcagcatatctggtgatggccaggcttcgtgatcgccacaactacactttctgcaacacggcgtaccgcttccaccctcgccgagcaagcggtgatgacgtcagcacctttcgcccgacggccggcgagaacgacaccaccttcggccacatgtgcgccgtgatgaggggaagggacaggatgcactctgacctgcacaaggcgtccaaggccttgaatgatgggaagctcgtgaggatcatagctctgaaggatgagatagcacgcctgaagaaggaaaacgctcagttgaagggtttcccagcgccaggaggagtccggatccgcaccacgcccctcaagttgacgactgtacccatgcgcattcagcttgcgcctaggaacccacctcctcccgcagctcctccagtacctccagcagttcttgcagtgcccgcagctccagctccagccccagctccagtcccagtgtcagctcctgcgtctgctctctcctttgctccagcgtcagccgctaggggtccagccagtggcaacggaggttggttgcctgctactcccagtggcagccgcgaccacagcagcagcagttctagtggcacagagccgggcaccggcgagacgtatctgccagactccaggagccgctcagagggacctggtgacgagcaggaggatgcctttgactccaccgaccgcaggagccgttcgaggcattaggcacgttttcccttagtttatcgactgtttagtttttgtctgttagtttgtgtgtttaggtttgttcgcttgtgggtcagtcgacggtcgatatcatgtgcctatgatatggctatcctaataagtattttgcttgctgttttaagtgttttaattctgatcagaacaattgcagtttaaattcctataaaataaagcttagttcctgagcatctgtttttcttcttttccaccccctccgtctgctcttccttcagatggtcaacaccaggaatggcagccgtgcagcaggtgagggcagcaacggcgaagaacgcaccgacggtgggcatcccaacagcgactccgtcaatggtccgccaccgctccccgagaatccgactctggcccaagtaatggctcatcagactcagatgatggcagccatgatgcagcagatgcagcagcagcaccagcagatgcaccagaggatgtagcagcaaaccaagtagcagcagcagcagtttggtccccctccccctctatccaagttgccggagtttctacgcgtcaggccacccaccttctccagcaccaacaacctcatggaggcaaatgactagctccatgccatagagaagaagctcaaccttctgcagtgcaatgatcaggagaaagtcgccttcgccacacatcagctccagggtcccgcgtcagcttggtgggacaaccacatggctacccgtccgccaggtatggaggtcacttgggcagaattctatcgcagctttaggaaggctcaggtgccagacggggttgtggcatagaagaagagggaattccgagcactccactagggcaacaggacagtgactgagtacctgcatgagttcaatcgcctagcgcggtatgcaccagagaatgttcgcactgacgcagagaagcaggagaagttcctagcaggcctggatgacgaactgaccatccagttgatctccagggattacgcagacttcgagaagctggtagacaacgcaatccgtcaggaggatcaatgtaacaaaatggacaggaagagaaaggtagctcagttccggtccaaccaaggaagccatcagcgaccgcgcttcacacccggacagcagggtggacctaccaccatgattgtccgccagcatcgcccgttaaactcaagcagtttccaccagggcgcaagtggcagccagagccaccagggaggtcagcccaaccgcagtgcagctccgcgcccaccaatggcaccagcacagtcagctccattagcccaagccaagaaggagattggaacaaagccagggtcctattacaactgtggcgagcatggccactttgttgacaagtgtccgaagccaaggcgtgccgggccaaggtttgcttaagcccgtgttaaccacgcgtccacagaagaggcgcaagcagcaccagaggccatactgggtacgtttcctgttaactcaatccctgcaacagtacttttcgattctggtgcaacgcattcgttcatttcaaagaagtttgttgggatgcatgggttaagaaaagaagagcttagtacaccaatgagggttcataccccgggaaatagttcaacctcggtcagttatagcccttcagtgctaataggaatacaccgatcataatttctagccaacctcatccttcttgaatccaaagacctagatgtcattcttgggatggattggctgaccaagttcaagggagtcattgattgtgcgaattgcatagtcaccttgaccaatgagaagggagaaaccgtggtgtacaagtcaccagtctcaccgaagcagggaatctccttaaatcagattgaggtggaaaaccctgtggccaccgaggagaagagttcgaggaaattggaagatatccccatagtctgcgagtatccagaggtgttccccgaagacctcactaccatgccacccaagagagagattgaattccggattgatttggcaccggggactgctccaatttacaaaagaccgtacaggatggcagccaaagagctagcaaaggtcaagaagcaggttgatgagcaactgcagaaagggtacattcgaccaagtacttcaccttggggtgctccggtcatttttgtggagaagaaggacaagacgaagagaatgtgtgttgattatcgcgcgctcaatgaggtcacaatcaagaacaaataccctttaccgtggattgatgatctgtttgatcagctgaaaggagctaaagtgttttctaagatagacctgcgatcaggctatcaccagttgagaattcgggaagaggatatttccaagacagccttcaccactcggtatgggttgtatgagtgcactgtcatgtcttttggacttaccaatgcacctgcattcttcatgaacctgatgaacaaggtgttcatggaatttctggataagtttgttgtggtataaattgatgacatactcatctattcaaagtctgaagaagaacatgagcaacatcttcgtctggtactcgagaagttgaaggagcaccagttatatgccaagttcagtaaatgcgacttttggttatcggaggtcaaattcttgggtcacgtcattacagctcagggcgtggcagtcgatccgtcgaatgtggagtcagttaccaagtggaccccgcctaaggcaatgtcacagattcggagtttccttggacttgcgggttattaccgtcggttcattgaaaatttctctaggattgccagacctatgactcagttgcttaagaaagaagaaaagttcaagtggacggccgagtgtgacaagagttttgaggagctcaagaagaaattagtgtctgctccagttctgattctgcctgatcagatgaagga

SEQ ID NO: 5056 - DNA, 8055 bp, Oryza sativa
ggttgctcatttcataccagtgcacactacttatacaggcaaagggtggcagagttctatctctcaagaatcatgtgtttgcatggagtacccaagaagattgtatccgatcgagggaatcagttcacctcaaaattttggcaaaaactgcaggaagaattggggacccgtttgaatttcagtacagcttaccatccgcagacagatggccaaaccgagagggtcaatcagatcttggaagacatgttgcgagcgtgtgcgctcgatttggtggggcatgggataaaagtctgccttatgctgaattctcgtacaacaacagctatcaggccagtctacaaatggcaccgttcgaagcgttgtatggccggaagtgccgcacgcctctcttctgggatcaaacaggcgaacatcaaatgttcggaacggaagtgctaacggaagcagaagagaaagtcagaaccgtcagagagagactgagaattgcccagtctcgacagaaaagctacgcggacaaccgccgaagggagctcacttttgaagcaggggattatgtgtacctccgtgttactctgctccggggagtgcatcgtttccagacgaaaggcaagttggcaccacgcttcgtgggaccgtacaaaatcttggaacgaagaggagaagttgcctatcagctagaacttccatccaacatgatcggcattcatgacgtgttccatgtgtcccagttaaagaagtgcttgagggtacccgaagaacaagccgattcggagcacattgacatccaagaagatctgacttatgtggaaaagccagttcgtatccttgagaccagtgaaagaaggactagaaacaaggtcaccaggttctacagggttcagtggagccatcactcagaaaaaaaagcaacctgggaaagggaagatgagttaaaggccgcccatccgcacctcttcgccagctcttccgaatctcggggtcgagattccgtttaagggaggtaggtttgtcaaaccctgaagttctttcccaagcctaaattgaatttataaattacctagaggaaatatcggtgtaaaagtaagagagaaaccctaataaattaatgcaaataataattgggattggcatgtggaatttttcttgagttctacatgtcgaaatatgctaacaagatttttagtggaattttcagagctctagaaataattttaaccaactaaaaatgagcacaagcattatttaatctctggaaattcaattctttctttttcttttcttattcccttgtcacgcccggaatttctatccaaaattccaaacgcttacatgtgtgtgaaccctcgtccaggaatcagccgaggcacacaataacaaattgataatagagttcaattattactctaaataataagcgaataaaatgtcattacagaggtagatagttcctctcaatcaataaagatctaagtagcggaaaaataagataaacggcacagacgactccactctacaggcagcttgaccagggttacacctaatcctccacaccaacagcttcactgtagaactcttcctctgatgaacgattgcaaggtgagtatatgacatactcagcaagtcacgcagcaaatatgcaagtgcacaggataacaaaggatggcatagtagggtttcatttgcataaacagcatttaataaacatttgagaatttaataaaacagttaagtaataattaaacaatattaatccaacgctatacaatataccctgttgtataagcccaaccattctgaacaaccacacccggctgtacagatctatctccaaaccaggaatataccattccaaaccaggagctaatcaaattattaccagttatagcatcttttattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcatggactccccagcgacccctgtgggcttatctccgccacttctcagtctggtgccccgcaataaaccatgctatacaaaaggtaaagccgttgcccacgctggcttgtggttggcacggttaatgtttcacaaccaaaactcgtgaaccggtccttaattgtcatgagcacgactctcaaaaccacgtgctcacaacccaccattatcaggttttaattggcacattaattaattaaccaatcacgattgaccatcgtgagctatcattaagccatcattaaataatagtgagtcataagttatcccagtaatgtgctaatgtttctaagcatggctaagcaatcatatctaatatatctagttgaaccaatatataaagcccaactagtcaagttataataacccaaggtatcaaggaataaagtagacaagaacaaaagggctataacaaacaataggttaattccacccaatgacattcgaaaataaatgcaatagttgaatagaaacagtagctttaaacaggatcaacatgctcaaagggttatttgggatctgtgtgacttgccttgctggccttggaactcttcaaattcttctcctgcgaaaacggactctccggaaacgtcggaatctaaacagaaaagagcaaaaacaccaaaacagcacataaacaagcatgaacagtacatgtggatatttttaacatgtagatctcaattttagaaaaatttagaaacttgaaccaactaaatccgagctaagatgaattaggtatgaatttttaaagattaaaccggattaaaacacttatatggattttaattgaattatgacgcaataatgaattatttttgaaaaggaaaagggaattattgcgttagcggctagggtttgcggtggaccaggtgcatggcaacggttcacgggaacgaacggccgagatcaatccatccaaaacggacggccgagatcgatcgggtctacggcggctcacggcagacggccccgatgacgtcggcgatgacgtcaccaccggcggcggctcggcagctcggacggcgcacactcaccggcgaacgacggcgcttcggcatgaacggaaggcaccaggacgtagagcgcgacgcggcgaactcaccggtgaccaaagaagcggcggagaaacaacggacggcggcgacgacgaggaagaagcggcgacggtcttcggcttgacgacgacggcggtgctccggcggtcttcagcgacggtgaagtggcagacgaggacggcgacgcgacggcaaccacgatggcgatctccccgagcgacggcgacggctgaagcgacggcgaagcacggctggagcgacggcgacgacggcggcgctaggtcacacggcgctagagctcttccgacggcgagagacgaaggcgagggtggcggcgggtagaggagacaccgggggtccttatataggggttggagggcggcggcgaaggcccacggcggccggcgacgcgaaggaaacttcgggttcgggagagagagaggaatccgattcgacctcaaatccatgaacttccaaagcgagttagacgatgattccaaaagagaaaaggtagaggagatcccaaagattgtttcccctcaaatgatttcaccggatcgggaaagacgcggccgaatttggaaggagacggcggcgctagggtttcgggcggcggcggccagaggtagacgaagactgacaggtgggccccacctgtcagcgggcggacgcgcgcgcgagcggcggctgcggctggactgggccgactgggccgaaggagagagagagagaaggttttcggccgactttcggcccaaagccaaaagagacttttaaaatcctttttcaatttaaattattcatgaaatgcaattccatttaataaaaatacttccttagctcatataaatcccagaaaaatctaggaattatagaattaagcacagtatttaatgaaattttatctggccccattttatattggaatttattaattaaaattagatcttctcttctagactttttaaaataaattctaataattccaattaaacaacaatttatatatttaggatttttagggtgtgacaaacctacccccttaaacagaatctcgtcctcgagattcggaagaactggcgaacagatgcggatgagctgacttcaattcatcttctcgttcccaagttgattcttcttccgaatgattactccattggactttacaaaaacggataactggattcctggttcttctctcatctatttccaaaatacggattggtctctcaacataggtcagatcctcttggacttctatttgttcaagattagcttcttcgataggtacccttaaacactttttcaattgcgacacatggaacacattatggactcctgccaaagattgaggtaactccaactgataagcaacctctcctcttctactgacaatcttataaggtcccacaaaacgcggtgccaattttcctttggtgtgaaaacgatgaactcctcgaagaggcgtgacacgaagatacacataatctccttcttcaaaactcaaatctctgcggcgattgtcggcataactcttatgacgagactgggccactcgcaatctttcttgaatgattttcaccttttcttctacttccctcaggatatccgtcccgaaaacctgacgttctcccgtttgatcccacaaaagcggagtgcggcacttccgaatatacagtgcttcgtaaggagccatctgaagactagcttgataactgttgttatacgagaattccgcataaggtaaattcttatcccaacttccaccgaagtctaaagtacaagctctcaacatgtcttccaaaatctgattcaccctttcggtttgtccgtctgtctgcggatgataagcagtactaaagttcagcttagaacccatctcttcctgaagtttcttccaaaaatttgaagtaaactgactgcctcgatcagacactattttcttagggacgccatgcaaacacacaatccttgccatatacaattccgccaaccgacttccggaatatgttgtgtttactgggatgaaatgagccactttggtaagtctgtcaactatcacccaaatagagtcatggcctgatgacgttctgggtaaaccagtgatgaaatccataccgatttcctcccatttccattcaggaatcttcaaaggctgcaacaaaccggcaggtttttgatgttctgccttgactcgctgacaaacatcacatactgctacgtactctgcgatttcacgcttcatacttgcccaccaaaatctttccttgagatcctggtacattttggtactaccaaggtgaatggaatataaagtatcatgagcttctttcagaattgcatcttttaaatctttgttatcggggacacagattttctcgcccaaccatacagttccttgctcatccctcaagaaaccgatagcttttcctcttctcatattctttttgatttctagaatatcaggatcattaatttgggcttctctaacttgatcaattagaatgggctttgcttctaaggctgcaacgaaacctctactggcaattcccaaattaaatctttcaaattccttgcataattccaatggcaactgtcgtcctttcgtagcattgcaatagcctttcctgctaagagcgtctgctacaacattagcctttcccgggtgataatgaattcccatatcataatccttaattaattccaaccatctccgttgtctcatgttcagatccggctgagtaaagatatactttaaactcttgtgatcggtatacacctctgtacgagtaccgaaaagataatgacgctaaattttcaacgcatgaaccactgcggctaacttaagatcatgagtagggtagttctcctcatgcggacgtaactgacgagatgcataggcaaccaccttcccatcttgcatcaaaacacaacctaacccaagcttggatgcatcacaatacacttgaaaacccttctttggatcaggcaaaatcaaaataggagctgatattaagcgatccttcaactcttgaaaactctgctcacattcttctgaccacttgtacttcacatctttctgaagcagtcgtgtcatgggcttagcaatcttggaaaaattctctataaacctccgataatatcctgcgaggcctaggaaactgcgaatctctgaaactgtctttggttgtttccagttggttacggattccacattactaggatcgacggcaactcctcctgctgagatgacgtgaccaaggaacttcacttccgacaaccaaaattcacacttgctaaacttagcatacagctgatgttctcgcagcttctccagtgcaaggcgaagatgttcttcatgctcttctttggttcgggagtagataagaatgtcatcaataaagactaccacgaacttgtctaggtattccataaacaccttattcatcaagttcatgaagaaagtgggggcattggtaagtccaaaagacataacagtacattcgaacaatccgtatctagtggtaaaagctgtcttaggtatatcttcctctttgattctcaactggtgataccctgatcgaagatctatcttggagaaaatggtggcacctttaagctgatcaaacaaatcatcaattctgggtagcggatacttattcttgatagtcacatcatttagagcacgatagtccacacacatcctctgggtatgatctttcttttccacaaaaataaccggagctccccatggagatgaactcggtctgatgtatcctttctgaagcaaatcgtctacttgcctcttgacttctgcaaactcattggttgccattctataaggtctcttgtggattggagttgttcctggtaccaaatctattctgaactctatatcccttttaggcggcataccaggtaaatcgtctgggaacacatcaggatactcccggactataggaatctcttccaacgttatttggttcagtcttgaccttaaagactcagaagacaatgcatgaacagttacaactcgaccatcattactggtaagagttacttttctgttagcacagtctatcacacctttatatctggctaaccagtccatccctaggatgacatcaaggtctttggattctaacaggataagattggccagaaatggtactccctgaatttctattctgacagaggggctacgttgcaaagagagtgcttgattacttggggcactaaccatcaaaggacgtctaagatcttctacttccatcccatgatttcccgcaaaactcatagataagaatgaatgtgtagcaccagaatcgaaaagcactgttgcaggaactaagttaacaagaaacgtacccaaaatcacatctggagcatcttgagcttctgcagcagcaacatgattgacacgggcctttgatgctggtacggtagagttgctctgggtagggacaaccttcacacgtcggggcttcggacacatgtcagcgtaatgtcctgggtctccacagttgaaacacaccacgggcttgctgccttgctccctcttggcaggttgttgctgtgtcggagctgcaaacaggacgtggagcttgattgcggatgttgttgccagcattgttgttgaagaactgacgctgcggacgaacaacagacgaagaacctccctgtggcatggactggggtcctaaagtaagacgcggcttctgactattccccttgtgtgccatgaaatgagcaatctgacggttcttcttgtccatgcgggtgtactttgtcctccctgacgaatagct

SEQ ID NO: 5057 - DNA, 15016 bp, Oryza sativa
ggacgccatgcaaacacacaatccttgccatatacaattccgccaaccgacttccggaatatgttgtctttactgggatgaaatgagccacgttggtaagtctatcgactatcacccaaatagagtcatggcctgatgacgttctgggtagaccagtgatgaaatccataccgatttcctcccatttccattcaggaatcttcaaagactgcaacaaaccggcaggtttctgatgttcttccttgactcgctgacaaacatcacatactgctacgtactctgcgatttcacgcttcatacttacccaccaaaatctttccttgagatcctggtacattttggtactaccagggtgaatggaatataaagtatcatgagcttctttcagaattgcatcttttaaatctttgttatcggggacacagattctctcgcccaaccatacagttccttgctcatcctccaagaaaccgatagcttttcctcttctcatattctttttgatttctagaatatcaggatcattaatttgggcttctctaacttgatcaattagagtgagcttcgcttctaaagccgcaacaaaacctctactgacaattcccaaatttaatctttcaaattccttacataactccaatggcaactgtcgttctttcgtctacttgcctcttgacttttgccaattcattggctgccattctataaggtctcttatggatcggaattgttcctggtaccaaatctattctgaactctatatcccttttaggcggcataccacgtaaatcgtctgggaacacatcaggatactcccggactacaagaatttcttccaaagttatttggttcagtcttgaccttaaagactcagaagacaatgcatgaacagttacaactcgaccatcattgctggtgagagttacttttctgttagcacagtctatcacacccttatatctggctaaccagtccatccctaggatgacatcaaggtctttggattctaacaggataagattggccagaaatggtactccctgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagcactgttgcaggaactaggttaacaaggaacgtacccaaaatcacatctggagcatcttgagcttctgcagcagcaacatggttgacacgggcctttgatgctggtgcggtagagttgctctgggcagggacaaccttcacgcgtcggggctttggacacatgtcagcgtaatgtcctgggtctccacagttgaaacacaccacgggcttgctgccttgctccctcttggcaggctgttgctgtgttggagctgcaacagggcgtggagcttgattacggaggttgttgccagcattgttgttgaagaactgacgctgcggacgaacaacagacgaagaacctccctgaggcatggactggggtcctaaagtaagacgcggcctctgactattcccctgttgtgccatgaattgagcaatctgacgtttcttctgttccatgcggttgtacttgtcctcctgacgaatagccttatccactaacttctggaaatcaggataatccccagtcatgagtgggtaagaaagctcatcattaagtccttccaagaacttctcctggcgctcttcatcagtgcgcacatcttccggagcataacgagccagacgattgaactcgtgcagatactccgtaacagagcgagacccttgagtgagcgacctgaattccttcttcttgagagacaccactcccgatggtatatgcgtcttccggaaagcagcggtgaactcaagccaagtgataggttcagtagtagtcctgttaaggcggaaatgatcccaccattcagaggcagggccatgcagctggtgtgatgcaaatgagaccttctcctgatcagtgcactgaagcaaatccaacttcttttctatggcgtgcagccagtcaccagcttcaacaggattagtggtgctagagaaagtgggcggcctcacacgaagaaattctgctaacttgttctggggaggtgcatggttatttccctggttctgctggttctggagttgctgcatcattatgttcataagctgtgtctgttgagccaggacttgggcaagtgtgggattctctccattgttgttgttgttattgttgttgttgttggggccattcccgttgctacgagtgagcaccatctggcatggacaggagcacaagaagagaaaccggggaaaactacttaagaccgagaattactttagcttttattgatcttaagtgagtttcattattacaaaactgaagattctcacaccactgaactcaccaactacctaacactcgaaagcaaacaaacgcacgcacttacatcccaccactgatgtaaatcacatgcgagacacacacaaccaaacttaaaacaagcaaactaacacaacgatctaagacaacgggttgacaaggcattctaagtcttccgggcatcggagttgattgaaggctcgttcggctcatcttcatcatcttgagttgctccccactcgatcttgtaatgggcgtgcttggattcttctacttcatcatcacttatgatgatgaccggaggatctgctagggctggggtaacttctttctccaccacacggacctttggcgccaattgataacgagggacaaataaagctctcttccttgcggtaagacgaatcctggccttctgcggtggtgcttctcccttcaacgcggctagttccttctccaaacgatccactttgtcttctagtttgcaaatcttaccacgattccggtcttcacgatcttgagctgctaacacagtctccgcacgggtttcatccatagcccacagcatctcaaccaaatgccttgtggtagcatcattctcaattccttcagtctcaaggtagctgccacgatcacttccctgtggttggcgaggatggtagcgatactcagtgtcggccaactgatcacaatagcgatcgcggagctctcctatggcgatccttgccacctcctgacacgcatggatgtagtttcttcctccagcttcgaacatcactgaggggatttcatcactattactgttcaaagtgactttgactcggcacttctcttcatgacgatcatgaggaatctgggcataaaaaggggcagtcccaaatcctatggcaaaggacatcgtacacaactcttggacaaatccctcaacaccaaacaagtactcaggcttgtagcgcggcatctaaagacaaatgaaaggagggagttaagacatttatccaattaatagcacaagtttttggattaatttgaataaagttggaaaatcaaagtaaaaagtaaaccaaacttgcaggataatttgaaacagttggaaacaaggccacaaattttgtacttttgaacaacaggttccaaaagaaataaaagaaagttataaattaacatgcgaaatttatttaattgcagcaagattaaataaagcaatattgtaaaacttttgctggtaaaatgagccattagtacagtaatagatgtacagtactaattacactggaataaattttgaatgagaaccattaaaagagattatgaagtgcatgtgccattagtttggtttaattaaaagagaaagggaggagaacagttctacttttccaatatttttagagggcttctatgggtaaccatttggcacaacctagggtcaaggaggctctgataccaacttgtcacgcccggaatttctatccaaaattccaaacgcttacatgtgtgtataccctcgtccaggaatcagccgaggcacacaataacaaattgataatagagtaccattattactctaattaataagcgaataaaatgtcattacagaggtagatagttcctctcaatcaataaagatctaagcagcggaaaataagataaacggcgcagacgactccactccacaggcaacttgaccagggctacgtctaatcctccacaccatcagcatctctgtagaactcttcctctgatgaatgattgcaaggtgagtatatgacatactcagcaagtcacacagcaaatatgcaaatgcacaaggataccaaaggatggcatagtagggtttcatttgcataaacagcatttaacaaatatttcagaaattgataaaacagttaagtattaattaaacagtattaatccaacgctacagaacataccctgttgcataggcccaaccgttctgaacaaccatcccggctgcacagttctatctccaaaccaggaatataccattccaaaccaggagctaatcaaattattaccagttataacatcttttattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcatggactccccagcgacccctgtgggcttatctccgccacttctcagtctggtgccccgcaattaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcacagtaattaattaaccaatcacgattgaccatcgtgaactatcattaagccatcattaattaattaatagtgaatcataagttatcccaaaagtgtgctaatgtttctaagcatggctaagcaattatatctaatacatctagttgaaccaatatataaagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaattcttcaaattcttctcctgcgaaaacggactctccggaaacgtcggaatctaagcagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcggctagggttttcggtggaccgggcgcacggcgacggttcacggaaacgaacggccgagatcgatccatccaaaacagacggccgagatcgatcgggtctacggcggctcacggcagacggccccgatgacgtcgtcgatgacgtcaccaccggcggcggctcgggcggcgcaaactcgccggcgaacaacggcgcttcggcacgaacggaggacaccaggatgtagagggcgacgcggcgaactcaccggtgaccaaaacgtcggcggaagagcaacggagacgaagaagaagcggcggcgaccttcggcttgacgacggcgacggtgctccggcggtcttcggcagcggcgaaggggctataacgtcccgccttccccaggccgggcccgcttacatctgatagctttcataggtcatagactgccctcacagaccaacacatgtcttttttgcacactttgtccacgcttaaccctggagttctttggagattggcttccggaaaagaagttgcaacttgttgatatgagtattctattaatcctattaagccctagaccgggatgttacaccctcaccccccttaagagagatcgacgccgccgtcgatcaaccctaggccaggaacgtcctctcttggccacgtccatgtgtccagtgccagcgcatgtgccatgctgtgtaaccactcccggtctacaccagacatgcgcaccatgcctgcgcccgtgaaaccgcgagagtcggctctgataccattttgtaacgtcccgccttccccaggccgggcccgcttacatctgatagctttcataggtcatagactgccctcacagaccaacacatgtcttttctgcacactttgtcctcactcgtgtgcacccacgaagaatttcccggtcggtcacccatcctaaattgctccaggccaagcacgcttaaccctggagttctttggagattatcttccagaaaagaagttgcaacttgttgatatgagtattctattaatcctattaagccctagaccgggatgttacaccccacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataaaataaacggcgcagacggctccactccacaggcaacttgaccagggctacacctaatcctccacaccatcagcttcactgtagaactcctcctctgatgaatgattgcaaggtgagtatatgacatactcagcaagccacgcaacaaatatgcaagtgcacaggataacaaaggatggcatagtagggtttcatttgcataaacagcatttaataaacatttcagaatttaataaagcagttaataattaagcagtattaatccaacgctatacaacataccctgttctataggcccaaccattctgaacaaccatcccggctgcacagtcctatctccaaaccaggaatgtaccattccaaaccaggagctaaacaaattattaccatttaaagcatttgttatcatgatgagaggtgtgagactaatcacgaaaaacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccggcacttctcagtctggtgctctgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcattaagccatcattaaattatagtgattcataagttatcccaatagtgtgctaatgtttctaagcagagctaagcaattatatctaatatctagttgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagagttgtttgggatctgtgtgacttgccttgctggccttggaattcttcaaattcttctcctgcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagatttaatcggattaaaacacttatattgattttaattgaattatgacgcaataatgaattatttttgaaaaggaaaaggaggattattgcgtcagcgggctagggtttcggtggaccgggcgcacggcggcggttcacgcgaacggacggccgagatcgacttgatccaaaacggacggccgagatcgatcggtccacgaccagctcacgggagagggcgacgatgacgtcagcggtgacgtcaccaccggcaacggcgactcggcggctcgggcgcgcatgctcgtcggcgaacggcgacgcttcggcacgaacggagggcaccaacgggtagagcgcgacgcggcgaactcaccggtgaccaaaggagcggcagaagaccaacagacggcgacggcgacgaggttaaaacggcggcggtcttccgcttgacgacggcgacggtgcttcggcggtctacagcgacggcgaaggggcggacgaggacggcgacgacttggcgaccacgacgacggtcttcccgagcgacggcgacgtctggaacggcggcggcgcacggctggagcgacggcggcgacggcggtgctagggcacacggcgctagggcgtttccgacgacgagaggcaaaggcgagggtggcggcgggtagaggagagctcgggggtccttttaaaggggctcggaggcggcggcaaaggcccacggcggccggcgacgagaaggaaagttcgggaaaatcgaatccgaaacaaactcgaatccacgaatttccaaacgattttagccggtgtttccaaaggagaaaaggtagaggagatcccggagattgattcccctctatcaattcggccggaaacggaaaggagcggccggatttggaaggaaacggcggcggcgacgcgctagggtttcgggcggcggcggcgcgaggtaaacgatgggtccgacaggtgggacccacctgtcagcgagcaaaggcgcgcgcgcgcggcggcggactgggccggattgggccgaggagagagagaagggaggttttgggccgactttcggcccaaagccaaaagaagacttttaaaacctttttccatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaattccatttaaacaacaatttatatattttgaattttcagggtgtgacaggggcggacgaggacggcgacgacttggcgaccacgatggcgacctccccgagcgacgacgatgaccggaacggcggtggcgcacggctggagcgacggcgacgacggcggctcaaggttgcacggcgctagggcgcttccgacggcgagagacgaaagcaagggtggcggcgggtcgaggagacaccgggggtccttttataggggcaaggaggcggcggcgaaggcccacggcgaccggcgacgagaaggaaagttagggctcggagagagagagaccgatccgactcgacctcgaaaccaacactttccaaacgattttagccggggattccagaagagaaaaggtagacgagatcccgaagatcatttcccctctattgatttcaccggaaacggaaagacgcggccgaatttggaaggagacggcggcgctagggtttcggacggcggcggccagaggtagacgacgggcctgacaggtgggccccacctgtcagcggcagcgagcgcgcgcgagggcagctgcggctggacttgggccgacttgggccgagaaggagagagagcggttttgggccgactttcggcccaaagccaaaagagacttttaaaatcctttttcaatttaaattattcatgaaatgcaattccatttattaaaaatacttccttagctcaaataaatcccagaaaaatctaggaattatagaattaagcaaagtatttaatgaaattttatctggtcccattttatattggaatttattaattaaaattagatcttctcttctagacttttaaaataaattctaataattccaattaaacgacaatttatatattttggatttttagggtgtgacagtacagttgtacacctctgatcagagtaaaactattcgaatagccgtgcccgcggttatgggcggtcaaccagattcaccgtgattattctcacccaagtctagtctaatggaattgaatagtctaggtggatggttgggcctgttgcaacgtggggtagcgttggacagtgggtggttaatattgattaattattacaactgttttactgctttcaactactatttataaatgctcgctctatgcaaacgaacctctatagctatcccttgttaattccctgcatcatacccctattccggtatgacttgctgagtacagtgggtagtactcagtcttgctctattttccccaaacctcagagtttgagtatgcatcagatggtggcttctccgaggagtaggtttcgtccgtgccgtcgaggatgcctgtggagtggtgttcccgctgcagtccaagtcaaggcttagctccagttatcttttaattttccgctgcatttatgtaagattttatgatgtttgtaagacgtggatctgtttgtcaactttgtcgtttgtgtacccggccggtcctggacgggggttttaatgcacattctgcttggaatcctattcgggaatttctgggcgtgacactcggcaatcaggggtggcttctcgaagcaccaggagggcatcggaaggagggtattagctaagtgtcacatcctgatttttgtttcaggatttataaattatttaataaattattattagaatttatattaaatgttcattaatttacaagtgaagttaaatgtgggaaataaaattttcttaatataaagcatggatggatttaatttttattaaattctccatgattaattatactctctggaattttctcggatttttcggagctcaattcctaaatgatacaaagaacaattcagtaattatttgatcaataatgatctaattataattgttaagtgcttttcttgtttaaaatccttaaattataaattgttgtttaaaagaaattagcagaaatgattttaaaagcttaaaagagaagatctaattttaatttgctaaatctcaatataaaattgggctagataaaattttattaaatattttgcttgttcctctattttctagaattttctgaattgtttgagcaagggaagtatttttttaataattgaaacaacatttcaccatttattttaattaaaaagttccaaaacccctccttttaagttgttgggccgtttttggcccaactctctctctctctctctcccgcccgcggccgagccggcccagccgactcagccggcccagccaagccggcagccgccccctcctcctctagccaccgacatgtggggcccacatgtcggggtcatcccctacctccggccgactcaggccgagcccaagccggccgcgccgcgccacctcccgtctccgattccgccgccctcgctcgcatttgagtccgagtgtttgagggattttgatcccctcgtcctcctctatctttacccccaaaaatcggagctaatcgttgagtattttatccgaatcgaactcgtttttgagtttatctccaaaaccgagtttttgatttcccgatcgatttcttgcgggaggagtccgatctcttcaatccaaggctataaataggaccccctagtcctcctcttttgtttgccccctttcccgagctctctagtgccccgtggagtcaccgccgcgccgccctagtcgccgtcgtcgccggtcgccgctcagccgtgccgcgccgccgcttgcgtcgtcgccgccgccttttctcaccgccgttaggtgcgcgtgagggagagctagctcgtccgccccctctccgctgtcgtcggtcgccgtgaagccgccgccaccgtcgactgaaccaccgcgccgcatcctctcgtcgccggccaccatcggtcgtcgttgggcgcattggtgagtaccgttgcgttcgtcttgttgccctctacgcgttggtgccctcttttcgcccggccaaggtccgtagcgccggtggtcgtgccgcccgagccaaggccaccatggatgacgtcagcatgacgtcataacctttcctttttagttttttttatagatgaaatagattagatcttcagaaaaacatatctaaataaccgtagatccgtttcaggtggttcaagttgctaaatttttctaaaatcaagatcttcatgttaaaaatattgacgtgtactgtttatgcttgtttttgtactgttttgttaatttttgttctttcgctttattttccgacgttccggaggagagcgttttcgttgaggaaggttcggaagtgtttgcggaagcccaaggcaagtcacacagatcccaaataaccctttgagcatgttgaacccgtttaaagctattattttatttcaactatgcattatttttgaatgtcatcgggtggtgaacctttccccgttaattaatggccgaagatgatcttattttccaatgggttataatttgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattataacctggctaaggtgggttgtgagcatatggttttgatggttgtgctcatgacaattaaggaccggttcgcgagctactgttgtgaaacatttaccgtgccaaccacaaggcagcatgggcaacggctttaccttttgtatagcatggttcattatagtgtgccagactgtgaagtggcgagaagtccgtgggggtcgctggggagtccattgcctctggttttgagggggagattatgatccaggaacggtgcactgttttgagttgtgttgtgcaaagggtattgtcacgatttccccctttgcaatgccgtggtggtatttccgggcatggcaacatgtgtggaatcgtgtcttgtgggtacagtggtacacctctggccagagtaaaactattcgaatagccgtgcccgcggttatgggcgagttgagcaatgtttttcgtgattagtttcacactactcatcaatgttaataatgtgagaattaatttgactcctggtttggaatggataattcctagtttggaggtttgatctgtacgaccggggttggttgttcaggtttggttgggcctgagcagcatgggtgtgctgttcagtgttgattaaaattgatgattaattactctattgttttactactcttaaatctttgctaaatgctgcttttgcaaatgagcctatattatgccatcctttggaatccttgtgcacttgcatatttgctgtgtggcttgttgagtatgtcatatgctcattcttgcaataatcatcaaacctcagttgaagataaaggatccagaaggaaaagacgtttggcttataccccagttgagctgcctgtgggagtggagctgaagccatcgctagaccgttaattcctctgctgtttttcttttctttgtaagtatgtaacgttattattaagatggatttgtatattaaattgtcagtttgtgtacctcggctgattcctggacgaggattttatgcacaaattagttcggaaattactagtgaatttccgggcatgacactaagtaatcatataagtaggatgtatgtatactagaagtataggaataggatctttctattttcctttccacttagcttagatagttatgaataagagtataaatactttttcttagtgtcactctaccctttgaatgatattaacccctgcctagactttggttattacaagtaatatataattattagtgtggttctctctattataatcttcccacgggattactcaaatatgattcccttggaatactcttgggtgaaaagctacaatggtatttccatgcacttgcggatgaactctgtaaccataatataccagaagtatttctcaaccattgctaggaattatatttcgagtaatataccagaagcatttctggcgccgttgccgtggaagattcataaaaaagattactataactaatactttatatttacctctgtataatcactgtcctttgtaggctaaccttggttgttttcacttctattgtggaaatagggtagtgcatgactggttttaacttgccggaaaatttcaaggaaaatccagaagttttctttcagagcttcaagccgcgagtcgttgctccgcagaaaactcttccgatagagaaaccagccattcccacgccaccaacctttaagactatggctgacaagaccctccgcgaattcactgctccctctgctgacaacgtggcca

SEQ ID NO: 5058 - DNA, 8811 bp, Oryza sativa
cgacagttcccattttccctcttggccttggaaaagcgaaacagtggttttatgccaaccgcgctatgatcaacaattgggataaatgttcaacggcattcttatcgaagtttttcccgatgggcgaaaccaacgcccttcgcggaagaatttcaagtttccagcagacgagagatcagtctatttctgaggcatgggaacgactacaggagtacatggctgcctgtcctcatcatgggatggacgactggctgatcctgcagaacttctacaatggactcactcccatgtcccgtgatcatctggacacggcaagtggaggagccttcttttccaagacggtcagaggagcaatcaatctcatagaaaagatagtctccaacatgagctggagcgaggaaggagtccagacccgtcagcgtggcatgcacaccgtaaaggaaacggaaatgctcgttgcgaagctggacctcctcatgaagcgattggacgaccacgagaagaggcctcaaggcatcgtcaaggccatggactcacactttatgtgtgaaatctgcggcaaaatgggtcattctgggaatgactgcccagaaacccgtgaagaggcgatgtacatgggcaacaacaacaacaatgggttccgtccacaaggaggtcaggggtggaaccagccacgcctatatttccaaggaggcaaaataatggtaactattttaaccaaccttccttgaaggatcttgtttttgccaagccaaaaccacagatgctcttagctaaaagctggctactaatgacaagactttggaaaacataaatttcaaattagatggctttgcttccgttttccgaaaccagcttagttttaataaaatgattgaaacccagctggcacaattagttgttctagtacctgctaatgaatctgggaggattctggggcaacccgaaccctctgttgagaatgttaaggcgatcacgacgaggggtggtaagtccacttgcgatccaccgtatcctaacgttgtaggaacaggcaacgctctggaagcaccatctagcaacacggctgtcgaagaagtttggccagaaaggaccgggccgcaggaatgttgtgacatgaggctgctgccattcccccaaaggtataagaagccatcggtggatgaacaatttgctcggtttgttgaggtaatccagaagatccacatcaacgtgccattattggacgcaatgcaagtgcccacctacgcacgttatctaaaggacatccttgacaacaagaggccactaccgacaaccaagttggtcaaactgacagaggaatgcagcaatgttatactccacaaactcctagaaaagaagaaggatccggggtgtcccacgatcacctgctcaatcgggacacaaaaattcaacaaagcactctccgaccttggtgcaagtgtgagcgtcatgcccaaggacgtcttcgataaactcaacatcacggtgttgacaccaacaccgatgcgcatgcaactggctaattcttcggtctggtacctagctaggatagcggaaggcgtaccggataagatacgggatttcttcatctcggtcgacttcgtggtgttggatatggattcggagaagaaaacgtcactcattttggggcgaccattccttagcaccagggacgccaacattgatgtggggacggataaaagttcgagtttcaaccaaggatggaacaatgctccatggtgaggatcaaatatggaccaaacacgcaaaatattcaagtggccgaagtggagccacccaaaatggatagcctggggaagttcatgcggaacttcctgggagagggagcacccgttcctaggatccgttattggaagacgccggcacagtctaaaacaccagccaagaaaccagaggagacggctccagagaagccgccgtccacaccaaaaccaaagaaggtgtggcaagtgtagcaaaagatgctcgctccatgacatccgtagacggttggaaaattagcaatctaaacgaaaggagaaacggtcttgctcgtcagatccaaaatgacgcggccctcaccagcaggtaaattggtatgtacctacatatttatttctatcaatttggattctttatcaatgcatgtttgagtttccaaaaaactacatttagatttgagttttgaggaaattacttcaaatgattttttcagagcaaaacaaaataaaattttcaacaaaaatttgctatgccacgaccatactggccattgggttccaacggtcgaaagtggggccagttgggcccaccaggggttcggttgaaccggccagggcaacggtcgggtgcctctttctttgaggcaacaactagtgggtcccaacggtcggttatgaccgttgtgggcagcctatttaagccaactggccagttgaggaaaatccatcccatttcaactcattttcatctcctctccgaactttgctctcaaaattcattcacgctttgcaagtttacctcaaatttaagccattagttgcattcacaagtttccttagtgaagctaaccggtgggtaaatatctcgctattctaacccccgcccgagttagtccattcttattcatttgtgcagaatgaagagacgattgtcccgctagttcaatatgggagccggctctcgatcaagtcatcatgacgagtctagcactcgctcatccaccgatgcctcaatggaggatgccgacattccacatctcttgaacgacgccgacctcgaccttgtcggtgactgggaaaggcaagcctactccatgctgaaagaccgggtgtttgctcacacgcgggcatatgatccggagctgctgaaaaaaaataggtatggatactgattttcgtgctatttgaaaagctgttggatggcagagatttgctgtagtagatgagcctggttctcgtttgcttactttgcaattcctgtgcaccttgaaagaaatagaagatggaattttcttttgcttttttccataaagaatacacacttacatggaaaggattaagtacacttctttgttttcacgattcctgtaaaatcaatcttaagaatggaatttctgggttcgagaaaaacagattttgggaagacatttctggtgctccaatttgcaagaaacctaggacgaatgacatccataatcctacacttaggcttatgcacaaatggattgctatgactttgtttcctagaggtgatcttagacctataagagaggatgaattgattatcatgtttgccatggttaggaagattaaagttgctcttgtaaaatatatgataagtcaatggttagagagtataagatttactgctcctgttgagtgcacttctctggttactcacatagcaagaggacttagggttattgttaatgatcaaattgcttatattttaacccctcgttcctatgttgatgagaattatctagtgtaaggtcatattcttaagcatatagtagatggatctttcatattctttttcctcagttgtatgaatgaaatcctgttacctaatgcgggatatcatttgtacaactgtcatgagctaaccattcccctataaaccatagaagaatctcgtgtaggtggaccatacagggagacatgcaacatggcaagaatggaacgcgaaggttcaacatcctcaacacccgtgcagatgtatgtggccggttgggagccatctggggatgcgcccagatggacccaagctccaggccattgcattggaggctcgggctgggaaagtgccagtgagagccgacggcgggcgtatcatgacatacaatggggtgggttgaacactcaatcccccggatcaagcagtatgcctccatctcccgctgaatggcgctcaagttcctctcgttggaacttgggtgaatcaccaggagaatggatacccttgatatgcaaatgggagagatcaaatacaacctcgaggaacacatagcacagacgcaagaatagcagcaaaatactaatgctcagttcaccaacatcaacaacctgatgcagcaacagcacgatgatcttcaagcttacttccgctttcacggattcaatccttatcaaggactctgagtgaaagccaagcttgggggagacgtctctcgccccactgaggtaacttgtatcattacatatttccctttccatatgcatgtttatttttccaattgcatcctataaactaaaaacatcataaaattttgaaaatagaaaaataccgaaatgataagttagattttattatcctaggtaagacaacttagttctctttgttgaaataacgaatagttgctctgttttttatctctcatatatgggttcatggttaagtactctctcaaaaattgaataagagtagccaacaattatccgggaacctgagggaagtgagctgcacttgctaatctgagtttaagttgctgtgagatatgagatagtaataagttgctataatcctagtctgagtttgacttgacttacggatgttttattttcaaaaatgataaactttggaagttcctcacttgatataaattcctaccaaagccaaaaatattcatattgattatgccatatacattttggttatttgcaatttcattgaactttgtcaagtccttgtgacttgtgttgatactttccatgctctataatcaagatcaaacatccacatatatgcacatgctaaacttctgcactggaacctagcagatgtccattccatctccataccaccatcaaaataaattctccatgcttatatgtgctttcttctcctagaaaagaaaatcatttatgaaaaaaaagagagaaaaggagggaaagtcatggttataaaaataataaagttatgctctatcaattttgaacatgatgttgaaaaaaaaagaaaataatgtgtagccaaaccctctccttatttataaaggaaggattttggagaaggaagtaagcacaaaggagaagcacaaagtcatggttataaggaagtatgtttagttatctattttagtctaagtttttgacttagtaataaatgtgaatgcaagtatgccatgtttgattgctaccaagctccatatatcaaccgtagaataggaataaaaaaggcaaattgctgaggaattcatattcatatacttggagagatcgagtgaatcatttgaggaacttggatttcttttgcaaaatcatttgaaaaactttcggaataattgttgaatgtagattgggtaattagtgctctaattgatgttctgtttctcaaccgctctttacaaagaaaggcagtgtcttgtgggaatcaggggtaaggataagccaccgtgccaaatttattaatttgagagagagagtacacataccttgcacctgtacatttgagatatacagcatggtagcaactcctgatcaacaatcaagtttttttttgtgagtccttcactcgggacgagcaaaggttcaagcttagggggttttgttgacggttgttagcgatcagtttcgcccgtcaatattacctttaaataaaagagaactagttatgcttgcaatgcatatttgtgtttaaataataaatattcaactagtactaggattattaaccccttgcagagaatgagcacaaaatggaggagaatcgacaacaaaacaggcgatcgatcaatcaggacaatgtcaagaattagacttatcaatgaatgggccaagaactcagaaatgacaggaccaattgggccaaaattcacaagtctgcaaaatatatcaagagacaaggccgctagccgaaggtgggctggattgggccagcccatggttcgaccaaaccctcgctggtaccattggatgcaggttttgtttttggacggcgtggatcactacccaatgacggttggagggcaattccgaccattccaacttcacaaccatcattggcagcctttttaaggagctcctctcatcacttcttccacacacctcaagcaagaagcttcatacatctctcaagcttagtatagtctctagagtatagtggaatagaaatagaatagaatctttagtccttggagtcttcggaagaattcaggtatggctctagtagcttttccttcttttgtaagaattgtactttatttagaatattcttctttatactactttggtattgtactactttccgagtatatgagtaccaactttattatatatccaagttatattcattatgatgctagcttatctaggagatgcaatgatgtgggtataatgatcgtatttacgatgactctatatcatgactctatatctaaaagtatattaataggatttttctattttcctttccactttgcttagataattatgaatgagagtataaatgcttctgcttagtgtcactctaccctttgaaatatattaaccccttcctagactttggttattacaagtaatattaaattattagtatggttttctctattataatcttcccacgagattaaacaaatatgatacccttggaatactctcagttgaaatgctacaatggtatatctgtgcgcttgttggtgaataaccataatatgccagaagtatttctgcgccattgctaggaattatatttctagtaatgtcgttaagaaatagtaacacttgcccgctgtgttgggctgctaagggggtggtgatatgccccttgccggcctaggtcctaggcggtcgcacaaccagcctaggcccagggccagccctgatgatggattttcttttgtgggtacaattgtataccttgaccagagtaaaactattcaaatagtcatgcacgcagctatgggtaatcgaccagcttcaccacgattagtcctactctattgcttaacttgacatagtgaacttgtgtagttcaggtggtatggttgggcctattcaacatggtatagcattgtttagaggatatttaatcttgccttaattaattagtagttttattgttttcaactataaatgtttacaaccgcctttatgcaaccgccttgtctccccttgcatgtatgcatcgttggtgtggcttgctgagtatggtggttgtactcagtcttgctatattccccattttcagaagtgtagtgcttatgtgttgaagatgaatgtagaggacgaaggcttatacctcagttgtgtttttgcctgtggggtggagctgaagtcccgctaggatcgcccgaatttttgttgttattgctttcttttcggtttgaggactaaatgcgtcctttgtaagcatttacaggttatttacgtttggatctatatattaatttgtcattttgtgtaccttggcttaattatggacagggatttatacacaaaatagtctagaaattggccaaatttcatagcataacatcgttgcaaccttcaatgaggggtaaaatgagagaagggagccggttggtatttcttaacgacattactagaaatataattcccagcaatggtgcataaatactctgggtatattatggctacagagttcatccgcaagggcacggatattccattgtagcatttcatccgagagtattccaaggttatcatatttgtttaatcccatggaaaaattatagtagagagaaccgtactaataatttatatattacttgtaataattataatctaagcatgtgttaatgtaattcatagggtaggaagacacacaagcataaaactactcattctcatattattctaagctaagtggaaagtaaatagaaaagaatctattcctatacttcttctagtatacgtattatacgtacatcctagttataatattaactagctaatatcctcttttcgatgtcctcctggtacttcgagaagccacccctgactgtcgagttccatacgacagcccatcatgaccatacaaccggggctaaatacggaggagtaccgtccccaggaaattaacttaggaatatatacacgagcgaaggaatacccatactgagctgtcaccatcagcggcccacctctcttccgcagcatatatccctaaataatgatacccagtaatctagacaccacgccaaaactactatatactactctaatatcatcgtcatgacatagagtaaatgcataagcaaacattatacccgtacctatccatctcccagataagctagcagtttaatcaatataacttggatataaagtaaagttggtattctaaataaaattggaaagaattacaacaccagaattgtataaagaagaatattctaaataaagtacaagtcttacaaaagaagataggagagctgctagagccctacccgaactcttccgaagactttcggactccgatttctattatattcctactccactagcttgagaatactaaactaagcttgagagaatatgagagagttttgcttgaggtgtgtgttgaaatggaggatgagagggctttatatagcttgagaatgacagttatgaaggttggaaagattggtaatgccctccaaccatcactggggagccatctcagccgtccatccaagcctcgaatcaaatggccgtgagaaaggttcggacgaacccgagccaggggccggtccaactagcccatggtgtggctggtggcctccactcttgatccctgttgtagacttatgaattttggcccaatccgatgtgacatttctgagttcttggctcattcatgcat

SEQ ID NO: 5059 - DNA, 5343 bp, Oryza sativa
agtgggcatacccgtcggcagcataggagagagaaggacgtgaagcagactttgtggttggagagaaggcaacttgtgctgggcgggagcaagttggctggcagaggaggagaagggatggaggagtggagatgggctggaagtaggagaaaaagacgggccggaaatagcccaagaaagcgatggagagtttaatttgtcgttcaatttaaatttaattaatttcttaaatgaacattgtgatattaaaattatttcttgagctctgaaaattcacaggaaatttcaaatagtactttagggcatgcagaatattaaaaaaaatatttctagctaaaattttgaatgaaaattttattttccacattattttcacttttaattagctttaacttttaatataaattgtagaaatttattatttaatgatttttagtcctgaaagaaaattgaggcgtgacatgttttccatgcaattaaaaatctatcatgtgtacatgtggtatctctgactgtgtattccttgtaatcaaaaaaatatcaaagaacataacgaaggatcaatattaagtgcacatcatctattatggatggattagttcaaaggtgccaaaaggtagagcaacaaaattaaaccgcacgtacatgcagattagtcagaaatttatgaaaataccttcatgatttaattacagatatggtggccgagagtggatatttctgggtgcaaacgaatttgtggattcatggatcaaagccttgagcccttgaccaacacctgtacgtgcacaatttttatggccaaagagcaacattggttgtgcgtctatgtatggttatgatattaatctacggtcacgatattgtaatgcatctattcaatggccagatttttttttgttaacatttgagctcgtagaatgtatccaagtagtataggtctagatagacagacagacagatagatagaaagatgtaagatagatagatagatagaaaggtgtaagatagatagatagatagatacattgattgatggatggattgatttagcatttttgaaaccaaataaaatgtaatttaatagaaagaaagaaagaaagaaagaaagaaagaaagaaagatagatagatagatagatagatactccctctgttccagaatataacaagttttagggttggacacagttattaagaaagtaggtagaagtgggtgatggagggttgtgattggatgagtagtggaagtaggtgggaaaagtgaatggtggagggctgtgattggttgggaagagaatgttggtagagaagttgttatattttaggacaaatccttaaggctaaaaattgttatattttgaaatggagggagtagatagatagatagatagatagatagattgattgatttatggatttatggacggattgatttagcatatttgataccaaataaaatgtaatttattattcgagaatagaacaatcaggatgaaaattttcaaaaccgatggatagaagtgatattaatcaattgtacacattatgatatgacaacaaaaatattgaagcagtaattcactatcataaaacaaacaattaatcataacaatttggaaaacctatgtttagaagtggctttaatataagataacttaaggataaggataaaacataccagaaaatcctcagcttacaaaagtaattaagtcaacattaatttcttccatatataacacctatctttggtctatatatatgaaccatggatcctgaagttcacactcatcaacattcaactcaatagtcacaataagacacaaaacaaaacatagtagctcactcttcacaatatgaagcacgcccaccttggactcatgttgttctgcttggttcttctagttttctttgctatccctgcacaaatacgaggcaattatttttttttgaatttgtatgttttttcatcattttctttgcactggcaagataataaacatatgactccttatgtctctaggtcaaagcacaagcagggccccggtgggagttagcattggagaacttaaacttagtgtttgcttttcggcccctccatcgtggtcttgctgttcaaaggacaacctgtgctatccatcacttgaggcatgcctggaaaagtgcaagtacgatgaataggcacgcagccgactcagaggctaagtgctccgatgtgtgattgaattggacacaatatttactaataatcatatatccggtatatttgggaataacatatgtatatgttccaacagatatgcattttctaaatccatattgaagcatatgagatgcgtggtgcttatgtttaggagttgttttcataatcaacaaaatataattccatattttcaatgctagaataaatattgggccaaaagaaaaccaagaatctcatttcataaatttcgttatcgcacataaagacccaataaattgagtctatgaaaaagagttgagcatgctagtgggcgtagttgctatagcgacactagacgtgcatggttgcgcttcccatgcaggttttggttttgcttcacgtggcatctttagcctcccgttcaaagatctctacatatcagaactttcagttttcctgaaacttccatctccaaaatcacaaaactttctcttcaaacatatgaaaacattcatctgaaaatcacattactttccaaccgtatctaaaacttttatctaacaaatcataacaactttcaattcaactataaaactgtcatctcgaaattgcacaaactaatgattcaaattaaaaacttctaggcaaacttcataaaattttcaattgaaaaatccaaaaattttcatgctgtactcaaaatccctcttcctcctcaacgatcgtcatccttgtgataacgaccgcaattatgaccaagttgttcattcctgctattgccgctcctgcacggtgtgtggcagcagtggcgagggtggtgtctccatgtggcggctagcaactacaatgctgcccctggtggctagagttgaggagctatggcatgggtggtgcagcacaatatattaggcgaacttctccaatctgttgatatgtagatatggcacaaaatgttgaaggaacaacttcaacatgctagtagataatgccgtaagggcaattgtgaaagatctcgaatccacagacagcaagagcttagtccaaagctccaagaagatttaatccaagttgtgaaataggaacatccagttgtattggtaagttggtaaacggaagtaagctacaaacttgagggcatcgcctcaatttataggcttcaaaaccccatgtacaactcataaacaactatatgataactagatgacaacctatttgataagtaggatgttactcaaaacaatccatctattactcaatgacaccaagaacacaactcaaaggacatatatcttctagttctagcagtataaggacatatgcaatgacatcgtaattattgttaagccttcatgaagcatgtactatagatgcaaaactcaaattgccttcttgttcttagtcaaaaatcatattttgctcgtaacacttatacttttggaattggtcgtctaatgtccctcatcaatgggggtaccatatggccaaaggagttgacccagggatgaagcgcggctgggaacgtgaacaaggatcatggcctgacacaagcgcagattgaagggcaacgacgagcagctctactgatgctgtcgattggaaacattgaagagagaaggaaagcagcgaacgaaggaataagaagagggatcatactcctctgccccccaccccgatgggctagatgggctctaaacatgcacctgtggtgcagctgtgccaaataggaatcttgcaatacatatactgcaaatcacattttaccacgaaagattttgctggtatcaatgtgtgccaccaacatattccagcactatgactgtccacatggcatgttgaacagtggggatagtcgtcaggcactacaagagatcttatgataggtgacattttatttatgtcataataacaaagagttatgtcatgttttgaaacctgtgactctcatgtgatgaaaatccgttcgtcacagatcatgcgtctcgaatcaggctctacgacgaaacatacttttttgtcattaatctagtgatgattcttctctcgtcattaactctgcattatcttgcaaaaaaaacacaaaatctctttgtgcctaccaaggtccatgtagtatgcaacatgtttatgggcctcagcccaattgcaagcccaattagattttgggcctaacctatataaaaagaagtattttattcactattttcatcccaattatattttatccaattttttttgtgtgaaataacaaatggttgaaccccatttcaaaagcccatataggcccaagcttatacaagcccagataacatccaatagcataaatccaatatacaatatggcacaagcccaacatcccatataactcaagctcaatgatatacgcacaaattcatagtctagaccttagtaaccacaacaggcttacttacatcagttaaacaaacaagtgtagtacatcttgaccaaattcagccacaaatcgaagagcaaacaaccacaagtctatttgaaaagataggtttagtcaatgagcaaacaaccacaacagcaccaccatatcctagatagcaaactaaagacatcactgaccatatctacaaagtcgagccacaagtaactgaccaaaacaaactcagatgtccaaaagttcacattcgctgaccatatcaaagttacatctccaagtgacacttttggcagcagccatctcacattatgaattggtaaggcaacatgaagaaataggcaaaccttactaggggggtgggaggggagagggccaaaagatggggtattcagaccaatcaaacaacggagaagggaatcggtctcctctgatgacttcttcaaactttcaatctcttgcaacttcagctcccttgcttcttctgaatcagctacctttttctttaaggaatccaactcctcctgctgaccatcaagcgtacctctaagatttgatgcgtcttacatctctacctcaagttcagcttcaagctcttgaacccgtgcaacgacaacacctttggcgcttctctttggtgcggttgactcaaggtcaacattctgaagaaactttgatttggcattacttgggaaatgtcacactcagaaaattctcgaaccagaatttctaagctgaatgtgcattaaatccctgtc

SEQ ID NO: 5060 - DNA, 8794 bp, Oryza sativa
aggtacatcatgtaacacataattcttgcataatagagttctgcttattttcttcccctgagtaggaagtgtgccccgaaatgaagtgagccactttgttgagtcggtcacgactacccaaatagaatcatgccctgatgacgtcctgggcaaaccggtgatgaaatccattccgatttcttcccacttccattctggaatctgaagtggctgtagcaaacctgctggcctttggtgttctgcccttactcgttgacagacgtcacagagtgctacgaattcagctatctcccttctcatgttgacccaccagaacttttctttgaggtcttggtacatcttagtactaccgggatgaatggaatactgagtttgatgagcctcggttagtatcaagtcttttaattccttgttttcgggtacatacaatctttctcccatccagattgttccttattcatcctcaacaaaacctcgggcttttccaactctcatgttctttttgagctctgctatttcaggatcacttgcttgagctatgcgaacctgctccaccagtgtgggctgtgcctctagggcaaccacgaatccgtgctcaactataccaaggttcagatgttccaaatcgcgttgaacctcacaacatagttgctctacccatacaacattgcagtagctcttcctgctcaaggcatctgcaaccacattagccttgccgggatgataatgtattcccatatcataatccttgatcagctccaaccatcttcgctatctgagattcaaatcaggttgagtgaagatgtactttagacttttgtgatctgtatatacctcacaacggttaccgatcagatagtgccgccaaatctttaaagcatgaacaactgcggccaattccagatcatgcgtcgggtagttgccttcatgaggacgcaactgccgtgaagcataagaaaccactttgccatcctgcatcaacacacatcctagcccctggcgagatgcatcacaatagactggaaatctttcgtctgatcaggcaggattaagactggtgcagacaccaaccgtcgtttgagttcttcaaaactcctattgcattcagcagaccagataaacttttcttccttcttcaatagttgtgtcattggcttagcaattttagagaagttctcaatgaaccggcggtaatagccctcaagtcctaagaaactccaaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgcttttttaacttttcaagtaccagccggagatgctgctcatgttcttcctcggacttggagtagataagtatgtcatcgatgaaaaccatgacaaacttgtctagaaattccataaacaccttgttcatcaaattcatgaagaaggcaggtgcattagtgagtccgaaagacataactgtgcattcgaacaacccgtaccgagtggtgaatgttgtctgtggaatatcctcttcgcggatcctcaactagtgatagcctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcgacttgcttcttgacttccgccaactcgttggctcccattctgtaaggcctcttgtggattggagcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactaatccctggcttctgcggcactggagactggaaggttaccacctcttcttttgcattggtcaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctgttgctgactgcgcctcctctgcagatgcatgattgacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactgttgttgtgactgccactatggtggttcttgttgaagcttcccgggtggtagggacggtgctgccggataatcatggtggaaggtccaccgtgacgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacagaaacttctcctgcctcccgtcatcggtacgcacgtcctcaggggcgtagcgtgcgaggcggttgaactcatgcaaatactctataactgttctggttccttgttgcagggaacggaactctctcttcttttgtgccacaattccctcgggaacctgtgctttattgaaactatgacaaaactctgtccaagtaacctctgccccagttggacgggtcaccatgtagttgtcccaccaaacagaagcaggaccttgcagctggtgtgtagcaaaagcaaccttctcttgctcgttgcattgcaaaagattcagcttcttctcaatggcatgaagctagtcgtgggcctcgatttggttggtggtgcttcagaaagtgggcggcttgacacaaagaaattctaacagtttggactgaggaggtggaggaccaaactgcaggttctgctgctgctgctgtgcttgctgctgcacctgctgcaacacctgatggtactgttgctgcatctgttacatcatcattgtcatcatctgagtctgattgtccaacacctgggcggtggggacggactgttgtcagatgcactgttggcacgtgctccattgatcggctcttcgctgccactggcgttgttggagtcgcgtgaaccattccttgtctccatctgaaggggataggtagaaatatgagaaaaggaagaaaaacagggggctcagaaactaatctttcttataaatttaagtgtaattatcttaatcttgattaaaacactgaaaaagaggcacgtaactcctaattgaggcagtcataccactgacatatgatatcgaccgccgactaatccacaagcaacaaacctaaacacgaaaactggcaagcaaacagactaagaaggtcggggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacaacatttttcacgaaccgagacaaaagacactaatgcaactgactaaacaataacttaatgcatgaaatagatgcatagtcatactgatacgcataaacttaccccaccgaacatagacacgacctaatgcatatcacccgacaattcccgaccgactgccgaataaattccgaataaacttttactaaatccctagactgtccctagtcgagaaatccaattaaataagcgaccaagatttttcccacaaatcaaaagaacaaaccccaaaattttccgaaacaaaatccaagtgcaaaagggcatatgcatatgaaaaaaaagggttcagagggctcttaggtttctagttggcttgtcctacggtcaaggtcggctctgataccaacttgtcacactcagaaaattctcgaaccagaatttctaagctgaatgtgcattaaattcctgtctaggaccagccagggtacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaagccaacctctctgagacggctccactgagaagaacttcaactctggtgtgggggaaaagagagcaagactgagtactacccactgtactcaacaagtcataccggaagaggaggtatgatgcaggatataaccaaaggaagctagggattcttttgcataaagcaggcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataacactcccctaaccatccacaccacgctaaggtttcacccccacccctcaaaatgcagtgggcggtcccctcttgcgccgcggtgaatccggcagctggacaaccgaacacctcggccgacccaactccatcacgcccaccctcgccaccggtgcctaggaaagggtcgagctatactttagatcaagcagttacccactcccgcttgtggtaagcacagtaagtctcccagggtttcccgtgaaccggtccttaactgccatgggtgcgtccagcaaaaccatgcactcacagcttgccattcagaattttttaattaactgacacccttgcggtggcaccaatctaaagctatgccaatagtcagagtatatgtaataatgtgacccccatttgtgtactagttgaactaagcatggctaagcatttcctaagccaacatctagtcattttgatacccaagttatcaatggcataaggtaaccaatatgtggctaaggaacaggacccatcccacattacattgtaaaagaatacaacatttaatagaaaaatgcgggatattggtaaattgggtacaatatgatcaaacgtattgcatgacttgccttgctctcgaactgatgagacctcagcaacgtcttcgagaaaccgcggatcgacgaaacggccgaaacctacacgacaaacaaagcacacaggcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaataaattattgcgcaataatacccagggctgacgtcatccaaggggggggcggcgccgataggcggagcccatgggtcagcggctcaaaggggagaggaagggggcgccggcatgtgggccccacgggcagtggctcaaggtggccggtctaccgtggaccgagaccacgcgggtggtccaccgccggtccacaggaccgacggtccggatcggctgggaggccgatcggacggcacggcggcggctaggcatggctcggctcagcttcaaaaccggccgaccggccatggcaaccggcggtgacgcgcacggtcgccggcgacggcaattggcggcgcgggaaacgatggcggacggggtacaggacggcggcgtcgaccgaaggcaacggcgagcgcatggagagaggcggcgcaaacgagagataggggaagagggagaaggggggatcctcaccggcgagtatggcggccagagcggaggatgaaggtggcggcgacgacctggcgatgaggaggggcggacgggcggcggcggcacctacggagggagttgagaaggattaggagtagagagagtgaccacagcggccaccattgttggccggagacgaaggagaatggatagctcaccggtgtgcgaggagaaccgggctccggtggggtttagcggaaaccgagcggcggccgaggtggctcacgcagcggcaatgctaatggcggcggcggcttagcgcggcggcgactctagcggcgcggcgcgcgaccggaggtggtggcaagcggcggcgctagtggcgagcggcgcggcggcggtaggaggcacgggagagcgcggcgaaaagaggaaaacggagagggagatccggggaagctttataggggctcgagaggggcggacatggccgggaaaccccccgatttggccggcgacgtgggggaagagagagagagagtagggggggggattcaaatcgaatcccgcccatttgcgggcacgcatgctggcgggaatggcggggagggcggcgacgtggggacgcggagtaggggcgtggcgtggagcggagaaggcggcggcgcggacggtttcggcggcggttgccgtcgtggagcgggcggctagaggaaggggacgacctgacaggtgggccccacttgtcagcgtcccggagagaggggaaaggggaacggaccggcccaaaggaaggaggccaagcgcgggagggagtgggccgacggcccaatagagaaaaaagaaggaaaagaaaaagaaaaagaagaaaagatttttcctgggatttaaaattgcactttggtgatttttagttggttaaaattatttccaaggctctgaaaattccactaaaaatcttgttaatgcactggagcatggggaactcaagaaaaaattccaccacgctaattccgattattaattgcatttattaactagggatttagctctaggttaattaagataatttcttcgggcaatttatttaaccaatttttaaagcaagaaaagggggggggggaaacttcagggtgtgacaaacctaccccccttaaacggaatctcgacctcgagattcggaatggctggcgaagaggtgcgggtgggtggccttcaactcatcttctctttcccaagtggccacttcttctgagtgatgactccactgaaccttgcagaatctgattactttgtttctggtccttctctcgctggtttcgaggatacgagtcggcttctccacatacgtcagatcttcctgaatttcgatgtgatccggacttgcctgttcctcaggaactctcaaacatttcttcaacttagagacgtggaacacgttgtggatgccaagcatgttggagggaagctcaagctggtaagcagcttcacctctacgttccaagatcctgtatggtcccacaaagcgtggtgccaactttcctttggtttggaagtgatgtactcccctgagcggagtgacacggagatacacataatcccctgtttcgaaagcgagctcccttcggcggttgtctgcatagcttttctgccgagattgcgcgattctcaatctttccctgacagctctgactttctcttctgcctcatttaaaacttctgtaccaaacaactggcgttcccctgtctgatcccagaagagcggagtacgacaccttcgtctatacagtgcttcaaacggtgccatctgcagactagcttagtaactgttgttgtaagagaactcagcatacggcaagcttttgtcccatgctccaccaaagtcaagcgcacaggctctcaacatatcctctagtatttgattgactcgctcggtctggccatctgtttgtggatggtaagcagtgctgaaattcaaccgggttcccaattcttcttgtaatttctgccagaactttgaagtgaattggcttcctcaatcagacacgatcttcttaggtacatcatgtaaacacataattcttgccatatagagttctgctaatttcttccctgagtaggtagtgtgcaccggaatgaagtgagccactttggtgagtcggtcaacgactacccaaatagaatcatgccctgatgacgtcctgggcaaaccggtgatgaaatccattccgatttcttcccacttccattctggaatctgaagtggctgtagcaaacctgctggcctttggtgttctggccttactcgttgacagacgtcacagagtgctacgaattcagct

SEQ ID NO: 5061 - DNA, 1589 bp, Oryza sativa
  unsure (1)..(1589): unsure at all n locations
ccgtcgtgaagcggncggctagagaaagggcacgacctgacaggtgggccccacctgtcagcgtcccgaagagaggggaaaggggaacggaccggcccaaaggaaggaggccaagcgcggaagggagtgggccgacggcccaatagagaaaaaagaaggaaaagaaaaagaaaaggaagaaaagatttttcctgggatttaaaattgcactttggtgatttttaattggttaaaattatttccaaggctctgaaaattccactaaaaatcttcttaatgcactggagcatggggaactcaagaaaaaattccaccacgctaattccaattattaattgcatttattaactagggattttgctctaggttaattaagataatttcttcgggcaatttatttaaccaaaaaagggggggaaacttcagggtgtgacaggaaacaacttcagtatgagtctttggttcttgcccttcttgtgaaggatcatcaatgatagcttccatctcaggctagcaatataaagataagaaatcacaaatcacattacattcacataaatatgtaagtgcaaaagataaaagaaaaatataactcacaataacattctttacaggctcactaaaacccatcttgctgttgcaatggcactccttgaaaacataaattgtagtgggtggcagtgtggcacgtccttatacttagtttgcttctaaaattacatgcaaacagtttgtaaataaagatgccatcactttctgaaagttttttcatatgcatatttagagtgctaaatataacatgccattagtgtaacgttttcttatccataatatgtcatccaatgttttaacaacctatggctgctaggtgcttatatccaccatgttagaaccacagcaacagattatgtagttaaagtgcagttggctagataaaaatatttagggtgattgtacataagtattactaactcctagaaaatgcatgtctagtttctgtggatcacacatgacacatacaaactcaaaatctgaaaaaaaaatcaacttattatacacataacacataattaagttacaaataagagtacaaaagaaccgacacattttattttgtatcttaccacatggcattgtgcaatgtagctccgagagcatgtcctttgctagtactgagcattctcatggttgttatgtttgttttacagacacttctcctatagaaagggaaacactagtaagacaagtagcttatttctatcacatatagataagacaactgtacacaatattttgatagtacgttgtattggtcaatcacatatggtttgactggtcagaagtaaaaacatatttagattcagatcagaaaataatatacgcgtgttagttgtaccacgaaaattgccagtttttacaaatatgacatgcatgtgagcttcaggtacaaacaatatgctagcttcctcttgcttttaaatgtttttcattaccatatatatgatttattcacttgtttctcttggaatgttaacaaatatagagaaaagacatactatgattttttttactagaatatgagacttgac

SEQ ID NO: 5062 - DNA, 15285 bp, Oryza sativa
  unsure (1)..(15285): unsure at all n locations
cattgctcacgggcatactcttcagcgatgatgttgttctcacttcgttttctggtgtaccatcaaagaaaatattcttcaacttgtacctcatttgtcattgtctagacttgagcaaatcagcacatgcatctttgaccgtctgattattttcatctttggcaaattggccctaattaagagcatggataaaagaaaattagcattaaaatagaataacatacaacatgataaacctaatgacaggtgaataaaaaaataagtaaaaatctgcataaaatagcaagcaaaatgaacgacatagacaagaataaagttatacaacaagtagcatgtgttcaacttgggagcaaataaagcaatatgaaagaaaaacaaatagcttctaagacttagttgcggatgttcaacttctccatttaaaattcagattagaattgtatagatccaacatgggcatagaaatgaggatgcaaaattaatcagagcccacacaataatttgtagaaactaggacataattcatcttatacatttgcagatactcacataaagcaacccatgaacatactgcaatacagtgaacaattaaaatttaagagtgttgctctattaggaaagaattgatctacttacaaccactttatccatatagtttttaagttgagacttgccattcttatactccttccagtgagtaaagattggtatgtgctgcctaagtacaaccccccactctgatgcttgctttgcaaactacattggtgcttctggccttctcttcccttcaacaatgcgcaccatcttaagggtgtgtttgngtgctcgtatctatcaagcctggctcatctncgtcatccaggttgagttcgtcctaggtaaagcgatacatatgcagtcgtttgggtgtttgcattagtctgggctggctactacgagatactgttgggtgtctgcacggggataccggtcagatgagaatttgtttggtggttgtatgaaccgtatgtataagaatattttttcttgggtgagatccccgcttataatttcccactatattagagttcaggtaacctgaatttattttttttcatatatcaatcttcttttgttagtaaaacaactcatcaattgaactaatgtagtggagtacgtaactacacagtaaatcgtatattagtgactaattacgggattagagaacggggatagtagaaaaaggaaaaagaagaaaaaagaaaaagtgctctcgcatctcctcacactcctcgctgttggtattttttaacgacattacaagaaatataattcccagcaatggcgcagaaatactcctggtatattatggttacagagttcatccgcaagcgcacggatataccattgtagcatttcacccgagagtattccaaggtatcgtatttattttatctcgtgggaagatcatgtagagagaacttgactaataatttatatattacttgtgataatcatattctaagcaggggttaagataatccaagggtagagtaacacacaagcactaactactcattcttatgatatattatctaagctaagtggaaagaaaagaggaagaaaatctattcctatacttctaatatacatagtatacatacattctagttaaccgacatactagctaataccctctatccgatgccctcctggtacttcgagaagccaccccagactgccgagttccgtacgacagcccgttatgaccatataatcggggctaaatacggaggaataccctccccaggaaattaacttaggattatatacagacgcggaggaatacccgtactgagctgtcaccatcagcggcccacctctcatccgcagcatataaccccaaataatgatatcccgtaatctagacaacacgtctaaacgaccagatcctactctaatatcatcgtcatgacatagagtaattgcataagcaaacattatacccacaccaaagcatctcccagataagctagccgtatatccagtataacaagaacataatgtaagtagatatttcatatacttggaaagtatttcaatcccataantgtatatgagnagtattctaccaaagtcaagcttacaaaagaggaaagganagctattagagccatacccgaactcttccgaaggcttccggactcctgatttctactctattcctattccaccagctagatactactaactaaacttgagagaaatgagcgagctcttgcttgaggtgtgtgagtgaagtgagaaggtgaagtccttatatagaggtagttatgacggttgtggaaggggaattgtctgaagtgctctccaaccgtcattgggatgcaatcttggatgtccacgccgaaccctgcatccaacggtgccaggatgggtaccaggttcggctgaagcatcagctgggccatccctgcccttcttcggctggcggcctcctctattgcttcactttgtagacttgtgaatttttgtcaattctgagttcttggcccattcatacatcagtctgattctcgacatcgtctgattgatttatcgtttgatttgatgtcgattctcctctactttatggttattctctgcaaaaggttagtaaacctaatactagtggaatattattattctaacatgtttaagcattgcaagcatcactagttctcctctattttggaaatattgacggtcgaaactgatcgataacgaacatcaacaaaaccccccaagcttgaacctttgctcgtcccgagtgaaggatgaaaggaaacaatgacttggttgttgatcaggagttgctactatgctgcatatctcaatgatataggtgcaaggtatatgtaccctctctcagattaaataatcttttgcacggtggcttactcttacccctgattcccacgagacactgcttctccttgccttgggtggttgaaagaaagaacagcaattagagcaccaatcacccaacattcattcaactcttattccggaagttttgaaatgatttttgtaaaagaaagccaagttcctcaagtgattcgctcagactctctaagtgtatcaatatgacttcctcaccagattttgcctttttgattcctactttaaggttttaatatgtggagctcggtagagatcaaacatggcatacttgcattcacatttattactaagtcaaaaacttaaactaaagtagataattaaaacatactaaagatcaagatcgtgcaatgtgtgtgtggtatatcgtggaaatggcacacgaggaaaaataaagaaaatgcttctcctttgtgcttactttcttctcccaaaaaatccttcttttattgattaggagagggcatggctatttatttattttttttcaacatcatgctcatgcttgatggagcataactttattttttttcttttcataaccatgccttttccttcttctctttttttttcaaatggatttttctttttaggagaagaaagcatatgaaaacatggagaatttattttgttggtaacatggaaatggaatggaatatttgcttacctcccagtgtaggagtttggcatgtgtgtcgacgggggatacccgtagaccggatatagagggtattggtgtccgttggtacaaggatctacgtagtacgacatcaagcaaacaaaagaaggattatactggttcagggcccttggtaggtaatagccctaatccagttgatatgagattatatgatggaaaacacagattacaaagggaataacagaactcgatgataccgatgagaccgtagtcgagttggtccgactagatctcccggcgacttggctcctgcatgctccggctctgtaggctatagtgggtgtgttggcggtgatattcgatgccttaggtcctgcccagggggttccttatataccgcgggtcagttgatctctaagtaggactcggagatatcgaacccctcatgatatggtaaaaacccagtcttgtccgagtagaactccttccatccgtagataccatccctatcccgtgatagatttccttaatgtatacggaaactatctgtatacgcgtgggtatattgtatcagtatacaacgtacatccaaggatagagggtataacttatccgtaaccctgacaatgtgcatatatgtgggtgtatgatcttgatcatagagcatgagaagtatctacacaagtcacaagagtttgacaaagttcaatggaatggcaagtaaccaaaatgtatatggtttaatcatgatagcacattttttgctctggtaggaatttatatcaaatgaggaactttcaattttatcattttgaaaaacagaacattcggaatgtaagtcaaactaggatcatgatcatagtaacacttatttactatctcatatcttgcaacaacttagactcagattagcaagtgcagctcatttacctcaggttcctagataattgttggctacttatatttaacctttgagagagcacttaccatgaacccatatataagagatataaaacagagcaactattcatcatttcaacaaagagaactggcttgtcttatctagcatgactcaaacctgtcgtatccttttggtattttctactttgcaaatttttatattgttttcaagtttataagatgcaattggaaagcaaacatgcaattgaaaagggaaatatgcaatgtgatacaagttaccgcagtggggggagagacatctctccccccaagcttggctttcgctcagggtccttgacaaggattgaaccgttgaaagcggtagtacatttgaaggtcatcgtgctgttgctgcatcatgttgttgaagtttgcgaactgagcatcagcagattgttgccattcttgcgtttgtgctatgtgttccgtgaggttgtactggatctcccccgtctgcatataaagggtgtccattctcctagcgatttcacccaagccccaacgagaggaactcgagcgccattcacttcgagatggaggcacaccacttgatctggaaggttggttattcccccaatgtatgtcattaggcgcatgccatcggtcctaactggcacttgcccagtttgagactccgatgctatggcgttgagcttgggtccatccgggtgcatccccagttggttcccaacctgcctcatacatttgcacgagtgttgaggatgatgaacttccctgttcatttcttgccatgttgcgcgtctccctgtatgctccacctgcacgagattcttctatggtgtgcaggggaatggttagttcacgacagttgtacaaatgataccccgcatttggcaacgggatttcatttatacaaccgggaaaaaagtaaattaaagatccatcttctccatgtttcagaatatgcccttgcactagataagtctcatcaatacatggacaagcggctgagataaaagcaatttggtcgctaatgaccactagcccttttgctatccgagtaatcagagaagtgcactcaacaggagcagagaactttatattttctaaccattgccttatcatacatttcacaggagcaattttgatctttctaaccatggcaaacatgataatcaattcatcccccataatgggtctaagatcacctctaggaaacaaagtcatagcaatccatttgtgcctaagcctaagtgtaggattatggatatcattctttccaagtttcttgcaaattggagcaccagaaatatcttcccaaaacctatttttctcgaacccagaaattcctttctggagatcgattttacaggaatcgtgaaaaccaagagatgtgcttaagcctttccatgtgagtgtatactccttatggaaaaagcaaaaggaaatttcatcttctatttctttcaaagtgcatagaaattgcaaagaaagcaaacgagaaccaggctcatctaccacagcaaatctctgccaaccaacagctttccaaatagcacgaaattcaacatccatacttatctttttaagtagttccagtgagtattctcgcgtgtgagcatactcccggtcgctcagcatgtagtaggcttgtttctcccgatcactgacaaggtcgaggtcggtgttgttcaggagtcatcgcggagcttcggcgtcttccatcaagacatcggttgatgaacgagccctagactcatcatgacgacttgattaagagccggaccccttgaacagacgagacagtcgcctcctcattctgcacaatggagcaagagtggactaactcggcgggggttaggaatgacaaaaatttcacccgacggttagtttcaccaaagcaacttgtatatatgcaactaagtatttgaatttgagggaaactatcaaagcttgaatgaacttgagagcaaactttgaagaaggaatgaaaatgtgttgaaatggggtggaattccctctctcggccggctggcttttatagggtacccacaacggtcagaaatgacatgtgggtcccactagccgttaccctgccaaaagtggcaggtaaccgttgcctggccggttcggccgaacccctggtgggcccaatcggccccactttcggctgttggattccaacggtcagtgcggtcgtggcacagtgaattttcgttaaaaattttatgttggtttgcactgaacaattcatttgaaaaattttctcaaaattcaaagaatcctaaatgcagttttgaaatgcaaacatgtgttgatgcagaaattcaaattggtgaaaataaatatgcgcatacataccaatttaccggttggcgaaggtcacgtcatttaaagtccgacgtgcaagtctgtacctccttccgattcagtgcgtggattttccacccatctccgaaggtgatggagcgggcgtctttcgcttctccttccacaccttccttggctttgatgcggacggcggcttcctctgagccgactgctctagctttttggccgatagggttggttttaccggcttcctccaataacggttcctgggcatcgttgtttccttctccaggaaattctgcatgaacttcaccaggctgtccgtcttgggtagctccatttcgaccacttgaatgttctgtgggtttggcccgtacttgattctgaccatggagcattgttccgtccttggttgaaactcaaactttttctccttcccgttgatatgaaaacggatactccctgttcccacgtcaatgttggctcccgcggtgctaaaaaacggataccctaggatgagcggcgtctccttccccatgtccatgtataacaccacgaaatcaaccgggatgaagaaatctcgtatcttgactggcacgtcttccgctatccctgacgggtaacggactgacaagtcagctagttgtaggcacatcggtgttggtgccaacactgtgaagttgagcttgtcaaagacgtcctttggcatgacgctgacactggctccaagatcgcacaaggcctggtcgaactgctgtgccccgatcgaacaggtgatcataggagcttgtggagtatgacattgctgcagtgctccatcagcttgaccacctccgttgttgggagcggtctcttgttgttgagtatgtccttgagataacgggcatatgttggtacttgcatagcgtccaacaacagcatgttgatgtggatcttctggattacttcaacaaaacaagcgaattgctcgtccactgacagtttcctactccgttgaggaaacgacagcagccgtgtgtcgcagtactcctgcggcacggtcttttctggctgatcttccttgtcagccgagtcactagatggcgcttcttttgcaatcttgttaattcctacaggattaggatacggcggatcacaagtggacttaccttccctcgtcgtgatcgctttaacattttcaaggaaggagccgggttgcctcggaatcctcccagtttcattttcaaggactaaggatgctaactgagctagctgggtttctattatttcgttaaagctcagctgattttgaaaagcagaagcacaaccatctaacttgacatttatgttttctaggatcttgtcattggcagcaagctttttgcttagcgcatcagtggttttagcttttgcaaaaactagatccttcaaggagggctggttagaaaagtaccgttgttgttacctccttgataatatgggcgtggctggctccatccctgacctccttgtggacagtacccgttgtttttgttgcccatgtacatcgcctcctcacgggtttccaggcagtcattcccagaatgacccgtgttgccacagacctcacacgtaatgtgcgaatccaagggccttgatggtcccttgtggtcttttctcgtggtcgtccaatcgcttcatgagaaggtctagtttgccagcaagcagttccgtctccttgacggtgtgcatgcctcgctgacgggtctggattcgttcctcgctccaacccatattggagaccatcttctccatgaaccgttttagagaagaacactcctctagctgccgcgtctaggtgatcgcgggacgtgggcgtgagtccattgtaaaagttctgcaggattagcgagtcgtccatcccatgatgacgacaggcggccacatattcctgcagacgttcccatgcttcaggaatagactcgtaccttgtctgctggaaactggaaatccttccacgaagggcattggttttgcccatcgggaagaatttcgagaggaatgccatagaacatttgacccaggtattgacagtagcacggttggcatagaaccactgcttcgctctcccgagaagggagaacagaaacagtcttaacttgacggcgttgggactgacgcccttgatggtgtacgtgctacagatctctagaactgttgcagatgagcattggcatcctcattaggcttgccatagaacgggctagcctgcgccatagtgatgaggctggacttcaagtcgaaatccacgactcccatgttgatttgcggcccaatggccacattgtcagcagagggagcagcgaattcacagagagtcttgttagccatagtcttgaaggtcggtggcgctggtatggctagtttctctgacggtagagttttctatggagcagcgactcgcggcctaacgctccggaagaaagctactggatttttctttgaagttttccggcaagttgaaaccagttatgcactaccctgttttcacaacaaaagttaaaacaaccaaggttagactgcaaaggaaaatgattatacagaggtaaatataaaatattagttcaggtaatctctactatgaatcttccctggcaacggcgccagaaatgtccattggtatttcttaacgacattactagaaatataattcccagcagtggcgcagaaatactcctggtatattatggttacagagttcatccgcaagcgcacggatataccattctaacatttcacccgagagtattccaagggtatcgtatttattttatcccgtgggaagatcatgtagagataacttgactaataatttatatattacttgtgataatcatattctaagcaggggttaagataatccaagggtagagtgacacacaagcactaactactcattctcatgatatattatctaagctaagtggaaagaaaagaagaagaaaatctattcctatacttctaatatacatagtatacatacattctaattaaccgacatacaagctaataacctctatccgatgccctcctattacttcaggaagccacccatgactactgagttccttacgacagcccgtcatgaccatacaaccggggctaaatacggaggaataccctccccaggaaattaacttaggattatatacaggcgcggaggaatacctgtactgagctgtcaccttcagcggcccacctctcatccgcagcatataaccccaaataatgatatcccgtaatctagacaccacgtctaaactaccagatactactctaatatcatcgtcatgacatagagtaattgcataagcaaacattatacccgcaccaaagcatctcccagataagctagccgtatatccagtataacaagaacataatgtaaagtagatattcatatacttggaaagtatttcaataccataaatgtatatagaaaagtattctaataaaagtacaaagcttacaaaagaggaaaggaaagctattagagccatacccgaactcttccgaaggcttccggactcctgatttctactctattcctattccaccagctagatactactaactaaacttgagagaaatgagcgagctcttgcttgaggtgtgtgagtaaagtgagaaggtgaagtccttatatagaggtagttatgacggttgtggaaggggaattgtccgaagtgccctccaaccgtcaatgggatgcaatcttggacgtccacgccgaaccctgcatccaacggtgccaggatgggttcggccaaaccatgggctgggccatcccagcccatcttcggctggcggcctcctctattgctttactttgtagacttgtgagttttggcccaattcatcgtgtcaattctgagttcttggcccattcatacataagtctgattctcgtcatcgtccgattgatttatcgtttgagttgatgtcgattctcctccactttatggttattctctgcaaaaggttagtaaacctaatactagtagaatattattattctaacatgtttatattgcaagcattactagttctcctcttttttagaaatattgacggtcgaaactgatcgataacgaccgtcaacactcgctgcgagcatggacctcgcttctcgcagcctgctctgcggagcttggctgctcgtcgtcgtcgtagtcaccgcatccatcgctctcgctgatactcttgctctaccgctcctctagccgcaccgctccctgtcttcatcgtcatggggatggtttgctgctgctgctcgccttgtcgcgtcgtggcggctagatccaacggaagcgccggagtagttggttgcaaaaggggttattgctgacagcggcgacatggaggaacaaatggggggcgacattggcgacggcgaggcaagggcgacggtgagcttcctgatctagaatcctatctcattcttgtccatcctcccgctattctccttcttcccgaatctggctgaggccaagtccggcgatgagcagtgcagtagcaacaaacccatgccttttcgttttgggggagaaatgagaaagggacaggatggtgaccactgaccccttcgcacctcttgcacgcgcgggtgcaacgcgtgcacgcgcgggtgcagtgttgctgcacgcgttgggccaagacaagcagcgaaactcgaatcggccattcctgctcagcctggctgagggggcctcttttgcatctgctcggcctggctctagcacatctgcaggcaaccaaacaggctgcaagttgcatccggagatacgaaccaggctgatacagccaaccaaacacgcccttagtgcataaacctcggattatcctatccagatatcttcccatacttcttcccctattccattgatcaatcatgccttttggttcacctgaaaatcatgaaattttcaaagttataggaaataatcaacattttttatgcaaatgtataaaccatattcactacaacaaagtgccaataccaatacatgcattctccagatttgataattgagttgatgctttgtggaccactgcagttctatccataccaatgcgatacaacacttgttctagaagagtatccattaagggtggtcccatgcatatttaataatatttttttgttattaaaattgcttatctgataatacatgatagtatctactcatgttcagacacaatggcccaatacacgcatgcaatctatgatatttaaaaatatatatagttatatcatccagtctacagaacagtcaagattattggaattatagttactactggtgaacttacatttcaatataattatataaaatattgctaccagaatacaaattatgccttcttctacactgatatatttattaagaccagtgagtcctcctatacaggcttccaggctatattcaactcatctaactatgggttgccttctagcttattttgatatattagttgtgtttaaactttaataaaaaaatatttatttagatgcaaaagcaagggtaacttggtaaaaataatacgatgttcagatgtaaatgttgtcaataaagcaagtgttggcggttattaaaatgccgattctataccaccaacatcttcataaagtccagataataaaacatccaacatagtgatagttgttaaatctcacatactccacgagtattggtgtatatttgtatgaagatgataaacccagaagttgggaggaaaatcagactaaagtgaagaaggaaatatatccatacaaggatgggctttgaactttatcaaaatactggagaatcagcccaaaactccgagaaatggatgaagtaggactaggggaggagacgggccaaaggccaagctagcagggccagtccaggtttggccgaaccctgaccaccaccgttgatactgggatttggtagggacggtccagatgcactcctgatggcagttgcatggcatttcggacaattccccttgtcataaccgttgtacctgtcctataaatagacttcactttcttcacttttacacacacacttcaaagcttgagctgaattataagaggctctattgtactccctccatttcacaatgtaagactttctagtattgcccacattcatatagatgctaatgaatctagacattattatatatatggattcattagcatcgatatgaatatagacaatgctagaaattaaagtcctacattgtgaaacggaggaagtactatttgtatactagaattaggacgagaatagagtagaagaagtcagaggaattccggagttgtcggtaatcttgtctcatttcttttatcttcccgagtaatttagatttatcttgtgagaattatctattggctagttcctaactagcatacgagattattgttcactataatcaactaaaatatagtgattgctttggtgagttataaacactaaaatagatattaattgcttagacgtggtgttaggtaattgttatccattaaattgctgtgtatcccacggtacgtttgaggtaggtgtagaagtggtgacagtcctcgagatcagttaagttctccctatcggggtatgtagtagagcgacatctgggaacagcgggttgccagtgcctgaagtattgcgttaggattaaacttaagcttgccctagacacaggttctcactagtaaatcctctctgtcctagcctatcctttgcttggtgcccttggatgaaccgaagggagatctgatcacacacgttcccttcgattcgatacccttggaatactccgtaggggaagtgctacatcggtatatccgtgcgcttgcggatcttatctttgaccgtaagaataaccaacgcatttctggcgccgttgccggggaacggttgttgataatttccgaacctagttcatccgtctatctcttttcattttttattctaccttcacccctgctgccaagagaagtattccttttaaattcttctcgaccatggagcaacctctctttgagctgtctgctcctaagggcgaattctatgagccacctccttcatcggagccaatttatacaactggctatgaaattcgccccaaactaattagtatggttaggaagaatccttcttctggtcttgatctagaaaacccctaccatcatctgcgggactttgagcaagtctactcatgacttaacattcgtggcatgaagcaagaaactgtacgatggaaattgtttccgttctcccttcaagagagagcgaagcaatggtacacatctaccgtaggatgtgtaaacggtagttgggaaaagccgcgagacaaattctgtcttgccttcttcctagttactcgtattactgcccttcaagtataaatcctcagtttccagcagatcaataacgaatcaatcgttgcagcttggtccagattcactaatttagtgcattcaggacaaaccttgtccttacccgagtatgtgcatctgcaacattttcatacgggtctggataaggagtctgcattctatctggacataaccgccggaggatcattcgtgcaaaaaacaacgtcagaaggaaaagtaattctagaccgcattctagaaaataattacttcatgatgcaatgcgatgaaccccagctggaggcatctgtatccaagataaaggagccttcaaccatcgagtcacaatctgaaacatccacttcgaccaactcgattgatgaaaaagttaccgaggcaccataagttgagaatgaagaaattcagactctggatcgtgccacaattctgttcagggatggttttgacgaagactacgccaacaccctgaactatttcagtaaaaagaaaccaatcgtccccttgccacctcgcgatcctatggaactttggttcctaagggaaaccgtttgggagctgacatccataattgtaacgccccgattttcgtttgggattaaaaatcatttcataatgcatttcctagaaattaaataaaaatttaagctatttattcaagtgaattaatgggagaattaaaattctcccttaaaaatcattgtccgagaatattttgtaatattctctgtgccctaaaatactctccggatttttccgtgaattttcggagctcaagaaataattttaaagtcacaaagttcattaaactaatttaaataaaaagaaaacaaattaaaatcatccttcctctctttgggcccctttcggcccaatccctcctttcccttcctcgccccgcttgcccctctccccttcccctccttccccctcccgggccgtcggcccagctcgctcccgttttcccctccctctctctctccgacaggtgggacccgaggccccacctgtcatccccttcctccggctccaaccggcggcatggccgcccgagccaccccacgatgcc

SEQ ID NO: 5063 - DNA, 11326 bp, Oryza sativa
cgctgcgtcatgccgcacccggtccaccgctccccttccctaatccattgccgaaacgccgccgctacattcaccatctctctccgccaccgtcgccaactccaaccgcttcccgtcggcgagcaccgctttgcccgggtgcgccactgcctcctccacattcgccgcgccccaccgcacctcggccgccgcttttcatgccgttatcccaccggaacacggtattcacgccgctgggagcctcctcaccccctcctaacctctacctcatcctccccaggtccttccggccgccgtcagccggttcgcgctcgcggaacgccgccgggccgccgttccgcctttgtcccgaggagcgccgctgctgagctcctctcgtcgccgcgtccttggtgagcaccgctctcccttctgccgtttcccgcgccgccgctcgccgtcaatggccgctggccgtgcgccgccgcctctcagccgtccagctgtgagccgccgctgcccctttggcagtgcaccaccaccgtggactcagtccatggtggaccaactcctttgacccgctgatgagtaggccccacgctttgtggacgtggtccgcacccctcctcttgctgacgtcagcaaccccttttcctttggaaaaataattaataattgcgtcataaatagtatttaattatagaaattcatttaaatggctcaaaacttctaaaattcatatctaattcatatgaactccaaattgggccattcaacttgcaaaattcatctaaaattgagctttacatgtttgtttacttttgatgcactgtttgcttggtctttattagagtttttccttgttttgcgtgccagcgtgtagaatccgtcgtttcggaagtccgcggtcgcgaggaaaagagttcggaagattgtttgaagaagcaaggcaagtcacacattcccgttgagcattttgatcctactttacaagtttttaccgtttgcaaataaatatgcatcgtttgctaattacatgggaatagagtttccctatctgctcgcttgtgccatgtttacttcatatttgttctttgtcaaccgtgggtgaaaattcgactagcttgtgtcacttgtgttgatctagctagaactatatgcttagccatgcttaattaccactatctcagttgatgggataattgcagtattagaccttttagtatcattacaagctgcgtgctcgagacacccgaacatgtttcattggtcgtaattatccaactaaaatgcgactgaatggtgggctgtgggtgcatggttttgcgagtcgtacccatggcaattaaggtccggttcacgggaaaccatagaaccggtggcgagagtgggcgtgatggagttgggtcggccggggtgtccggttgtccagctgctggattcaccacggtgcacgaggggactgcctgctgccttgcgaggagtgggggtgaaaccttagcgtggtgtggatggttaggggagagttatatgaagggtcttgtcacaatcactcgacgtggtgacgtgttcatcatgggtgcatgatgacgcggtgacatgccggtgaattgtgtcttgtgggtacggttgtgcacctctggccagagtaaaactatttgaatagccgtgcccacggttatgggcgatcgaccagatttaccgtgattactctcacacttaataaatcgactcaatgcactgtagttcaggtgggttggctgggcctgttcaacatggtgtagtgttgatcagtggagatttaatattaccttaattactcaactgttttactgttttgctcaataaaatgttttacaactgcctttaagcaaatagccacaagccattcttgtatccccttgcacgtctgcatcgttggtgtggcttgctgagtacggtggttgtactcagccttgctatttcccccttttcagaagtgttgtgcttctgagctgaagacggagttagaggaccaaggctcagacctcagttgagttttgcctgtggagtggagctgaagccccgctaggatcgccttttgccgctgctgctgctttcatttcggtgtgaggactaagtgcctcttctgtaagtattttatgctttatttacgtttggaactgtttattacttatcgttttgtgtaccctggttggtcctggacagggatttaatacacaaaatagtctagacatttgggctaaatttttgggcgtgacaataatgagtgacgaatgatcaaggtaagcagagatttcatccgaagtaattctaataaataccgctccccgagttattccttgtcacctagaagggaacaacgttggtattctatacagtccaactgtcggggttaatctcgtctcggagtcatttgcattcgcttacctgggcaataaagctataaccctagcaaacaaattcttcaagcacccgaatggaactatcattgaaggatttgggattgtgcaagacgtacctgtctgctttgaaatccaagattttgacattctaattgggcctccaattgagcaactcctcataaatacacctcgattggacagcctcaagataactttgggagggaacgaattctcagttccattctcacgggcaaggatcaccttgaccgacactctcccagagaacgagtttgcagaggaggttatggcagttccccctcacgagtctcccgagacccttctggaaaatgaagtccccaacttcatcaaacaagaaccggagcccggtgagactgacgaacttccaatcatggaactgccgcctcgacctccacttgagcttaaacctctacctgaaggcctatgctatgctttcttgcacaatgacaaagaagcccctatcatcataagttacaagctttctgaagaggagactcaacgtcttctgtctgtgttagaaaagcatcgcgctgttcttggctattccctctagggtctcagagggattaatcccgcactttgcactcatcgtatccctattaagcccgagagcactccctccaaggaacctcaacgacggctcaataatgcgatgcgtgaagtcataaagaaagaggttctgaaactcctgcatgctgcgattatttatcccgtttcatatagtgagtgggttagcccggtccaggttgtgccgaaaaagggaggaatgacggtcgttgcaaatgctcgaaatgaacttatcccgcaacgaacagtaaccggatggaggatgtgcatagattgcaggaagcttaacaaggcagaaaaaaaagatcattttccgctacccttcattgacgaaatgttggaacggctagcgaatcattctttttctctgtttcctggatgggtattccgggtatcgtcaaattcccatccatccggaggaccagaccaagactacgttcacatgtccgtacgacacctatgcttatcgtaggatgtccttcggactgcgcaatgctcccgcatcttttcaaagatgtatgatgtccattttttcaaacataatcgaggacattatggaagtattcatggacgacttttccgtctatggaaagaccttcggtcattgtctactaaatttggacaaagtctttcaacgatgccaagaaaaagacctggtactcaattgggaaaaatgccattttatggtccgcgaagggattgttcttggtcatcgagtgtctgagcgaggaatcgaggttgatcgtgcaaaaattgatgtgattgatcaacttcctcctcctgtgaacatcaaggggatccacagcttcttgggacacgctggcttttatagaaggttcatcaaggacttctctacaatcgcccgacctttgaccaacctgcttgccaaggacgctccctttgggttcgacgatgcgtgcctaaaatcctttgaaattctcaaaaaggcactcgtctctgctccaatcatccaaccccctgattggacactacccttcgagattatgtgtgatgcaagcgactttgctgtcggcgcggtcttgggccaaaccaaggattaaaagcatcatgcaatctgttgtgctagcaaaactctacccggagcttagttgaattatgcaactgctgaaaaagagctgctcgcggttatttttgctatcgataagtttagatcttacttggtgggagcaaaggtgataatctacactgatcatgttactctgaaatacctgctcactaagaaagatgctaaagcacgtcccttgagatggattttgctgctccaagaatttaacttagaaattaaggataaaaagggagtagaaaattccgtagcagatcatttgtctaggctgcagattactggcacacaggaacaaccaataaatgatttctcgagagatgacatgctgatgacggtgcgcgactccatcccgtggtatgccaacatagtgaactacatggtatcaaagtacataccaccgggagaaaatcaaaggaagctgaaatatgtgagccgccatcatatatgggatgagccatacctatacggggtctgctctgatggactgttaagaagatgtgtgccaactgaagagggacttaagatcatagaatgatgccatgcctcgccttatggtggacattatggtgcattccacacccaggcaaagatttagcaatgtgatttcttctagctgacgatgtacaaagattcaaaggaactcgtcagaagatgcccaagctgccagaggcaaggaggaatcactgctcgcgatgcaatgcccctcacatacaacctacaagtcgagatatttgatgtttggggtattgactttatgggaccctttcccaagtcccgtaattgcgagtatattgtggtgatagtcgactatgtctccaagtgagttgaggctatgtcgtgcagcgccgcagatgcgaagcatgccaagaagatgttcacataaatcatcttcccaagatttggtaccccaaggatggtcataagtgacggaggttcgcactttatcgacaaaaccattcgagacctcctgggagacatcgcagccaaacacaacgtggccacaccttaccatccacagatcagcggtcaagcagaaacatcgaaccaacaaatcaagaacattctgtaaaagacggtcaacaaaatgggaacaggatggaaggagaaattgccagacgcactgtgggcataccagacagcatacaagacacccattggaatgtccccctatcagatcgtctaccggaagtcatgctgactccccgtagagcttgagcgtagagcatactgggccatcaggaattggaacatggattttgagggagtaggagaatggagaaaaatgcagttagcagaactagaagagtggagagaaaaagcatatcacaactccaagatctagaaagaaaggatgaagcgctgccatgatgaaaggataaaaattaagaaattcaagccaggaggcaaggtactgatgttcaactccagggttaagctgttcggccatggaaaatgacgaagcaaatgggaaggaccgttcaatgtcatcaacactgcttcgcacggagcaatcacacttcgtgatgactcaggtaacatatttatggtaaacggtcaacgtttaaagactttccttgagccgaatgaaactttagatgaagaagtggttattattgaattaattgattatgattgatttcctgtatgaaactttaaagactttctcatctaaagcatgcttaatttcctgtatagttgtcatttttgtgcttagcttaggattgtgtggggccagaagaaaattggtggccagccggactcgtctggttctgccaaaccagggtggcgcccgtttggtcccattttcgacaggttgtttccaacgcgcacttgtagtctattgtgaggcgcattcggaggtacatcgactgtatcaaagctcagaacaccttcttcctcctttcctccacctttgcaaattcccttctccaccctagctcaattccttgagttccactctcaactcactaatggctggcaaatctttgatgccctatattggctcttcttccaattccacttataacctcaacggagagcccactccggccaaccaactcatccccatcgaagattacaccatggaaggattgaatgctgtctggacacaacccctcgcgatagtgctgggctcccctgcaaatttgtagcccattggcgagcttcctgcaaatttgtagcccattggcgggcttcctgtgggcataccggcagcttcttcgtgagggggattgtttgtgccatctgggcccgtcgggtcaggcttattgaacatcggttctgtgcccgagggagctttcttgttcatcatctttttctttgcgcgttcttcaaatggaacaatttgaaactcattttataattgatatttcatacaaatccactaaaccaacgtaacgccacattaacttcgtattctgtgatggtttgctagacctctatctcgtacctacgtttgcctcgtggacagacacatccacgttcaacaaggctagagctgatgaggtctcgacctcaacgttaatatcccacgcgaacgggctatcgttgtcgctatctgaagatacttaaaatgatagccagttcgagtgggatactgatggtgaggccgggacctcatctgccccggcctagaggaacgtggatgctacacatctgtcgatgaggccgacgcaggtagaagacacgggcaaccaaacccccaaggtatcttatttgattatagacaattgcactgaacccctaacgataacaatattttagacatatctgatctgaacgaaatgttctagtttccaatgtgtaattaccgcctcctaaaatgcacctacttgtattcaccgaattagcctaatttaataaattgcatcaataataaaatttcatcacaaattgcatctcactaattaaatcctattcaaccacatgtgtaactcagatcccctaacatcacaattccatctcatatactgtaaattaacaaagtccaattaattacatcataaatactctaaaatgtagcactcacaattccatcacaaattccctaatttaacaaagtccatttatttactctaaaagcacatccttaatatcatcatcatcttaacattacaaattaacattcaaaatcgcatctcgcacaaataacacatatatcacacattgcatatttcacatattacatattgaataattttaaaaagccaaaaaaggcttaccggcggccggcggcttggggataaggtggctggcggcttggggaggaggtgaccggccgctgcttgaggccgatgtggccggccgttgcttgggggcgaggtggccgacagcaggttggggatgaggtcggtggcggcttgggggagttggtcggtgccagcttgggggagtaggctgtcgtgctcagtgaaaaggccggtggggtcgtggaggtcggcggcgcgggggacgtggtcggtggcagttcagggagtagatccgcggtagagaagacggcggcagaggcggcgagggggatggaggagagggaggcggcagcggcgagagggagagagaagagggaggtggctgacggtgccggggaggggggtgaggaggcgcacggcggcggtggaggaggtccacgagtggagcaggtggcagtggatgccggggaggaggcggaggagagcacaaagtccgggcagggggaggaggccgaaagttggcggcgggatggatctggccggcgtcgagcaggtggcagccgggaacaagaggagagtaggcagcggcagcgtgggcgaaagtaggcgacgagggggtgagaagaggaggtggcagcagcaatggatttgggcagcctggtggcatggctccgaaaaatttcaccaggacttaaaaattttcggagcccgcccaagcatatgtagggcgaggaggggatttttccgtgtgcgcgacatagccaacccacacggaaagatattttcccatgcgggccatttatcccacccgcacgggataatatgttgccctaaaaagtaattatttaaaaaattattcaatcatacttttataataaaaaatcacaacttaatcacacttgattttaaattgttccaccatatgattaattaaagaattagttaaaaaattgttcaaccatatgggtaattagtttactaaatatatttatagttaattaaagcacaacttaatcacacttgattttaaatcgcatctaactaaatataatcacaaataattaaccacatatgatttttaatcgcatataattcaatcgcttgcatattgattaaaccaaaacttgaaaaatcaatataattattcacccatataaattgagaccgacatatattagggataaacatgcatggaaccgcgcattcattcggaaagaccataagtttgttccattaatcgtttacaaaataagttgtacacaccaacatatgtactaatgtttaacaattttggaaacatcatccgtccgcacagtcgagaacttctcttcgtcaagggttgtctcaactcgcttgatccggttaggaagatctatgaacaatgggacatcgtcgtattggttgtaatctgacgtgtcttcaatgttatcaatgccaatgatgtgttgctttcccggtacagcaatgaccatcttatcatcagatgggtccttcacatagaaaacctatgcaacacgctcagcaagaacccatggatcatccttgtgtcctagcttgctacgttctacaaccgtaaggctgtagttatcgatggatacgcctgttgtgtctcttacccattggcatcgtagcaccggggtctagatgttaaggccatagtcaggctcctaatgtcttttatgatcccatagtaagacttcttctagcctgatgcgtcaaacgcctccacccgaactccgctattctgagctacgcttttcttgtccttacatatcgtgtaaaacctatatccgccaatatcataccattgccatgaggtcacaaggctagttgggccatttgctagcatgtgcaatgttttttcctcgagcaattcaccgaacgacagctctttctccttcaaccatttaggaaatttacatttctattccttagagatccaagtggccgtccttctagggttgcaggctcttatctcgttcatgtcttcctcaatgtacggctcgacgatggtgagctattgcaacacgctgctatgtgcttccactacagcattgtagtcctcatcatagaaccttttcttgcctacaaacctcgtcccagctaaccgaccgtcatgtacaggggggttataccaatgggttcagcgtccttcatgtagtatatgcagcattcaaccacctcctcagttgtgtaccccaccatcttttttcctaccctcttgttgccatctcatcaactcggcatctgtacggttcgaaaatagccacttcaggcaatctttcacaggcgggtaccacatcaccattctaggaatctttttttttcatccaccgatgcatcttggtcgaccacctctccatcggaggctccgttgcccgtcttgtaccgactcgtctcacatgttgggcaagagtctaaatccgcgtattccttgttgtacagtatgcaatgattttcacatgcatggatcttctgaacacctagagataatggacatatcaatttcttcgcttgatatgtgttccttggcaggaggttcggcttaggaagcataactctcagaagatccatcaaatcattgaagctagtgtccgaccattcatgtatggccttcaatctgagaagttgtcacgcccagaaatttagcccaaatttccagattattttgtgtattaaatccctgtccaggaccagccagggtacacaaaacgacaagtaatatacagttccaaacataaataaagcgtaaaatacttacagaagaggctcttagtcctcgcaccaaaaagaaacgacagcagcggaaaaaggcgatcctagcggggctacagctccactccacaggcaacactcaactggggtctgagccttggtcttctaacttcgtcttgagctcagaagcactacacttctgaaaagggggaaataatagcaaggcttagtacaaccaccatactcggcaagccacaccaacgatgcaggcgtgcatggggattcaagaatggcttgaagctatttgcataaaggcagttgtaaaacattttattgagcacaatagtaaaacacttgagtaattaaaataacattaaatctccactgatcaacgctacaccatgttgaacaggcccaaccaacacacctgaactacagtgcattgggtcgatttattaagtgtgaaactaatcacggtgaatctggtcgatcgcccataaccgcgggcacgactattctgccagaggtgcacaactgtacccacaagacaatccaccggcatgtcaccgtgcccggccggacacgtcaccatgttaagtgattgtgacaagacccttcatctaaccccctctaaccaagcataccacacctcaggtttcatccccgcccccaacaggcagcgggcagtcccctctcgtgcctaggcgaatcagaaagccgcataggccgtcgcagggcccatccgaacttcatcacgctcacccttgctggatgcgtcagccagagaaaagctatacttcaagtcatgcaattacccattcccgcttgtggcaagcgttgtatgtcttctagtgcatcccgcgaaccggtccttaattgccatgggtgcgactagcaaaaccatgcacccacagcccaccattcagtcgtattttagttagataattacaaccatgaaacatggccagatgtctcgagcacgcagctcatcatgatactaaaaggtctaatactgcaattatcccatcaactaagctagtggtaattaagcatggctcagcatatagttctagctaggtcacataagtaacataagctagtcgatttattacccaatgttgacaaaggacagatatcaagtaaacatggcacaagcgagcagataggtaatccctgatcccatgtaattagcaaaacatgcatatttatttgcaaacggtaaacaatttataaattgggatcaacatgctcaaaggggaatgcgtgacttgccttgctccttcaaacaatattctgaactcttttcctcgcgaccgcggacttccgacacgacggaaactacacgctgg

SEQ ID NO: 5064 - DNA, 8663 bp, Oryza sativa
gggaaccggcagacggcggctgcaaggacatggggaatgcaatagtatggttaggaggatgggagaatgcatgagacaacgggaaacaccggccgaaggcgaaggaattagcagagctcaccgacgcgcgaggggagtggagcccagcacctcctcatccttgtggagccgagggaggcaacggcgcgggtcggcgtcgaccgaggtggcggcgcgacgcggctggagtcggcggcgacggcatatggtggaggtggcttgggatgcacggtggaagggtggttgcggtgatgaaatggggaaacggagcggaggccggggtgcggcgaggcacggcgaagccggcagtgcaagcggcgcgacgcagcggtggctagggtggcagctagaggcggccggaggaggcaaaagcagcggcggctcgggctgcacgtggacacggcatcacggcggtggttaggggaaataaagtggatgccggggtggagcttgggacggcgaggctagaggtggtggcggcgcagcgcggcgtcgtctggagcggcgatggcgtgcggctggaagcaaggcggcgagcggtggagctcgggctcgcgcggagagagcaggagaaggcgcgatgggctcgggaaagagggcgaaacggaagaggagagcatggggagggtttatataggctcgggagggtgaaatcgttgccgagaggggtgggatcgggcggcaaccggccagcgacgtgggacgccgacatgggcaaagtggagctcaatttgactccaaaaattgggggaaaagtgggggaaaatgtggaggagttggtggggaaccggtttcactcggtttgggtgcgagggcgcgagcggaagggcgccggatttggcgggacgtgggcggcaaccgccggccatggcggcttcggcctgggaagctgaaggtaggaggagggcctgacaggtggggtcgccgggcccacctgtcggggagggagagagggaggagaacccagggggttatttagactttgcgcgaggggaaggaagatgggtcgacagcccaaggaggaaggaaggaataggggaggggacgggccgaggggagggaaggagggctttgggccggaagtggcccaaagtgaaggaggcgagatttaattgtttttctttttattaaattggttaaatgaactttgtgctatttaaattatttcttgagctccgaaaattcgcgggaaatttcagagagtattttagggcacaaagaatattacaaaatattctcggccaatgatttttttaaaggaaattttaattctctcattatttcacttgattaaattgctttaacatttatttaatttctagaaaatgcattatttaatgatttttaatcccgaacgaaaatcggggccttacagaagttcaagcacagagcgcaacaccatatagttcttgtcgcatcctttcgcttcgtcgtgaagaagttccttcactattttttccagcgcttcctaattgtccaaccctcgtcttctaccagttaggacctctggttcaacatgacgcaacatatgttccagatcaaaatcaatatttgtatcgtctataccagagccaccacattccaggatcgttccctgtgatatgtcttcgattataaattttctgcatcatcaaagcaggaatcttcagcctctttgttatgaccggcgacttccccatgaagagtccatatcttgtaacccttcttaaatcctcgctctacgatgtgcgacaatacatctttcggtatttgcagcaacatttcgttcttgcaatctttgcatgggcctcacagcatgtgcctttgccagcttaacaaatttggctgcttccttcaagaacgtcggatgagctctttttgtgttgtacatccatgcccgatccatgacctagaatatatcttgtcatgaatacatctgtgcccgattcaaaaacgagtgtatttaaatggagggaattaagcaaatagtaaattaaagttttacggacaatttaaacaagcgtacacgatttttaatcattaataaaatattgtccatttctaaacaatgaaaaaattcatccttttatccgaaggaaaataaatttaatggaggcaaacccaacttttcaatttgggtactaaatacttttaagaacatgtaatggaaacattatatattagctaaaaaataaaaaaacacaaaatgcatacactgttccatttaaaaagtggaaatttctacgcattgcaccgatgaaaactgacaaaaatggaagcaaatgaaggaggagaacaagctctacaccttttatacagaacccaatcaaaaattcgagatccttccccctaatttgtgtatgtttaggagagagaaaacgccggaaaaaatgggattgtgtcgggttgagggctatatagcccaacgaccatcgcatgcggtcggcttatgttgcccgcacaggataatgcattatccagtgcggccgacagcccgacgccgatccacggattttactaggcagagccagttcgcctggaaactaccggggccagtgtccaggaaaatcaattctgtagtagaggtagatatattcttgggtttttttttttttgtcaagttcttgttgaatccgagtaggtctcctgcagcctttttgaagtaggtcatggccccccttgtgtgattctttacttagagtagtcttcctgtagatgtacaggttctatatggatatctagcattaccctatgtcacaagggtataccttatttttatacaccaacagtattgtacgaactctcatgtattattatacagttgagtgaacacttatatgcctaaattttatccttttcatatatgtgcatgtatggcatcctagttagcatctatctccccaggattagccatagcttatcatgcatgttgggcttttgtttgcatatggtgcacaagttcatgcaatggaaatctagagactacaacagatgtgggctttctggatggatgccctatgacaaacatgaaatatgccattgatctataatgaattcataaaaaaaatcatcgtaaaattcaccctcggccaattctaatgataactggatatcttgggcataagatatgttcactgtgacaaacatgatcgtcataaccgcaaggattttatcgttagcagttggtaatgaagaatttatgaagaattctaaaatttatgtcacaggtaatcacgcggtaatgaagaacttatgtcgcagataaaaagggcattgcgatgttggcctaagtgtttagactagtgagatttggggcgttacatatatgtcgtggatcctgatcggtacattataatggtggatgataatgcggctgataaatttatttaatacaacaatttctctaaggatattattacagcatagttttcatgggcttgtttcgatctttttttaaaaaaacaaattaccatttgttggtaagacgaaatttggcaattctaaaattttggtaagatcaagatatgaaggatgtgtttagtttgatactagttttatgagtacgagtttctgtaattaccaaatgttgggggggatttgaaatgttgtgatggtgacgtctcgtttagtatattgccttactaaatattggcaatgtgaaaatttgatatggttgaatttagcaacaaactgaacaagccatatattaaaatatttggcaagatgctatgcatggctgcctacatgattaatattgaaggggtccagcaccacaataatgcgtctatgtatattaatgcaaaaataaatatttaacaaataactaaaattaaccatggaaatatatatatttttctcgctcttatctaaattgctaaatattttatttgcatatcaataccaatttttagctataaaaggatcaaatttctctctttttcctctcctaagtaaatgttggaattaaaagttaagccaatctatgtctttttttcctcccctattatttataaaaacatcatatttatactagtaagggatgagtgcacacattcaacaaggatgccctatacaaatgtgatccaaattgtgctctaagttacaaaaacgaagatagctagaaaaccatggctacatagatccttcacatcgaaccatagctagaaaactacataaccaaggtagcaaagtatagatgtaattttggaaaccaaaagccaccaaaagtttcaagttcaaaacattactagtatattttgcttattttagaatagagaatgttcaagcgaaatgaacagctatcagggaaagaagaagaatttatgggtctattttagtaggtgatcagcttaagacgccgcatgcggtatctgatcttcttaggtggtcggtttaaggtgacacctatcgtaatgtatcttcataggcggcaccttaagtaggccacctatggtaatttatcttcagaggtgtctccttagacatatcttcgcagttggcctgctataggatcccccgtccacaactacatagacatgcgtttgttgctggcctgccttagaaaaatagatctcgcggtcaaaaattattttcctattagaggttataactttatgagatccaaacacgtataaaaatctcagtgtatcaaagtcatgccatcacgtatatataatatgcaagcaggatcctacgtataaaaatttccagagttcaggctatgattcaatgccatgtgtgtatcgggttgtgtcaggtgaatgggacatttcgatgtcggcctaaatgtttaggctagcaagatatctaggagttgatcatgattttggtacattgtgatgttggacagggatgtggtgataaatttaatacagctatttcttaagacaattattggagacaatatatctttatgttaaaaaaaatggtaggatgcatggcagcctagctagatgattaatagtgaaggggtccagcaccacaataatgcgtctctacatattaatgcaaaaatatgtacactactaagggattagtgcacaccttttaacaaggattacctaaacaaatattatccaaattgtgctctaagtagcaaaaatgaaaattttttatatgtgtacatacatatgtaacatattttttacggtaaatacatatgtagcatacatagatccatcaaatccaaagcataaaaatgctagaaaactacaaaagcagggtaggaaagtatggatattatctttgacgtcaaaagacactacatattcgagttcaaaaagttcctcctatatattgcttattttataagagagaaagctcaagctaaatgagcagctctcgaggaaagaaaaaggcatcatagatcctttttagcatgcagccagccaccataagccgccgcctacagtaactgatcttcaaaggtgactggtttaaggtgatgcctgcggtaatgtatcttcgtagggagcacctcaattaatccacctacggtaatttatctttagaggcgaaacttcaaatgtatcttcccaggtggcccttgtccacaactacgtagacgggcgtttgcggccgaaaatttgaccagtcatgctgagtaaaatagctcacctagtcgaaaatcatttttctatcggtggttgttactcctcggagatccaaacatgcataaaagtctgtgtctgaaagtcatgtcatcacgtatatatcacgtatacatatatatatgacatgcaagcagaacacggggtatacaatttagtgttgtgatcaaacatatacgaggcactagctagttagatcataaggacgacagaatgtttgcccctactagaatatatgatctcgcctcatcttttatttgcaccatgatactgccggtatagagcatgatctatttttgaaaaaccatgtattcctgtctttctgaacatcccaactgatcaacatgatcgccaatgttaagtccttctgacattctatctcagctaattgagtcatcactatccaccatttgaaaaacatagtgtgtgtatgctaattacctgtttcaggcgttgttagactatacaattgtttttccatactatatatatacactacggttgacaaagacatcccaacaactaaagataaatgacaaagtttttttccacaatcattactctctgtatatggcatcccaacaattgaagataaatgacaaaccaataaaccatttgtttttttccaccaatcattactctctgtatatatatagccttagtccgtatggagcacttgataagcttgtatgctaaatctccttcctcttccaacatgactcttgccaacattcctgagataatggaatctcttcccgtagagacgaggttcacagagtttcccttgcgacaatatggtggattttggttattggaggtcatgctcaatggcgttgctgcagctgaaactagctttcaaccgagaccatccgacatcctcctttcaagctttcctaagtgtggtaccacctggctcaaagccctcgcctttgcaaccctgaaccgttcgacttacccaccatcggatgaacatcacccgctcctcgaacacaacccccatgaccttgttgggtttcttgagatttaccccaagctcgagttgtacgagtcactcccatctccacggctgctctcaacccacctgccatattcgatgctgcctcatcgcatcagggaacaagaaacggggtgtcggctagtctacatctaccgggacccaaaggatgccatggtctccatgtggcaccagaacaagaaggagaagaagaataggttgacgttcgaggagatgttcgacatgttctgtgaaggacggtgtgttgtcggcccgcagtggtgccatgccggtgagtactgggatgagagccaggcgagacctgagaaggtgcttttcctcatgtatgaggatcttctgcaagatactgtgggcaacctaaggacgctggcggagttcatgggctgtgggttctctcgccaggaagaagatgacggtatcgtgcaacaaattgtagaactgtgcagcttgaacaacctgaagaacttgaacgtgaacaagagtggaactacccttctagggatctccaaagatggcttcttcagaaagggaggaaccggtgactggagcaatcacatgtcaccagagatggcagcgaggctggacaagatcgttaaggagaggctggagggttctggacatccaattatttccaggatcaatgcgaaagcaacaacttcgatcggttcatccaaccatggtgcttctgaagccaaatacattaaggagtaacaactcggctggctaattaccgtggctcatggtgctgtggattctgtgaagaccaggatctgattgctttttcattatcatttcagtcctttgtattccttgtgtttcaagtgtaatatgcccttcttttgggagcttctttgcaaaatcaactgtaccctcagttgctacttgctatcagggtttcccaaaccgctggggccagggttaccgtgtcccggcggtaagcacggttaccgcgcggtaatcgtggtaaccgtgaaaaaccgtacaaaaccgtgtaaaatttatcaaaaattcaaattattttttaaatttatttgaatttaaggaggttaccgcggtatttatattaccgtacccccgtggtaagcccggtaaccgcggtaaccgcacgtttaccggcggtaaaggaaaccctgcttgctatcgaataaatgtactgctgaggctgttgcctcagtttatgcttcaagaaaaaaaaaagaagtggaggtgaccggatgagtcaaccggttactgtacttgtgttttatagtactctctccgtttcacaatgtaagactttttagcatttttcatatttatatagatgctaatgaatctatacatacatatagtctagattccttaccatctatatgaatgtgagtaatgctagaaaatcttatattataaaatggtggaagtatgtaataagtgtcggactatagctatttatgtaagaataaattaaaatacctcaaataaaaaaacaattatctcaatgttgctttgttagaatggtttgtactcttgaaaggagactatgagaatgcgaaacttttacgaagtgtacaagaacagtgactacgtaaaaatttcacgttttgagtaacctgttccatcaaatttaaaaactgtttaatcagccttccgagctaaagaactgggggaatatgtggaaaattgctatgggcctatgtgcaatatatatccctatatacatgatgattgataggcaatccacaaagcctatcaatcatcagtgcaaatatatcatggtttaaatcaatagtttttcattttaaaatatatcatggtattaattgttagacacgacgtgaccatttgtcaacttaaaaaaattagtgcaaacttgtgcttaacccatcttcaatgataaaacaagtccaaacaaaataactgacacttatattgttttcttaaaagaaacaaatggttaacgtcgttaaacttcattaattactttaaaagcgtagtcattcttcttcactacctttagggatggcaatttcccccgcagggcc

SEQ ID NO: 5065 - DNA, 1358 bp, Oryza sativa
  unsure (1)..(1358): unsure at all n locations
tgcagcatggcaagattttgttaagaagaaaataaatggtgcgtggaaagctgaatgcaaatggtgtcacaacaagcttggagctgaaagtagaaatgggactaaacatttgttagaccatattaaaacttgcaagtctaggcaggctagaaaagtctaacacaatccaatttgaagatgggaatagatgcagaagggagggttaccgtaggaaatatgtctttgatcaagaggttgctagaaagaacttgcactgatgatatgcctcatgagtacccactttctattgtagaccatgttggttttcgtaggttctgtggtgcattgcaacctttgttcaaggttatgaccagaaacacaattaggaaggatattattgacttgtttggggttaacaagatttctatcagtaattattttcacaagcttcagagccgtgtggccattactactgatttatggacagcaactcatcaaaagaaaggatacatgttgaggagggtgttggaacttcagatggagttaatgcttcttcaagtgttgcccctccagggggatttgatttggtggatgatatatttgatcagtatatgtctggacaaactgttgcctcttcctcacagattcgcactgagttagatttgtatttagaagagaaaccgttgcctaggacacaagattttgatattatcaattggtggaagtttgggggcattaggtacccaactttgagacagattgcccgggacattttggcaatccctattacaacagtagcatctgaatcagcatttagtactggttggagggtgataactccaaatcgtaatcagcttaaacctaatcttgtggaggcacttatgtgtgtgcaagcatggggtcgtgctgatatgttaggtaatttcatttttgcttttgtatcgttcaagtttaatttgtcctttcatgtttcttccatttcatctaattgcaaatcacattatatgttgatagctgaaattgctaacaagaccaatgcattgaacacggtacttgacgatgaatcagaatcggtatgtcctacactcccactttattgtttttattactataatatacaatgcttagttgcttcctctaattttgatttcaggaagcatctactgtcactgaagcttgaggtggagatttcataagtgaaggatgggctagaaagcctgcaattgcaaactatctacctatatattttattatgttggcaatgtaatagtatattaagacttctatatttctgtgagactgaatttgcttgctgtgtgtgatgtgttgaacaattcaactgttgaactttgaaggcttgattcgcttgancgggctgc

SEQ ID NO: 5066 - DNA, 7308 bp, Oryza sativa
tgagacgcttttataaatcgtcgtaggaacgtctccgtttgcaccgtctcaaaattatggaaacgctttttaaagcgcacctatattatttaagacgttgctagagacatgtaaattgcatctctataaaatatagagatgcttttatagaagcattaatataggcacgcacatcaagcattaatatttgcagattgcaaagttcatgcactaaccaagtcattaacgtgaacaatcttaaaggtaaatagatagttttttttatattgcaactctgcaaacatgcgtcctatagcagatactcttcttttttaatctgagactgaatattaaatattcatttttttttctaaataattataatattattataatggtatttaatgatgacgattaggaacagtgtgtttttttcttctttctctatataaataattatatattatctaataacgatgacacggatataataaaaacgtctcaaaactcatttctacacatgagacgttccaaaacgtctcaatattcctctctaaacgatttagttttgtgctaacctgtaaagcgtcttaaactatgtcctcaactaataaagcgtctcaaatatcgtccctattttaatttttcttataaaaaagagacgacttataaaatgacttaagtgaaacgtcttaaaacaatagttttgttgtagcgcgcgtgctctgcttcttcttgtatacggaaccactataggatccagtaatttattcttaatccgttcatcaagtcaatctcctacataggctgctatgttgcaaagcaaaagcatatactagtatattttaaaaagcgatttcatggacagacgatttggcatgcattatataactactctgagtacagccaggccagtgtttgtcacatggctgatggctcagatatacttttatgtcatggacgttgctggtttgagcaagtcggatgattaatttgatcgatccgacggcagtatgcatatgatgatgtgataagccaactaccacagagaattattagtgaagagtttttcactagtgactcagtggtattattggcccagttcctactgtataagcgaggatttattcgaggaaagagggaccctatatcataccattacccaccagttatcatcgccatctctagctctctcacacgttcgaccacagtctcgtcaccaccatctcccttacacgcaccattttcttcatgatcaccaccatctcacatctttatctattataaaaattaaagatatttttgcctatttttcatacgtcatctcagtccgattccctccccgtatgcgcccgattactcctagatcacccgtataaaaaacatgcaaggattacgtattttctttcttaaagcttttcatccgtcatcgatctcttgcgtaatcaaattcgctaattggctttcaatagagccttcgcccgccgcttgtgccatcatgcacagcataaggcagtccaaatcgatcatgtatttcataatgtaacacagcctaatctctgtccccacggaatgccccagtctttcctcagaccaactttgtcacgtattaatccatccacagccagcataagccgccgcctacgataactgatcttcataggtggctggtttaagatgggactggataaaaactcgtggcttgttagctcgctcggctcgtgtctatctcgactcgacttggctcgccgaaccagagttttagctcgttagctataacgagccagctcgagatggctcgcgagccgctcacgagccatgaaaacatcagaccgagcagccccggatgacacctatccaaaccatgtaagcccaactaggccacggtagtacagtgcacatcctatattcaggtaataaaggcgacagttgcggctcggcaacagaaaaaagaagagaaaaaagaaaaaagaaaaggagagaagaaacggtgagactccctcgatcccttctctgatgtcgccattcgccgccctgcgcccctgccgctcgcgctatccgctgtctgccgtcgctccctgctgttccccactgtcggagcaaaggagatccggtggccatcaacctgaggctgccggatctggcgccgttgacctcatggctaaccactggatttggtgttccatccgtgacaaagggacggtggtggccatgaggagaatttgttggccaacgaggagggagacgctggctggcggtgatgtaggcggcaacaccgtggcgcggtaggaggtgatgccagctcgttatcctaagccggctcggtatccaccctagtttaaggtgatgccggctctaatgcatcttcgttgggagcacctttattaagccacctgtggtaattttatatcagaggcgaaacctcaaatgtatcttcgcatggtggcctgctatcaaatcccttgtccacaaattacgtagacgggtgtttgcgccgaaattttggcctgccttaataaaatagctcgcgtagtcgaaactcatgtaacacacactggtggagaaaccatctttcgtcggtcggccgatttccacaatagtcccggatgcaataaaaaccggtgctaaagatgatctttagtcccagttcaaaagggtaacgggcatatttgatctttagtcccggttggtaataccaaccgggactaaatatcatctttagtcccggttcgaatgctgtcagggcatgtcgggccccccgggatctttagtcccggttggtcgtaactttagtcccggttggtattaccaaccggggctaaagatcctggtgatctttagccccggttggtgctaccaatcgggactaaagtcccacccctatatatatgtcttcttcctcctccagctgcccgagcaagcttcaaaatttcttcaaaaaagaggggaggtcatgccaaaatttttattgaatttattttgatgattacatacaaatcggaggtgcctaaaaggtttgcaacttcatcgtccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattataattattgtatgactgtcattattgtaagaataattatttgtgtacggtttttttttactcatgtagatggatcggcaatggatgtacactgaccggcggtccaaagagtttattgacggcatgcactattttttgagagtggccgaagctaacaggcaaaggggttttatttgttgtccatgcaataagtgtaagaatcagaaggagtattctgcatccaggactattcatttccactttattgagtcggggttcatgccaagctataattgttggacatcccacggagagcaaggtgttaaaatggaagaagatgaagtggaagacgacaatattccggactttgctcagtatgttggatttgaagaaaatcaaacgggtgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatagggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgatcgattgtatcctatatcgcggtgaggagtatgagaacctagaagcatgccctgtatgcaaagcactacgatacaagattagacgagatgatccaggagaagttgacgggcagctaacaaagaagagaattcctgctaaggtgatgtggtatttccctataataccacggctaaggtgtttgttcaggaacaaggggaatgctagaatgttgcgatggcacgctgaagagcgtcaacaggacgggatgctgagacaccccgccgattgttcgtagtggcgaaacatcgacagaaaatttaaagaatttggaaaggacgcacaaaacatacggtttggtttgagtacggatggcatggatccttttggagagatgagcagcggccatagcatttggcccgttacgatgtgtatctataacctccccccctggctatgcatgaagaggaagtacataataatgccgattattattcaaggcccccaagcaccctggtaacgacatcgatatgtacctaagaccactggtcgaagatcttaaacagttgtggaagaaagaaggtgtccccgtgtgggacgaggacaaacaggaggagtttaacctacgagcgctgctgttcgtaaccatcaacgattggcctgcacttagcaacctatccggatagtccaacaaggggtacaaggcttgcactcactgtatggatgaaacataaagtacgtatcttaagcactgtaggaaggttgtatacatgggtcatcgtcgattccttgcagcaaactacctggtacggaagaaaggcaagcacttcgaacataaggccgaccaccgtacaaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccatattgggaattcttggacgtacgccacgcaatcgacatgatgcacctcactaagaacctttgcgtaaaccttcttggcttcctaggtgtatacggaaagttgaaagatacactggaagcacgtaatgatctgaagcatatggaacaacgcggcgaccttcacccggaaccaaaggagaaaggaagccattacttgagtccagccagctacactcttagcaaggcagagaagaaagtatgtttgaatgcttggagagtataaaggtaccgtctggatattccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatatattagaagcccttcagaataaagtggtgcaatgtctcgtcagttttgagttgatatttccaccttcatttttcaatataatgacgcatctgctttatcaccttgtgaaagagatccgtattctcgggcatgtgtacctacacaacatgtttcctttcgagaggtacatgggcgttctgaagaagtatgtttgtaaccgtgctcgtccagaggcaagcatcgccaagggttatggaacagaggaggtcatcgaattttgcatagaatttatcgaagaccttcgcccaatcggggtacgtgaatcacgccatgaagggagactacggggaaagggaactctcggaagaaaagcaataatgacggtagacaacaatttattccgtaaagcccatttcactgttctgcaacactcttcattggtagctccttacatcgaggagcacttggctcaatgggtacacattctacacgagagcccaagacatgaagagcacgaaccaaaacagcgttgttcgtgtcgatgccatgggacacgatggaacaactggcacgtattacgatgccatcgaggatatatgggaacttgactatggtcctctcaaggttcctctgttctagtgccaatgggttaggttgactggtggaggcgtaatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctaatgagcctaagcgtcaagtggttatcccaggcaaaagaaaaatcatcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtatgtgcggtcaaccgtcaccgccgatgtaatgccgtaattattgtgtacacgatataaactattttggatgtattgattatccatataaatcaattgatgtatggcataatttactatcattcatatgctacatttaattgaatatcattcatatgctaattataattaactagagaatttttaaaagtattaaatcattcatgtggcatttacagatgttaattagagtttttcacaatttaatttactatctttcataggctacttatatatgactattcgaatttttaaaaggtttaaatcatgcatgtggcatttacatatgttaattagagtttttaacatttaatttaatataattcctacgctaagtatatatgatgattacaatttttattaattttaaatcatgcagtatgtacatacaaatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtaatttaaataatgttaatgcattaacttctattttagaaacacatatgtaagcgaaaataatatgcagtgctataatctttagtgccggttcttaaccctaaccgggtttaaaaagaatttagaaatagtgggaaaatatctttagtcccggttgatgattactcccggttgttctcatca

SEQ ID NO: 5067 - DNA, 5102 bp, Oryza sativa
  unsure (1)..(5102): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgaatagtgccagggaggcaaactagactttcggctgggcttctacttccaaggactgattaaaggagggaaataaagcagacttcgggaaagagaggaaaagggctgcaggctgagaggagactgggccgagagtgagaggacttttcctaattcggcccgaaaaggaaaaggtgaactttaattacttttccaattaaattaatcactgaaatgatctttgaattgttaaaaatacttccaatgctcaaataatttcaagaaaaatcttgaaaatacttggacactcaaagtacttaacaaaattataatcagaccatttaatgattaatttaatatttaaacaattgctgaactgctctttgtatgattaaaattaacaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctaataataatttattaaataatctataaatcctgaaacaaaaatcaggatgtgacaacgatgacgtcagcgatgacgtcaccaccggcggcggcggctcggcggctcggacgcgcatgctcgcctgcgaacggcggcacttcggcacgaacggagggcaccaacgggtagagcgcgacgcggcgaactcaccgatgaccaaaggagcggcggaagaccaacggacggcgacggcgacgaggttgaaacggcggagctcttcggcttgacgacggcgacggtgctccggcggtcttcggcgacggcgaaggggcggacgaggacggcggcgacttggcgaccacgacggtggtcttcccgagcgacggcgatgaccggaacggcggcggcgcacggctggagcgacggcggcgacggcggctcgaggctactcggcgctagggcgctacggacgacgagaggcgaaggcgagggtagcggcgggtagagaagagctcgggggtccttttaaaggggttggagggcgacggcgaaggcccacggcggccggcgacgagaagaaaaggtcgggctcggagagagaaaagccgatccgattcgacctcgaatcaaacgctttccaagccgatttagccgatgtttccaaaagggaaaaggtagaggagatcccgaggatcatttcccctctatcaattcggccggagaaggaaaggagcggccggatttggaaggagacggcggcggcgcagcgctagggtttcgggaggcggccgacgcgaggaagacgacgacctgacaggcgggggcgcgcgcgcgtggccggctgcggactggactgggccgacttgggccgaggagagagagaacggtttttgggccgactttcggcccagagccaaaagagactctttaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatattttgaatttttcagggtgtgatatgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttcttagtctggtgctccgcaatgaatcatgctatacaaaaggtaaagccgttgcccacgctggcttgtggttggcacggttaatgtttcacaatagtagctcgtgaaccggtccttaattgtcatgagcacgactctcaaagccatgtgctcacaacccaccattatcaagttttagttggcaagtaattaattaaccaatcacgattgaccatcgtaaactatcattaagccatcattaaataataataagtcataagttatcccaatagtgtgctaatgtttctaagcatggctaagcaattacatctaatatctagctgaaccaatgtataaagctcaactagtctagttataataacccaaggtatcaaggaataaagtaatcaatgcaaacaggccataacaaaggaatagattcacaccacccagtgacattcgaaaataaatgcacagttgaaataaatagagaatttaaatataggatcaaaatgctcaaaggattgtgtttaggatctgtgtgacttgacttgcaatattcggtctacaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattacgaattttacaagattaaatctaattaaagcccatttaaaaagaattaaataaatttaattcaatttatggataattttaatatgtagatctttattttacacaacttttgcaacttgaaccacattaaactgagttacaatgaattagttatgaatttttaaagattaaaccggattaaagcatttatatggattttaattgaattattacgcaataatgaactatttttcaaaaggaaaaggaggattattgcgtcatcaaaggcagtccgggtgcacgggacggtctaaggaaacaaacggccgagatcgatcctatccaaaacggacggccgagatcaacttgatctaccgcggttcacgggacaaggcgacgatgacgtcagcggtgacgtcagcgatgacgtcatcaccgacgacggctcggcctcgcacgctcgccggcgaacgacagcgcgacgacgcaaacggaggacaccaacgggtagaggacaacacggcgaactcaccggtgaccaaaaccacggcggaagagcaacggacggcgccggccatgaggaagaagcggcggcggtcttcgggtcgacggtgacggcggtgctccggcggtcttcggcggcggcgaagcggtggacggggacggcgacgacctcgcgatcccgatggtggcgacggcgaccgacgacggcggctgcaacggcggcgcggcgcggctgaaccgacggcaacgacagcgacggctagggctacgcggaggcggcgctagacgcgacggcgggctaagacaaaggtggcggcggatagaggagagctcgggggtgcttttaaaggggctagcgagcggcgacggaggcccacggcgaccggcggcgagatggaaagctagggttggagggagaaaagtcgatccgaatcgagctcaaatccgtcgatttccaaacgaaattgaccgaagtttctataagagaaaaggaagaggagatcgaggagattatttcccctcaaacgatttcaccggaaacggaaaggatcgaccggattggaaagcggcggcggctagggtttcggccggcagcggcgcgaggaggaagacgggcctgacaggtagggcccacctctcagcggctgagagagaggaggaaggggcgcggcggactggcggactgggccggggagggagagagaaagagagaggggttttgggccggctttcggcccaaagccaaaaggaggatttaaaaacatttttctatttaaattattcatgaaatgcaattccatttattaaaaatactttcttggctcaaataaatcccagaaaaatctaggaactaaagattcaagagaagtatttaacaaaattttatctagcccaattttatattgagatttagcaaattaaaattagatcttctcttttaggcttttaagatcatttctaataattccttttaaacaacaatttataatttaaggatttttaaacaagaaaagctcttaacacttataattagatcattaattgattaactaattactgaactgttctttgtatcatttaggaattgagctccgaaaaatccgagaaaatttcagagagtagacttaatcatggagaatttaataaaaattaaatccatccatgctttatatttaggaaattttatttcctgtcacaccctgaaaattcaaaatatataaattgttgtttaaatggaatttttagaaataattttaaaagcctagaagagaagatctaattttaattaataaattccaatataaaatggggccagataaaatttcattaaatactttgcttaattctataattcctagatttttctgggatttatttgagctaaggaagtatttttaatgaatggaattgcatttaagaaataatttaaattgaaaaagtttttttttaaaaaaaaaaattttggggaaaaaaaaaaaaaaaaaagggggggggctttttttttttttttaaaaaaaaaaaaaaaaaaaaaa

SEQ ID NO: 5068 - DNA, 1373 bp, Oryza sativa
atggtcgtgctcatgacaattaaggaccggttcacgagtttgggttgtgaaacattaaccgtgccaaccacaagccagcgtgggcagcggctttatcttttgtatagcatggttcattgcagagcactagactgagaagtggcggagataagcccacgggggtcgctggggagtccatgccttgtttttaagggggtgattatgatccaggaaggtgcgctgcggtggattgtgttatacaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttgattagctcctggtttggaatggtacaatcctggtttggagatagaactgtgtagccgggatggttgttcagaatggttgggcctatacaatagggtatgttgtatagcgttggattaatattgtttaatacttaactgctttattaaattctcaaatgtttgttaaatgctgcttttgcaaatgcaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacatttcccacatttaacttcacttgtaaattaatgaacatttaatataaattctaataataatttattaaataatttataaatcctgaaacaaaaatcaggatgtgacagattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgttctaagtctaattacaaatcgtgatataagctaagtctaggtgacgtatattatacaaccctagctagtaaataattat

SEQ ID NO: 5069 - DNA, 1129 bp, Oryza sativa
ccatctggtgatacaagaaacatctgctttgtcacgagacatttatgttttaacaatctaagtcatgtatgcttagtgtgaatgtcgttcattagaaccctacacatccttacgttctaagtctaatttcaaatcgtgatattagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactccaatagtcaattgctaggagtcgcaccaattccgtagtcaataattacatactaattctaattacaaataaagtaatcttatattaaaactcaaataatattacatgctaagactgaaagagtcatgtatgctaagtgtaactgtcgtatatgctaagtctaattaagactaaaattgtcaattgctaggagtcgcaccaattccgtagtcaataattatatactaagtctaattacaaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactacacaatcttatatgctaagtctaattacaagtctaatattcttaattgcattacaaatataacaatcatttatattattacttcacttgcctgcacgaattccttctagggctagctcttccactccggcttgagggacgactccgacaacacgtcttttctgcaagatacaaaaaatatgtattaggataaatgcgaagtaacatatatatattgcatttcacgttcacgttcgttcgctcgttctcattcacgttcgttctcgttcacgttcgttgtcgttctcgttcacgttaattcgttcgatcgttctcgttctcactctcgttctttcgatcgttctcgttctcgttc

SEQ ID NO: 5070 - DNA, 790 bp, Oryza sativa
aagtgcccgggataccaaagattggcatagtagggttccttttgcataacaacatttaccaacatttgagaaattgataaccagttaagtattaattaaccagtattaatcaacggctacacaacataccctgttgcataggcccaaccattttgaacaaccatcccggttgcacagttctatctccaaaccaggaatataccattccaaaccaggagctaatcaaattattaccagttataacatcttttattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcatggactccccagcgacccctgtgggcttaactccgccacttctcagtctggtgccccgcaataaaccatgctatacaaaaggtaaagccgttgcccacgctggcttgtggttggcacggttaatgtttcacaaccgaaactcgtgaaccggtccttaattgtcatgagcacgactcttaaaaccacgtgctcacaacccaccattatcaggttttaattggcacattaattaattaaccaatcacgattgaccatcgggagctatcattaaccatcatta

SEQ ID NO: 5071 - DNA, 2672 bp, Oryza sativa
gctatttttcttccctcgcggaagcatcggtaaaaaaaattactaacagattacttcacccaaccaatcttcatttggtaaataaattattggcttttagtcatgttagatcttttcagtaaatcagttactcacgaatatatcactagattaatttcttattattagtagattagttccttattattagtaatgatattagtagataagttccttattattagtaatgattttttagttattttcagtagctcgatgccttatttgtggtagtagtatttttactgccaagtgatttttatttttaatgctatgtatcaatctattagtatttttatcatgaacgcttattaacgcatagtaaatgttttacttgatgacaatatatgagaagagtttttttttcaaattatatatcctacacaacatgaatacaatattacggtgttggctggttccttaccaataaaaattacagatgggaaatagacatacacatattcattttgataaaaaaaatcaagaagattgtaaccaatgactactccctccgtcgcaatatgttacaatctaggatgagattaaaccaatactagaactacaaatctggaagaggttgctacatattgagatgaagcgagtacatcccaactcgccaaataccatcgccggtgccgaagactcacggtcgacgtcaaaatcccactgccagctacatccatggtggagtcggtagcatcggcatgctccaccgaggatccaaccttcaccctggaacccgccaacatatgagagaacatgatgatgataattcagatgagagcagatttctcagaatactgcacacacaaatttgcaaatgacatatttctaattgacatttagagcatgatttgtctataaaccccataattttcataacatttcagagcttttgacacaactgtaagtatcaaattgtccagccgaccaaactaaaatttatgagaagggcatgtacttgcaaactgagagaacatgacactcagaactctgaatataatttctctgaacgaaaattctcccatctttcattcagcaataaccactgcaaatcaacaggtgagttgagagcagccactggacggattaaaaaattatcacttctgcacatgtctgtgtgaacaaaaaaaattcagagaactgtattgcctatcaagtaatactcttccaagctaggaaatttcagaagctaatagcctaataaaatatcaactagaaaatctaagaatctactagcacatcaaatagaaaatttcagaaactattggcttatcaattaaatgttgtccgaagacttatgagccgatagcccaaaagccaagcactaatcatattccccataccagtcatgccagaatcaaatctctaaactaggaaaagctgaaattgtttgtactgctagaacaagtatgccacctggaggttttatgaagcaactctttggtgctgttatttggaaccagaacaaaaggcatgcatcaaattagtgctttattagtagccatcaaattagtgtaggtggggactgaaccaacagatttttatggtggagatcaatacatagtcatctgttaaaatatgaacatctctaaattgacagataatcctaaaatatagttcacctttaatatgagttattgagaggattgatttcatcctaaaatacagttcaccttcaacctgagttattgagaggattgatgttatcattaatccgagcagcatctttgaaattaacaggagctggactgctggctactacttactgagttactggtaactaccatcatttgcaaaaccactggtattagcatttaatttgatgaagaagccatcagagaggagctctgttaattaccttaaatgctacatttagacttgctgatgttcttgatcttgacagcactccagatcgacttgcttcccaggctcatctgtacctatcagtagagagcaaagtcagagacaagcaaggactatgtactgtatccatcaatcgtgctgattcaatctattccgtttgcgagcaacataataatcatatgcaattcgtttcgtttttattgtttccagttttgcaggtttttgagaaagccaattttcttcgtggagacagaagaacgagtgcacaaagcgaagaccattcttaaccaggaatcagtatgcgaagagaaacaaggacagagccttggactattctgagccaagcaaatcaatcaagaacaattgcaatcgcgcagcaaagcgaactccaattaatccaaccaaaactgaaaaggattccaaaggaggagtagtctctagacagagcaacccgccatgagaggggaaaaaccagagcaagaagacaggaaagcagcagcagcagcaacagcgggcggggagcagcgaccggatcaccgcggcgccgctgccggatgacgtgccggccccatccccttcttgttcttcgtccaccggcgcgggaaggcagagaagacggccccgccaccgacatcccgactcgccgcctggctctcctggagacgcgcttcgacgacgggaatgttgaggagaggagggaagagggcggcgacggcaggagctagggttttgctcccgagccgcccaccgctgccgcaggccgttgc

SEQ ID NO: 5072 - DNA, 1338 bp, Oryza sativa
gggtagggatgaaaaaggagcggatacggacggataatgctcataccatattcgttttcatattttttatcggatacgaaacgaatacggatagctcgaatatggaaacaaatacggattatcttgaatacgaataagaatcgaatatgatcggacacgaatacggaaacaaatttttctcggaacacgaaaaccaactcaacttctaatagaaataaatatcaacatatataattagctcattttatataaaatgaggtataatttataaatattttttaaaatttaaataatattaatagtatggactaatgttaagagataaactactattaaaatctataaaggtatattgaaggttatagagttagaaagaaatggggtatgtctcatgggtcctgcggatatccgaataacactgttcaccggatatccgaattattatccgtatccgacggaaaccctgataccatattcgtattcgtatccgggagaaaatattcgtattcgtatccgtatatgaaatatccgagaattatccgatccgaaaggtatccgtatccgtttttatccggagcggatggaaactatccgctccgttttcatccctaggtgggggtagggtgtgagggggagtgttttagttattactcacaattggattattatgtctatatatatatatatatatatatatatatatatatatatataggaattggattatttgcacccgagtgcacatgcactcgcaatctacaccctcaattcccctgcacgaatcttgggactgatgataataggatgtaccatgcctgctttcctccctttaggcgctgcggaattgctgatggatggtgactttgtaccgtgtctttcccaaaatgcccttcatccactgaccccttcatctccatggggaaattgtggagtgtggacgcccctgttcttcaatcatctctctacccctctccagttctcaaatgcccttctgctcccgatcccccacggtcggacgaacccggtgagaaagtagaaggaaccagccgaggtcaacgtcgacgggagcctcgtcgccggatcaggcagccactttcatggccgctgcaccagttgtcgctctgcaatggcttcatagacatggggctcggctcctaggacctgcgggattggcggctggcgcggttgagctcccaagccagaagggaggaggagcaggctggcgtttttaccatgtagcactggcacggcaagcagcgaggtggctgcgatggtgagggcacgcgtcgaggcggccatgaggtgaggcatgtggtggccgcgttcctactttctgcg

SEQ ID NO: 5073 - DNA, 867 bp, Oryza sativa
ccgagctaagatgaattagttatgaatttttaaagattaaatcggattaaaacacttatatggattttaattgaattatgacgcaataatgaattatttttgaaaaggaaaaagggatttattgcgtcagcggctagggttttcggtggaccgggcgcatggcgacggttcacggaaacgaacggctgagatcgatccatccaaaacggacggccgagatcgatcgggtctacagcggctcacggcagacggccccgatgacatcggcgatgacgtcaccaccggcggcggctcgggcggcgcaaactcgccggcgaacaacggcgcttcggcatgaacggaggacaccaggacgtagagggcgacgcggcgaactcaccggtgaccaaaacgtcggcggaagagcaacggacggcgacggcgacgaagaagaagcggcggcgaccttcggcttgacgacggcgacggtgctccggcggtcttcggcagcggcgaaggggcggacgaggacggcgacgacttggcgaccacaatggcgacctccccgagcgacgacgatgaccggaacggcggtggcgcacggctggagcgacggtgacgacggcggctcaaggttgcacggcgttagggcgcttccgacggcgagagacgaaagcaagggtggcggcgggtagaggagacaccgggggtccttttataggggcaagaggcggcggcgagggcccacggcgaccggcgacgagaaggaaagttagggctcggagagagagagaccaatccgaatcgacctcgaatccaacactttccaaacgattttagccggggattccaaaagagaaaaggtagaggagatcccgaagatcattt

SEQ ID NO: 5074 - DNA, 15908 bp, Oryza sativa
  unsure (1)..(15908): unsure at all n locations
ctgcgtgacttgctgagtatgtcatatactcaccttgcaatcattcatcagagaaagagttctacagaaatgctgatggtgtgaaggattatgcgtagccctggtcaagttgcctgtggagtggagtcgtctgcgccgtttatcttattttccgctgcttagatctttattgattgagaggaactatctacctctgtaatgacattttattcgcttattaattagagtaataatggtactctattatctttgttattgtgtgcctcggctgattcctggacgagggtttacacacatgtaagcgtttggaattttggatagaaattccgggcgtgacatgtacccacaagacacagccccacgacacgtttctgtgcaccgacatgccaccacgacataccggatagagaccgtgacaggacccttcgcataaccccctctaaccaagcacaccacaccacaggtttcacccccacccctcgcaaggcagcgggcagtcccctctcgtgcctaggtgaatccggaagccacataggccgtcgcaaggcccatccaaactccatcacgcccacccttgcctagatgcgtcaactagaggaaagctacactacaagcccagtcgttgcccacgctggcttgtggtaagtacgataagttcttccagggcatcccgcgaaccggtccttaaatgccatgggcacgaccatcaaaaccatgcacccatagctcaccatttagttaattttaattaaccaacaccggagcggtggtattaaccaacatcattactagaatctgatatctatgtattaatgtatttcccccattgtgtgctagttgaactaagcatggctaagcaatccctaatccaatctatagtcatgttatacccaaagctaacaaaggagcatggtacaaaaattagtgtggctgtaacagtaggtaaacatcccatagtaacattataaaacgatgcagtatttaaaagaaaacgatagagcatttgtaatataggatcaacatgttcaagtgacaagcatgacttaccttgctctgctgctggaggaacctccgcgattatttcaaagtacaccggagcggtgggagagcccgaatctaagcgacatacaaagaaaacaatacaaacaggccataagactactgaaacagagaacaaaaccatttttaatggattctatacatttttcttgatttactgagacttgaatgggcttaaacggaaacatccttaattgatttattgcgtaataaataaataccgggagagggaggggcggcgccgacatgcgggccccacaaggcagtgactcgggagggcggtccatggtggaccgggtccacggaccggggaggagcggcgcaccacgttgtgcacacgtggcgctgacgcggcgcacacgtggcggacacgtggcagccacgcgggcggcggggttggacggccccgatataccgcccggtagatcggacggcggaggcggctcgtggccgggcgcgcacgggcacggctcaagctgacccagcggccgtggcgcgctgcggcgcagcgcgccgcgacggcgatgcaagcgggcgaccggccggcggcggagggcggcggcgtcacggcgacacggacggcgacagtggcggctaggcggctaggccgcggcgcggcggctaatcggcgcgggagagagggaggaaggggaggaggggtctcaccgacgttgactgacgacggcgagcgacggagggcgatggcgacggcgagacgggctccggaaccacctaggggatcaaaagggatgagttagagagggaggggaaacaatggatggctagggcagcgaccgaaggcgcctgccatggcgaagctcatcggcgcgcggcgtggatgggactccggcggcggattgctacggaggaggggtggacgggacgacccgcacgacggtgaacgcgacgacgtcgacggcgcggctcggcacggtggctagcggctgcgaccggagcggcggcggcgggcggcggagagaaggacgacggcgctagggcggtggagtgcacgggagcgggcgattgcaaaatgaaaaagagagagaggagggaacgggggtgctttatttagacccacgagggtcgatcgtggtcatggagaccgcgatttcgccggtggagtgtggagaggtggggaggagagagaggcgggattcaaaaattgaatcccggccgtctcgagcgcgggcgcggccggaaaagaggggaaagtgggcgcgggaacgcgggcacgagggttacgtgggcgacgtggcccgggacacgcaggagcggggcgcggcgacggttgctgggcgcggcggcgccagctggaggaggcagacgggcccgacaggagggccccacctgtcggcgacccggggaaagaggagggggctcgggcggctggctagcccgtggcctgcggccggcccaacggggagggggagggggagagaatgggccagcggcccattcgaaaagaaaaaggagggaaaaagaaaagaaaaagaaagaattgaatttctagggattaaataatgcttgtgctcatttttagttggttaaaattatttctagggctctgaaaattccactaaaaatcttgttagcatatttcgacatgtagaactcaagaaaaattccacatgccaatcccgattattatttgcattaatttattagggtttctctcttgcttttacaccgatatttcctctaggtaatttataaattcaatttaggcttgggaaagaacttcagggtgtgacaccgagttccttacgacaatccgtcttgaccatccaaccggggctaaatatggaggagtaccctccccaggaaattaacttaggactatatacacacgcggaggaatacccgtactgagctgtcaccatcaacggcctacctcgcttccgtagcatataaccctaaataaagatatccagtaatctaaacaccacgcataaatcaccaaatactactctaatatcatcatcatgatatagagtcatcgtaaatatgattagtatgcccacaccattgcatctcccagataagctatcatcataatgaatataacatggatatataataaagttggtattcatactcggaaagtagttctataccaaagtagtataaagaagaatattctaaataaagtacaagtcttacaaaagaaggaaaagctactagagccatacccgaattcttccgaagactccgacgactgaaaactctattctatttctattccactataccctagagactatactaagcatgaggatgtatgaaacttcttgcttgaggtgtgtggaagaagtgatgagaagagttccctaaatagactgccaatgacggttgtggagttggaatggttggaattgccctccaaccatcattgggaagtgatccacactgtccagggagggttcgactgaaccatgggccggctcaatccagcctatcatcggctggtgacctcctctcttgatatattttgcaggcttgtgaattttggcccaattgtccattcattgataagtttgattctcgacatcgtccaattgatcgatcacctgttttgatgtcgtttctccttcattttatgtacattctctgcaaaaggttagaatcctagtgctagtggaatatttattatttaaacataaatatgcatttcaagcataactagttcttttttatttaggtaatattgacaggcaaaactggtcgctaatgaccgtcaacagcaagcgtagcctatgagggagggaggcgcggtgtattgcaaggctaggagggagggcgctaccaggccacaacacgtctcttccgcttcgtttctcctttttttcgcgaatcttgcgctactctcgactccacaacccaaccacgacgcgacacatctccttctctctaattctccctccgtgcagcgcagaccacagaggcgcaggtactttaccaccgagtggcaggcgcttggctggctggccgccggcacgccgggccagcctctgatcactgacacctcacgcttcttctcgtctcatgccggcggccagcctctgatcactgacacctcacgcctcttctcgtctccactccccagtacctttagctctaagccctaggaaaactgaggtgtttttttgttcttgtgttatttctttaatttttttctaagaaatttaggttcgcagcaggcggtgacgggaggagaggcggcagcggcgggcggccctctgctagatccggtgggaggggaggcagtggcagcggcggcggcccacgggcgacgtcggcgggctcacgtcttccagatccagcaacctctccgaccgcctctcctcctatcgcctacctcctccttcatccggtgagcagcggtggtcaacgctctgctgctttcaccctgccgattctctgatttggattggtttttaagatatctgatttaatgatgtgaagcactccatgaatttttgatcgtgtgatccaagaattgttgattgtgtgatggctgctgatatgcagttgtctttttggtagatttttggatgtttatatcggctcggctcaaatcgtatacgtcaattgctggcacctttgagtgttcttactagtgccgtcttcgtggtgccagttgggaaaaccgacatctttgtggtattcctaacaagcaccagtaaccctatctgggatagtgtattatgccaatttttgtttcgttggctcacaaaagtttattagatgttccatatcggctagaagtttaaataaaatacgtcagagaatctaccacgtctaataaactgaacccttattagagcggggcagctcaaattttaacattgacggtagaaacagtcagtaaaatgtagttcaatttttaagatgggactttacttttcagtgagattcgaataaacctgacggtgttaataacgtcaggaaaattcactgtgacggtcaaacctgtcagcactatttttcctgaagaatacacgtcaggcaaattaaaaatttcccaacaagccagttcggacagaattttcctgacagtttcacgtcaggagggttttggttgtcagggctagttgagtttttggcagtgttatacgcgtgattgcggaacatgaaagttcacacgtacaactcacagctatgcatttttgcatgtactatacctccaagtagattcatagtattggatatacctccaagtaaattcatagactggatatacctccaaatagattcatagtactggatatagtactggatagtctatttttatccatgttttaccattagacttatttaaaatgttttgtaaatataaaataaataatagctacataaacttttaataacatcgttgattttttatccatattttgccattagtcttatttaaaatattttgtaaatataaaataaataatataaatttctaataagacgaatgatcagttttataatacaatggtgtcatgcatcatgcattacaaaatgaatagagttagacggtgatcaaacataaaaaaaatcaatgattcatgcattagaaaacgaacgtcatgcattagaaaacgaatgggcggaaaaaaaagaacagaaaagagaggattgagcactccatcataaaagaacaacctaaagagcatgtgcaaatttacccctggttttttctaatttagctaaacataccactcgaatgacagtttggttgtaattttctagtggcagtactgtaataacgatcgtagaaaattataatcaagattcaaagcagtagaaaatttataattacccaaaaagagggggaatctgtaaataccaaaaagagagggaatttgtaattaacaaaaagaaggggaatctgtaattaccaaaaatttataattaccaaaaagagggggaatttgtaattaaaaaaaagagagtacgccttccgttccataaaaaacacaccataaaaaacacattataatactacgaatatgaacatacttataaaaagacacattgtaatactacgaatataaatataacacattataatactatgaatataaaaatacttcctagacttagcattgcccattgcccatattcatttagatattaatgaatcattagatattaataaatctagacatatacatgtaatactacgaatataaacatacttcctagacttagcattacccattgcccatatttatttagatattaataaatcattagatattaatgaatctagacatatacattagacatatacatgagtttagatatatgatgtttagattcattaacatctatatagactttttagcattgccatattaatgaatcatgtacatacatgtgtttaaattcattaacatctttttagcattgccatattaatgaatcatgtacatacatgtgtttaaattcattaacatctatatgtacgtggacacaatgctaaaaagtcttacattgtaaaacaatgtaaaacggagggagacggagggaataccttaaaaaaaatacattggaatactacgaatataaacatacctctattattcactcctatgttttttttaacctctattattcactcctatgtattattcactcctatgtagtatcatattcactcctatgtttttttttaagtcctattcactcctatggtttttttttaagtcccatgttgtttttaaggacggaagacgtaacattcagtcctacttcaaggacggaggagatactggataacaacattactagcaacattatggaaacattttaaaaggcaggcaggtacaaacttcataaatacaaggaaacattttaaaagacaggcaagtacaaacttcagaaatacaagaagctatgaccgatattaatattagcaacacattgaagcatgcaaccactcgtttttattcatccatacatcggagtattggttattctgaacagtgtacggccactccaaagctggagctaaactgaacctcaaaaagggctcagtgatggccaccaccggggagcttctccttgatcttctccatcatacccttcttctcgtgcgtcggctgcgtcgtcggtgtatacgccgtcccgccggcgtcggtggttgtaccagcggcggcggtgtgtcccgtgccggcaccatatccgccggtcgccgcagtggccgtcggctgctgctggccgcccttgttgccgccggggagcttctccttgatcttctccttgattcccttcttcctcctccctcccatcccgtcgtcctcagacgactgcacgtcatatataatacattgatgacacaggaagatacgtagacataatctagttacggttaatttacagtgtgttgagaaacgttaccgagcttgagcttgaactgccggagcggcggaggatgccaccggtcttgtgctcctctctcgccggctggaactggccgcctgcgtgcggatacgcgccggtgccggcggtggcgccgtgtggcgcccctgtgccggtggttccgtatgccatggtgtcgggtgttgtggtggctccgtgtccagccatgtgcctggtgcccaagccaccggcgccgtggtgggctccggtggttccgtacccggctgtgtgcccggttcctagtccaccagctccgtgctgagctccggtgacgccggttgttccgtacccggcggtctgccccgcgggtaaaccggcgccggcgccgtggtggactccggtgccggtggtaccatgcccggcagtgtgcccaggcattaaaccaccggcgtcatggacgccagtgccggtagcgccgtacgccggctgaccggaaccaccatagcccgcggcgtcgtgggtgccggtgccggtggcgccgtatccggcctgccggccataacccccggcgtcggtggcgccgccgaacgcatgctgaggctgcgcaacgntgccggcggcgccgtacccttcgcgcctgtctcttgcgtcccggtgatgccgtggccggccgccaccgggttgccgtactcgtcgacgcgcgccgccgggtggccgtgctgctgtccctggaagtgcgccatcttctcagcgtacgacgtcgctcgagcccgactcgatcacttgcgtgtgtgtgtgctcgcctgctcgagaggcgacgagttgatcaactgtttcagttggaaatgatctgtgtggtgggtgacgcgaggaggagaacgaggcaaagcgttggacttataggcgaggcgcgcgcggcgcgagcgcgacacgtcgagggggcacgtgtgagccgggtggatgcgcgacgcgtggagaacggtggggagccgacgcgtgcatgcgcggtgtgctgggatggggggtggagcggcatggaagccggtttgctttccacctggatgaggatgagtgcggacgtgggcttcggcggagattctgcgcgtcgggggtgtgcgtgggcgacgtcgagtagaacaggcgttctgccaggtggttaggttaggcatggatgcggctggtgacttgactcgactggaaacaaacagcctcggatatatatttcttttaaactgtcgaaaggtttggagttcaaatcttaacacaattctaataaataaacatagtctattttaaataaaatattaaaaatgataaacatttaaaatgtcataaatatagagaaaaaatagtagtaaactttatttttggtgttttgtactaattgagtttaaccataagttcggtctgcaataacacatctagaagattctacgactgaaacttaacccaaaatctattgtaagcggaatagtaaaatcgttttttgctaggtattgttttgtcaagaaattttcaagggaaaatcacatggatttttaaaaccaccctacacttggctattagaacaatataaagctcactaagaggataaagacgtacacaagtatcttagttagaaaatacaatataattgaattttgttttaaaatttctagatttaaaaagttacaagcatattaacaaggtacaatgtaattttatataaattacatcgtagcttaaaataacttacaacattctcattacactgtaatttgaaatgtggcttcaatttatttttctaataacgtcattaagctcatgtatacttataataccaaataggcatattgcatactttaatttgctggatcattttattacgtaactgtttcagctgggtctcacttattaaccagttgccagcctgattggccctgctctggttgctgcacgcacgccaggacatgacatggctctctatcagttgcagtctgtttgtgatcaaacgagaaaagcaaggatcttatacgtaaaatcaatggtgaaaattccgtctgattttaaagatgaaatctgttgaaagatatatagcaaaccagtaactgacatagtcccttggctcgtgagcttgtaactacatcgcatcccctagaagatagtatgctaatgggacgctatgaaattgcattgtcattcttagaaataaaatacacccgtccaaactcggataaaaatatatatttcttgctctgctaaaaaaagatcatggtaagaaatatggctctcatgaccgtgtaaaataaccaagtgttgaatatttcggaacggaggaaatatatatgttttgtggttagtctccatcttaaattaactatggggagaactgtgtaaaatataaggtaatctttatccatcaaacggtctcttggatatataggtcaaagataagttatgactccggttgagcctgtaatgaaacaggtcaaagataacttgggtggcctatcaatggtgggccaggctttacactatattttttccaaaaaaaaaatgatcaaacttaatgaaatttgacttagtacacaacaaaaacatctaaacctatgaaacggagggagtacagtggcatatgtacctagaaagttttatagatcatctctaaataaaaatggtgctgacagtagggtataatccatccaaaaaaaaagaaataattgtggggcatctttgctttgtgttgcgaagtttttttttcttgtaacaaggctgttttaaaaaatatattttttgaaaacgttggtactttttttagaacatgattttttttaattgtaattttgtttgttgacgtgcaatatatatgtacgcatatttttttattatcatctcatatgctccaatatgtttctaggaaatacatatggattggagcatacaaatcagttattcccagacactggatgtgattactaccaatcaaacactataacttcttatgtatccaattcaaccacaaaatggagcgcacttaattaatttgccaattagtccttcgctcgctttttagttgtaggtgcattttgctagacactcagaaattgttgaatagcacttcttgtcctttgaacagcaataggcaaagtccctctctttctgatagcaaacattcaagctcgcatggctgaccacgtttttcagtcccatcggaatattgcttccgatcttccttatggtttgacctagagatggaaggaatcatatgtactatatgttttaaaactgaaaaagaaatgatgaaatgacatataaatcaccaaaaaaaggaatttagttttcttattacctcttatttgtgcaggaagagcggagcacaccacaagaaccaagcaaaacaacatgagtccttggtaggcaggcttcatacatttcaccattgcgaaatatatatgacgctactatgttttacctgtcttattgtgatctatgtagggaatgttggtttgcgtgaacttgaggagccatggttcatatatatagaacaaatatggctgctatatatggaataaataaatgctagcttatctggaggattttaatcataatctaaaaggatctggaagattagcctgaattatgattaattgcctatttgatgacaataaattgttgctgtaaaatgaaatatcgtaaagcctaattttagctacatggacaaacttatcttctcggtcttgcccaaacgtctattgttgattaattccaccttaaaagagcgattttaaaaatatatcacccttattcttctgttttatgataatagattaatgtttatttttttttgtcaaatctactaacttgtccgaaagtctaattttagtttcactctaaaacatgtcaggctgtactatagatttcaccatcaaaaggttctaaatgtttcttacttaattgcatttttatgacaataaattagtgcctacttagcatcaaatctggtagattatcctaattaaaatatactttcaatagcatggctaaatctagcaggtgactctcccaacgtatgctaatagcaataggccccgttcactgtttccttgcggtgaattcacctattaggaggggatggttagaattaattctccatggggacataaatgagaggaggcatgtccccgttggtttcacggggggcggggattgttcttcattccacgtccccgctccccgcgaagacccgcgtaggggccgggtccaactttaatgtattttagttatcctgtgtgattatattgtttgtagtctttgataaatgataactttatgtttttatcatgtgaattagtagaaaatattagtagatgtatgctaatatattcatataaagtacgaatatatgttgtattgcatatataatttgacatgtgtatatttttttaagcaagggtgaaatcaccgcggggatttattccccgtgcggggatggggatggtaacaaagcttcccccgctgtgtttcgcggtgacggggatgtctcgcgggggcagggatggggatgcattccccgaggtgaattctccgttgccatctcttgcactactaaacatgcatgcgttttcaaattttcttttttgtttaattgctcggtttatggcacgatttcttcactgtacttatcagattttgttggtgtaaaccctaccttctttaaatattatgaatttaatttccactttgttgtacgtatgtcaaacatattcgagaggtgattgtagttgttttcttaggcgttcggttttctccgagattcaagctaggaatttcccacgtctctgggttgtcggtatgtggggtcaaaatagagttattgcttttgtcttatagttaaaaattttagcagtaaatctactttgtgttttctctactatattccattgaatttgatttgttctatagtaggtatgaaatcggttcagatagtttccatgtctattatatattttttggcatgtctattatattaattaattattaattttattgttatatagataacattgaaattgagattattatgtggatacaacacatatttataattctgtgtttttcttaaaaaaataaaaacctaaagagtctaattttcaatggtatattatatttaacacaatttagtatattcttaattttgtaagcacggtacaaggggttttcctgttcccatagatattcatgaccatatttgttccaatacatatttactcagtatctgtattcgataatattttgcttcatttccttttacgattctgattaaaaaaatgaaaataaaatgatagaggtagtttctgttaagaaaccagtctactctactgatcagcacatgagcagataaacacaaacttatgttccccaaagttctacatgtgctatacatgtcagacacttataagagacatataggagattacttcttcaataaggttgtcctcatcatcgtccatatggacatcttcaccatccttagtgttgacaaacatgtcatcatagttttcaatgtgagcttcaggctcagtggtgaagtatgactcatattggctcattttctcattagagctcaaccagatgcttgggaacatggcagttacgagaccaatgctcaatgcctccacatctatagcaattatcatgttttccccagatgttccacatgtaactttcttgcattcggcttttgcctttgggcttacccttcccttgccccttgaacatgatacttcccttacccttctatctcttctccctgtggccccatttatggtcacgtgagtcgccatcaacatcaacattggcttgtccttcagacattgccgtagacccagtgggtcgagcggaatgattgtttaaaataatctcattcggcctttttgcaactaaaaggactgaaataagctcagactactttgagttcttgtattgttgttgaagcaccatgcatgttgttggggtggtaggtggataactttttctcaatcatctcagtatcagtgatcttttggtcacataaacataaccaagcactgatccaatatagggcagagttatacgccactataaatttgtagtcttggaagcatagggtgattaggccatgttgtgcccatgggagcaaaattgacccttgatggtcgcagcgatccttcagggattgccataataccagtggatcttcctcggtcatatactcagacttcatctctgggtggagatggtggcacaagaatgcaattcctttgctttcttcgcctttgtaggatcctctgtgccagcttcgattagcacaatagtatgaccaagacccatggagtctagcttaatttcaacatccaatgcagtgaggtagttgctaccatccaacgcaagctcgatgaattacttctttgttctatctgacatgtcccatggcatcattttgtatttataacaggtaaataatatgtgcagggtcgatataaactggtcatgagtaatttttatgatcactagcatgtgtaatctttaggattaccacacagtttaccatagaaattaatttaagtaatccttaggattacagattgcgtgattaaatattatgaatcatgctaggaaattaattatataacattaaaataaaatgttacgaaagatcatgcaaacaatatagtaagcatgtaaacaaaacgaagagcatacatgggcacaaactccatgcatattgtgcaaactttaaaaaagaatagaaaccagtaaacacttctccactatgagcccacgagccttgacggcaaagttgaccttagtgacagcaaggccccatatgggtgatctccatagaaccaaaggacatccataacacttttagggtcgtgtagaaggtttgtttgcctccactatttgcgggcaacggcggtagagccatccattaagtttacataccgatgcttcaggaacctttcatcatctctagcattttaacgataatggtagcagagccgccatcatgtatcaactaatgctgagaggatgtatcatctcaagcctttggatggtaacggcggtagagccgccttcatgttactaggcattgctgagaggatgcatcatctctagcaattggacaataacagcgatagagccaccttcatgttatcatgtattgctgagagaatgtcagaggatggtacttcaggtgccatattgttcttctgctcatttcaactatagtagaatatanntntgcatattaagancnagatgatcattaggcattggtttctcagctgtttacctgtttagcttggtgaagactcgtgctggtacattnttaagaagccattctattctactgatcagcacaatagcagacaagcacagagttgtggacacagaaanatatggatgaatganagctttatttcatcggattgcgtacaagttacatgagnagattaagtatgaaaatataattcaaaatgatgttttagagaagattgagtatgaagatataattcaaaattttatttcaaagaatatcaaaaggattatgtttttcagtagaacatgaggtcaggtcaaactatttaagcattaatgttttatatgttcctaagaagaaccatatctaaaattttatgcttttgttatgctccgttttcatatttttggggcccattttacgttttgcacatgggccccaaaatcatagatacggccctattcatctgtaacaagacgcatcacctctagtacatgtgaagcctagattctggtttctctcttcacctctccctaccttttctctcccctttggaccacctatatacccatggttgatgttagcttcctccggtactaccccatttgagctgccaccgtattctttgaaagccattaattatctggaatttactattaatttggtaaagcgtgattttctctttatatatactaccgggagtagctactcctgcatcatctgctatacgtgctttcaagccgatcgctattttcgtgggatacaaacttttgaatgcattatgcacgtcagttgtttgcattatctgcctgacggccgcatatatatatagagagagaaaatcctctatgtacccatgaaagttcacctaatcccttctatacccctgaattttgctcaatcccttacatacccctgaattttagtttggatcccttccatgccctttccgctagttgaccgttagttgactgttaaattcttttgaaaaagtccattttgccctttgctataaagaaacataataaattaatgaagtatattgttggaatgtaaaaatttattggatgagactattatatttatgagaatgtgatgcaccatattatttgtgacaaatttacttttacatatgatataaaaagttaatacttatttattagttattaaaagttcttttatgtagcatatgtgttttcatagtaatacaacatat

SEQ ID NO: 5075 - DNA, 660 bp, Oryza sativa
cagaggtagacgacgggcctgacaggtgggccccacatgtctgcggcagcgagcgcgcgcgagggcagctgcggctggacttgggccgacttgggccgagaaggacagagagcggttatgggccgactttcggcccaaagccaaaagagacttttaaaatcctttttcaatttaaattattcatgaaatgcaattccatttattaaaaatacttccttagctcaaataaatcccaaaaaaatctaggaattatagaattaagcaaagtatttaataaaattttatctggccccattttatattggaatttattaattaaaattagatcttctcttctagacttttaaaataaattctaataattccaattaaacaacaatttatatattttggatttttagggtgtgacaaacctacccccttaaacagaatctcgtcctcgagattcggaagaactggcgaacagatgcggatgagctgacttcaattcatcttctcgttcccaagttgattcttcttccgagtgattactccattggactttgcaaaaacgaataactcgatttctagttcttctctcgtctatttcctagatacggattggtttctcaacataggtcagatcctcttggacttctatctgttcaagattagcttctt

SEQ ID NO: 5076 - DNA, 709 bp, Oryza sativa
ctttgccttttcagacttgtagagaaggagcagccagatggcatgatgtcaaagcaagtgaggtactccttgctagtaatgcatataattttttttaataacaagtactaataattcatgattatcttagttctgtatgctactctagattatgatgttttttgctgctttgtttgataggccttatctgatggatcttggtagtaccaatggaactttcattaatgtaagtcctccaatgatacttttactactaatcagatacactagtcgcgtttctaataatattttctacccagtcaatatttatgttttgatttttttttcaggagaatcgtattgagcccagccgttactatgaactctttgaaaaggataccattaagtttggcaatagtaggtatgatcattgaaattgaaaagtaactttccccctctactgtttaagataactttgcttgcttcatgccctcatcatatcaattaaagaaagcatcacttttttgtttatttattgctcaatgtatatgcatctttggtatgtgatgacttaaattaacaacttattatgaaagtgacagtctggcttttggcattctctttagttagagatttattttgatttgtggtactcttgggataaaacatttttctccaatatctaagtatatctttgtaactacgcctattgtttttctcatacaatttc

SEQ ID NO: 5077 - DNA, 35221 bp, Oryza sativa
  unsure (1)..(35221): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccgcagttcacggatatgattgcaatcagtgtaacaactaagcataagctaataaacatagacaaagtatatcaatgtaacaacaaatcaagggatagacacggacaaaaagtgtccttgatgatgatgcccacttcattggcctgcctgcccattttgttttgtcactgtgttaattgatgcaaaagttgcaaacataaatttattttttcaaggatagtgtgagaccctgtgagtgcttgaatagattcttggaccctagcttcttgttcttttctggatagaagaatcagaggctactaattagtgtaccttctggttgagtagcatttacagtgctaattaagtagtgttcagctcaacaagaattagctcctggtattataacaggggttttagctggtaaaatttaatggaatggtccagcttgtgtccatttagggttcaagactgttgtgcctggtttgatgcatgacaaaattaccagggtgaaacaatctatgaacaaactgccaaccaagtatctatcctaggtgactaacatagtcaatcaaacacactttgttttgttcatgaggaggagggccactaaattagggtaaactagtactatatatatccagcagaattaggctgcgctcattactccacattcccaacacagctgctgcgcacggaaaacggagctgttcattagcatgtgattaattaagtattagctatttgttaaaaatagatcaatataatttttttaaacaacttttgtatagaaattttttttgcaaaagatacactgtttaatagtttgaaaaacgtgcgcgcggaaaaagaaagggggagttggtaactcctggtaacaacgtagccttagttcacatttttataattttaaacatttaagctaaaaaatttagacgaaaagacatcccttcaacattcttagaaagaaatcgtaagtgtgttgaagattgaacatctctgagcaagtacatctctaagcatttaagcagctttaaaccatgagtaccaaacaataataaaataaagttattttatccaatcagttgtgcttagacatttcctccaactaataatcttgttgatccatcaatttttgtcttagcataaaaaaggagtggaggaggagttgcccaactcctctaaccaaccaaagtctgacctggccagccaaacccctccacgcgtcacataaaccaacacatctccctggacacggtccatgaaccagaacccatcacagccgtccgtttctcccataaaagctactataatcgctcgaatcgacggctggtaacgcacgcaaggtgggcccaggcaatcgtacccaggggcggctatcgatggacccgtgcaccgggtccatgaacccagcacgtgcgcgcggcacaggtcaaccgcttcgagtctatggaccgggtccatgcaccgagagtgatagaatccttttcgtctcgtctcgtctccctcgcgagagcttcccaccattaaagcccatagcggcagcagcaggagcttccctctttttttggtccaaaatccatcgcccaaaatcggaggtaaatgaaattcgagatattatccaaatagtttgtttgaatacttatcggtttcccaaatatcttcgttgaggaaaaaaacaattttaaaaaagtattttgccatgcaattttatcgttcggagatgatggattagttcctttttccctttcttggcatgatagttcttgtggatttttaggttggagcttttgctcgggcgattgattttggaatcggaggaggggatgtcaggaccactcgatcgatttgccaggccatgtgagtacgaattactaggaaatagagtatttctttgcatttaagaccaggatgaatcgatttattgggcttaaattagtgggttatcttgtgattacctgtgtatgtggtattgtacgattcaaatatattcatatttgaattcttggatcaattcttaatggaggatatggcaaaagagttcgtgagagtatgcgattgcactgtttataggatttggggatttccccattcagttaacaccaacggttacctatcaaaatcgaatgtttgtaaaaaaaaaatcatgcagaagtccattcactctccgttttttaagtttcttgctcatcttcgatttttttttccttttgttggtctcactagagggcataatagcttatgcttcaagttttttcaaaaaaaaaaaaattacggggaagctgatgcttcaagctaattatgcattcaagaataaccacaaaaaggaaagctacaaaccaacacaaagaatcagcacattttgatgttgatgtcacatgtataaagcattaaattccatttaataattcatgtgctgttggtattgccttgcacaaaggcactggattaattgatcaaatgggtcctctttttataaagtttatcttcttaatcttcaaatgaacacctatactcacattactgttggttctgaaactaagttaattttacgttctaggtttagttccctgtaaagctctattatttgtcattctccctaagcggctaagccacctatcagttgccggtaagaaaaaaagttcataccgtcataacatgagatgctattgctggtgcaggttttgaaggttttacgcataatgatgaaaagaaagagatcagatctgacgcagacaactccgaaggagagaagaagactaaaattggttctttcaagaaaaagacgattaatgccgggaacaaattcaggcattccctgaggagaagaagcaaaaagaaaaatgaacctcggggttccattgaggacataagggatgttcaagatcttcaagctgttgatgcatttcgacaatgtttagttgatgaggacctgttgccgcaacagcatgatgattatcacacaatgcttaggtacaagcttggcttctctcatattttacttttggccttaggctgtgtgtatctgttttgcctccttcccggaaatgtggcttcactataaatcacctatagttgggaaatccaggatatgccatttcattgaggtgaattctagatttgcaacttgatgtctgtcttgtgggtcctaaggcccccatgctagctagatatcgagtggaaaaaatctagagtggcaatctttggagcagcaaatcattaagaggctaccctgaagaaaatgattggctggtcgtgtgaaattttcattttatctccttcacatataggttcctcaaagcacggaaatttgatgttgagaaagcaaagagtatgtggtcagatatgcttaaatggagaaaggaatttggggctgacaatatagaggtaaaaggttgcgttgaagaaacatatctaatataaatatgccattctatcatgacacttgtttatcctttctctcaggagtttgactacaccgaggcggatgaggttatgaaatattatccacaattttaccatggagtggataaagaaggaaggcctatctacatagagttaataggaaaagttgatgcgaataagctaatgcaagtaactactatagagcgatatgtgaaatatcatgtgaaggagtttgagagatgcttccaaatgagatttcctgcctgctcgattgctgcaaaaaggcccatagattcatctactactattctggacgtgcaaggcgtggtatgtgtattcataaccaaatgtttctcttaacactgagcacatagttatgactctgtgattgacttgtattatatgaatatcaagggtttaaagaacttctcaaaagctgcaagggatctaatcacacgactgcagaagatcgacaatgacaactacccagaggtaggtgattcccccatgtaccttattttccaaagtagtggcatagtgcatgccttttgcttgttgtcccaacactgaattgcctaatgcatcctgaaacctctcacagacgttgcgccgcatgtatattattaatgccggccaaggcttcaagatgttatggagcactgtaaaatctttcctagatcctaaaactgcttaaaagattcatgtaagtcaattatatattttttttattgtaggattattgagtaatctgttatatacttaatcaagatttttgaccgttatatagttagtagttaacgactttcatgttctattttttttttctcttgaaggttctaggaagcaagtaccaaaataagttacttgaaataattgatgagaagtcagtatctacaatcttgtccatatatgtttcatgttcatgccatcctccatcctaatttctgtccgctccatgtattcagtgaattgccagagttttttggtggaaaatgcaagtgcgaggcatttggaggttgcaaaaaatcagataaaggtccttggaaggatcctaacataataaaggttatatcttgaaaccaaatcaccagtccaccgcttactgaaaggaaaatagaaagagggagaaaaataatagatgcttgctggtgtattattacatgcacactatctttgcgttggtgttgatatatctaacatgatggattttgaatttggcttgtccagagggtcctgaatggcgaagcaaattatgggaggcaaattgtgaccatatcaagcactgatggaaaaataattcgttatgctgggccacaatacccaacagtaagtctacaagcatggttaatgtggagatttttaggagcattgtgttcaaactattctattgaaatttattgttatgttgtcatgccaatgcagagaaaaggaagtgatggctcagcggagtctgggtctgaagtggaagatggcgcgtcacctatggcatcaaggaacctgataccaaatccccttttgacccctgttcatgaggaggcaagttgccatgctgtatcactgtgatcatattgcagtttaccttataaaataggagaagtgcaaatatgatatttgtcagcataactgcataatctacactgactaaaaattgaataatagcaccacatggactaaaaaatcattgaccatcaaattgaaacattttttttgtgaataacatgtggatttttatatttcattacattacaccattacattgttatacaagcttctgtaagtaggctatccttaatccaaggaaccatggaaggatctttgggttactgcagcattcttgtaatgatgcagcatttctgactatgtagctattgctaataggtaatctcattttgctatttcagtcaaaattggcagcacatggatttacatctgcttccccttccattattgaagaaagcattcctgttgttgacaaggttgtggatgatggatggggcagtcctagagctagtatggcaatttcttcctcagctcttttacattcttaatttggttgtttctcttatccataatctcgttcaaagttgaaattaatactcaaatcgttgttgaccatttttattgttatactgaatgaaccgattgagaaatattcgctaaactgttgaataattattcgctgaacttttctttttgctgaacctgaacctgaactttcacatgattcacgccaggttcatcaccctcgagaagtttgcctatcacatttgatggcctctggacacaagttatcacatggctgactgtcttgatcgtgagcctttttgctatggttcgctctgtcccaagcaggatggctaaaagattctcaagccaatccactgaccatgatcactcctatgtggagtatcctcaagaagcagagtacaaggaagaattccggccaccgtctcctgctccgtcttatactgaaaaggatgtcctctcatctatggtaagacgactaggcgagttggaggagaaggtgcaggcgctcgaaacgaagccatccgagatgccatttgaaaaggaggaattgctgaatgcagccgtccgccgtgtggatgcattagaagccgagttaatctctacaaagaaggtaggcttgttttgctcaagatggtacctttttcagcttcattctgagtgaattggcagcttggcataaactatattggtttaggtatatgtaaaaatattactaccttataaaaagaaggtgatgaagtacttcaattttcatgagcaggctctctatgaagccctgatgcggcaggacgagctgcttgcgtacattgacaagcaagatatgatcaagtttcgtgtacgttacagctttcttacactctttttcttgctattgagataagagcagcagagccatctaattctgttcttttatatatgcctttgcagaaaaagaaattctgcttctagcagctcaacgacgagttaattctccatacacagagctgttcgtgtatatttggatcaattaatcaccacgaatatgaatgaatgcagctagtttggagtgtaaaattaaaagtgtgcatatggcaaattgagaatccaacaataacaccacggtatcggtatgtgagttacaaggtggaccttgaggtgttgttggctggtcattcagaatccagacgatgcatcgtcttgtgctggagggtcctggctgctgtaaattaagcctgtaattaatcttgtgacttgtaacatatatagcacaaatgtgagttaaaatcgttgtaaatggacttcaccttggaatcatgcatcttctcatcatcttatctgcgttgagttcagatattccctgtatcctaaaatataaggcacaacaaccactaatctaataaaaaaaatattaccccttcgtttagatcaccctaataaatataatgcatacatctaattggattaaagatcaaacaatgttaatttgctgtctattgcggtggcgtgttttggagctgtgggaccgtgacggtccatgttttgaagctgcgggaccgtcgtggtgcggcgtgaccgtcccgcgggaccgaccgtcccgtgttttggagttgcgggaccgtagcggtcgcgcattctcatcccgcaggacgggtgtattttttaaatccatcccatgtagttatataaacgtaaattattaaaaaaataggtatattcgcaattttttttcattcatccatcgttttacatgaaaattctaagtcattatataataaatacggatttgtattttcaaaagtgatcgaacttaagaactgactcatacacgaataacatactaaagtaccagaaaaaacatcttcagtttttataataatagagattgaagaaacaatcgacgctagggactacccacgtactatactaataatttgacttagattgtttcttggtactcctatattcgctaagagaaaattacttctacgcccctaaaatgttagtataccttctaggtgtttgagttttgtacactcctttatgtgtctttgaattttgggtttaatctcttcttcgttagttgattgttaaattgctaaaaaaaggtacattttgtcttttggcatgaaagaaatatgaaaatttgtagacgtggagtatattactagaagtcactacaatggtctagccttacttgatgagtcactttcatcaataaatagcgaaagctcgtcacaaaccatattctttgacaatcttgtgatgaaatgacactgtcgttgcagaagccccgtctgaaattaccatgtgcaacttaaaaaaaaataccaacaaatggctctaacgattttccgtcgtcacgaattagtgacgcactgaaccatcattaggcaaactaaaacaatagaaccacctgctccggtgtcatcgcaggacaacttgacaacatggatccgacatgacataatttgtgatttctagcacgttgaactaatgagaccattcctgcttaattattacatcataaacaacaagaaacaagcatatggtgggttgtggcccaccattatgtgagacctcgatcattaggtgggcctaggcccagcataaccatgggccacgaccccatcttatggtggcttggtctaatgaactacaagcaacggcaaagtataagtttgttatataagactattatgtatttatatttatgactttgtttcacgagatataataataaaagaaaaataacatttatttatttatttattaaggagtatatttagaaaatatattatggtagttcaatatatttgtcacatgttatatattctagatctctgttggaggtatgtcacaagggccttcgaccggacctgccgaaaccaccaaatccgctagacactgactaagtccagagggtgtgcccggggcaaagtcatagggcgaagccgaacgatgaagatcgaagggttcgcccctaggctcacaaccccagggcgaagcgttttgggcgaagccgaacgacgaagaacgaagggtccgcccccaagcccaccacttggccaagtcaccgctaagggcgaaggccataaggcgaagcaagaggccttcgcctgggtagaaggggccttcgaccataggcctgggaggccttgtggcccgtaggttcggccatcattaatgggccggcccaacgagaccgcctaagagcccatgaatacaaaagacactatgtacccacactaatatccctatcataagggtatccatgtaaattcccatgtactaactaaaccctagagggtatgagcccgtactaagactataaataggcccatagggccatgtaatgggggatcccaacaaaattttaccaattaatatatttcttttattatttcattaactcactgagtgaaccacgcccttcgatgtgatgcagttgtatttcgacaataatctctataagagaaatatgtttatcatttaaaaaaaatgctacacatagttattaaatttatgtcaatctatgtctatgtattctattcaaacaatactccctccatccaaaagtaaggcatttttatctaaaattgagggtggactaacaccgactttgttctcacacctgcatgttcttagtacatatgtgctttatactatatatatttgtccttttgttgcactaccttcctagggaggaaaatctctttgttgtattaccagatgtcacgttgtggtcgttagcaatataatactataataaaattaaaatatacacactataagatactatggactcaaggtttcagaactaaccagtattatttttcccctccagacaaaccatgcaatgtggtatcatatcatatgtgttacagtcccaatacacttcagcgaaaaatattatagctttgattaaactgtatttaatctgatatattgcaaacaaaaaaacaaaatagataattttgatgtgggcttaagtagttaaaaaaatattacatccgtttcaggttataagactttctagcattgtccacattcatttagatattaatgaatctaggcacacatatatgaatatggacaatgctaaaaagtcttataatatgaaatggaggaagtactaaacaacagattatatactagaaaagcagcacaatataaacatagtcctattataaatcattaggtaggtggataatttgctctcgtctagattatatactcaattctaactttttttttataattccacatatatgaatattgaatggtaaaaaaagatgtaaatattttaaattatcgatgcatatgttttaattatttttaaatattaaacataaataaaaaagtgaacacattttacctaaaaaacacaagctaaactatattttgttcttctcatcattgttataatttttcagagagctctctgcatattcattagaaatacgctgaagagcctcctcgaagtcaccatcactatcatcatccgattgatttggttggactacatttgtagcaacattgatgaacttgtttaccaaataattgaagtacacatcattgtcttcttctgcatcagactcgctctcatgatacctatatttaaaaagaatctgaataagttaggcatacaagtagtttaagcatacataccagagaaattatagaagtgtaaaagaaaattattgcactcctgttgctagcaatatgagtggtagtgtatgtgtatcaagaggtggtgaagacatgaagatattcattcgatgtgatagaggtggagaataaatctaaatatggcggggtgatgaaaaataagtgtttttattaatcaagttggtaagtgtaacagtgtccatagtaatgcaaacaccatctttttataaccgtgatgaacatgaataattactaagggggtgatactaatacagaatgatcaaacaaaggatctaagcatcataaaatcacacaattaatataacaaacagtgttatgaattaatagcacaactagacagtaaagagaagctattagtctactactgtcacaacaccatcacatacatgcatatacagcaagagaccatagcaaagattaatggataatcacatacatgcatatatggcaggagaagtctattgaatgagattatgcatgcatatatggcggcaggagaagtgtattgaatgagaatatgcatgcatatacggcaagagaaggtatttgtctattgaatgagaatacgagatgatgggatattgagatttatgaaaaatatatttgatttattggtggattcacaatggagaagttctaacattgcttaattacttacagttcagttgacacttgccaaatgatgagagcacaaatcgataaaagaggcttcaactatctataatttgatcctaatgattttttttgccaatccaggacaacgaataccactagaaaattatgcaagtatttctaacatgttgggtttcaaatgtttcaaggtccaaatagttttctcaacattgccattgatttgccactaattttactactttgtatatacatgtggcagctcacttgactttttgctaagacctaaaagagtgaacttggtgctggcaaggtactcctttgttttgttttgttttgttttagatcatgtaaacattgaatttgatttgcaactttgtttcagtttcaggcttagcctaggctttgagcctatccaatatcattatcatggattcaccacggctagggatcataagatagaagatgttactttggttcagacattaaattatcatggattcaccacggctagggatcataagataaaagatgttactttggttcagacattaatgcaaccacggtttttatgaactagtagcacaactagacagtgaagagaagctaattactactgtcacaacgccatcacatacatatacgacaagaggcttgccctttgagatgaggtggaggaagtagtattgtgtactccatccgtcccaaaaataatacaattttacattgatcatgtttaacgtttgatcgttcgtcttatttgaatatttttcatgattagtattttcatgattactaaatgataaaatatgaacaataatttatatgtgactatttttttcaaataagatagacggtcgaacgttggacacaaatacccacggttatacttattttaagatagaggtagtagcttactttgacattggccttaggaacacctcgggtatctactttgactttggcgggttttctaccacaatcaatcaatcatttcaggcttggtagtgataatgatgaaatggagaattcagataagattttttttcttacgaacgacgataggggaagggaggaagttccactatcttcccagtaatgggatcgctataaattaacgatggggaattatgccctcctgtcaaagccacgcttgtggccgctcctcccccatcggaacgacaccctcgccgctgccctcctgtccggagtcgggtttggttacggacttacgttggccaggcctcgtttttatgggcctcaattcaggcccatccatgtgtaattttacaagctttgatgggccggagttacaaagaagaccttgttgctagtcatccgaaaaacacagatgggcacaatttgagtttaatttatttgttttgttacaacttgtaaaaaaaaacaatggcgtatttgtgttttaccccgtcgttactagaggtgaagacaacgaaggccgcatcctctcgctctcgctttctaggtgaagttcctgtggtttcgaattttgatacggccggcctgacaagagacattgcttagctattcgtgaataataataactcaactcaatataagggactgaacgttcgatccaaatacgacttcaactccgactcctcaccacaaaacaatactcttaagaatacgagtacgaccgttaagtgtagaaaactaaagataaaaaggaagaatacgagtcggttttacctataccatatatgatataatatgtctctctctattctctctttctattaacttttattatttactagaatgactagaaaaaatgtccgtgcgttgcaacgggtgaagcttattttaatcttattattattatacattttagttaaggtaaaattcactatgagaattcgattggatttatgtttctctacaaaatcatgagatgtaattaggagttcgatcatctcaagttagcatgcgagttttttaaagagattttttatacgactcattctgtatttccaaaagcgaacttaaaaccgactcaaatatggatctgcattttcaaaagcgaacgaacttaagaactgactcatacacggatatgaatatgaatgtttctaccattgacaaattaacgataatagcatagtgatcattattgtaatgtttttctcatcattgttgtaatgcttcattgacaaacttaatttacgttgtttttctcatcattgttgtaatgtttcagagcagtctctacatatacataaaaaatacactgaagaacctcctcaaagtcactattactatcatgatccgattgatttggttggactaattctgtagcaacattcgtgaaactgtctacgaccaaatagttggaatgcacaacattatcttcgtctgtatcacactcactctgagaatacctatatttaaaaacaaatttgaaagctattgcacataaaaacacaagtaagatcgtcaagcgtttcatacatcataccagtgaattgtaaaaatattagagacgagaatttttgcattgcctttgtagcggcggagaagggggaagcgggtgaagagcagcgtaagtagcatcggcagaatcgaggtgatttcttatgtctccactgttgtcgccgtcgttgtccatcactaaacaaacctacagatcgcgtggcgttggcttacatgcaggattcggtttggttccgccgactgtgcatctggaacgatctaacaagaaagaaataaagaaaaagagtttggccttgtttgtttatatgggacgcaatcttgacctataagcatatacggagttctgatttatgttcgaatttccgagcatgtacacacattaattggctaaaataattaattaggcccaacccatccagagaaggaaggaatgccagcgaggttggataagcgcccactaatcaggccaagcaaataagggggagtgtctttccaaatccttttcagtacctgaatctgaatttttccatatgattttttttgacagggaatcctatcttataataaaattaatgtccactaacttctaaaactcaacatgcaagtgtatcacatcatcatccactagcaattattatctagagtattttaaatcatatgcaagtataccagatcatcacccactagcaattattatctagagtattttaaatatcatgcaaacatgacatatcatttaaaattttattgtatttttagaactcaatatgtaagcaatgtcaactcattatctccacatcattttcacattatttaaacatacacatctaacatttctataatgtataacatgcattcatccacatattcctcagtaaagcacggggtgtcaactagttttccagatgattgatgtcaggtgttcatctacctggagaagtttactatcatatgtttgagtgttcacccatgagtagatcgacaccgcactactgttccccctcatgtgaagtttcttatcatgcatgtgatgacgcatatgctgaacccagtgattgtagttgacaccatcaaaaatatccgggcaatgagaaactgaaattgtgcttgacaaagaagacatcatcaaagatcaatgggtgacggagaaagcgcaaaaataaagtggcagcaagcagaggcaggaaatgtctttctttctatcttttcctttctttttttttaagtaacaagcctcggtcaagaagaagaccacgagtcagcagtggagaagaccgcaccgcattaccgcaactacgagagtcgctcgtttttttagtgaattgcacttcgggccatgttttattgccaaaatattacttggaccatcctatacctaatcttttcacattagaccagataactttacctttgttgcataatagaccaccctaactctattttctaatcatgtctagtgtctccctcgataaaggtatgacatgcatataggtatgaaaattcgtcgacatgtcattaacaatttgctcgaagtcattgaagtgctaaagatgtggcttggggtggtcacttgtgcaacaaagataaagttatctagtccaaaataaaatgattggacaaattatggtccaaactgaaacttttgcaataaaacatgacccaaagtaaatttttaacttttttttcactcggatctgatcggtcaaaaagaatccgaccaaaaaagaagtgacacgcgaacaagcaagcacgcgaagacgagagacgaccagcgaagggcggcgcagccaagaatgagcggcggtcagcaggcagtggccggggatgggcggcatcggcgaacaggtggcaaccgacaatgatggtggtagccggcaaagaggcagcaataaccaactgccacggtagttataggcccgtgaccacaacgtaaacaaaaactgaggtacgagatagaagaattgatgcacgtaagtgaagacgtacgtagagagaaaaaaatgatcatctaggggaagaagaagagtctaaccctagttttgctctcgataccatgttatagatagcacttgtattcgtctaagggcaataagcccaaatatatacaggtacatgtgcatacaaatatgcagaaaaaaaaacctttacaaataaaggaatataaagccaaaataaacatctaacaccatggtggctctgctggtcatcgatggatgatccagatgtgactgacctgtggatcccaccaacatgtagacatcaccatggcatatcatgtcagcgcacaaagtggattagagaacgtttggacttatatgacacttaggacaagttcagggatccgaaaatatatttaagagttgaaggacctagacgatacgcatgcacaagtttagagattgcttgtacacttcactcaaaatttaatgaacattaaggttgacaaatatcaaatgatgatcttccttcatgaaatactagttacaactcacactgtttgtttacaaagattcctctcttacaataactaatgtacttagtgtgtatatgtactaatacaaataaaaaactgtgaacgaacaaaagaatggacaatcatcaatactcttcaagatgtatatcagcaattcagtaggcaccatccgtgtggttgtggaggcattagtatctgactctatccaccaaagttcatccacaaatatggttgtgtgcattgctaattggtctagaggccagaagttatacttccattatcttaaaaaagaaaagaaatttactaagcataagagaaaaacaagattcttacccagtagctcattctaaaaatgacaagtaatttcacatgggttgttgctttcactgctatttctttggaacctagttagttggatggttgtatttcttgaacactctctcttggttttccctccaccattcctcagcctgctgctcagcaaacctcctcttgctaaacaaaaaaaaaagattgttgaagaatgaaccataaataaatgatcacctggagttgttgcttcaaacaaaaacatagaaagaactatgctttcagtgcacatcttgaactgaacacacttcaattgtaaacaaaagcttcgaagtttttccttcaaaagtgtggatggtgcaagtgttgttttttgaaagatggactattgatagattaatcaagttggaagatatattttacatccaagaaggatttgaggatggaatacctgaacctgacacgcttgaatactttggtgccatccctcagctggataagcgtcacatacactcctggctcaaactgctcaatcaactgcacttctccatgagtaccatactttggtgcgaagtcacctggagccttcaagttgttttccatgatacggtgacatggagagtcactagccatggcaatggaagagccactagcatttccagaactgccatcttgagacactggcaggctacccgtgctacttgacctatggtgtccgatatcatgtccagtaaggccagtaatctccactagattactactttgtcctgcaagaaatctctccgactggctttgcaaagtttttaagttgtcagcaacatcaccgggcaccctgtcggcaataaccttgagctgaagaatggagggttgtgatatcatgagtatatcctctaataatgataaataaacatgaactttgaagcaattatgatcatacaagacactaggataacatgataaacatgattttatatcgtgcgccctttattgtattttgattgagctatagaaacgtgtcagtaatataaatggaacacaatagagctactatactccaaactatacagtagaccaaatacgtacactatcatggaaagtataataatagatgaagagttgcacagtaatagtagtttaatgtacctcactgtcaagatgcttaacaaaatccaagacagtattgcgcctagcagattcttctgaagccatagaggcagcctgtttagcttttctttctgctttctgtagttgctcatcttgagtttcacatttctgtttcaacttattaacctgtcaacataaaaaatggttttaacaaattcagctaatcacattgaagaaatagaacaatctagagtgttctttcatacctgagattgcaacttggaaatgtcttgattcagcaactcgttagtcttcttcaagccatcattgtccactttaccgatcagaggacttgcggtcgctggaggtggacttggcttctttgacggtggcgatggtgaaaacattggcatgcccatttgcatttgacctcccattgtcatagattttacggtagttggaactgtaccaaatgttcctgcaaaagccatatctttgaactgcaacatggcaggaacttgtgatgctttcatcatggacataggatcggctggttttgtctcatttctaacattttttgtttcttgatacttgactggctctgctggtgatgtcgttgcaagtctggaaggccttatttctggtctctctaacttatctttgatatcaatggatcgcctggtgatgacattccttttgttatatgaactgataacgccggtatccgcggctttcagtttcatgaaacatgaatcacatacacggtgtggcttgcaagaagttggtgccaaagcagccttgagcactttcctagaactgcatgcatgacaatggacaagtccacagttgtagcaattgtgcctctttcttgtgaaaccaaatggctgcctgcatccagagcaaacagactgatctgcacctgaaacccacttatgtatgcaaatgcatgtagtgaaatttgaaccacatgaaatgctcttaacatgacgatctttcaatgcgtcaacaagagttggcttctttttgtcttcaacactaccatgtcccaaccttccattggctcccatgccccatgtatatacttcacttcttgaagtcaaggctgctacatggttagagccacatgagatctcttcaaccaactcattacccaacttatcttgcaccatacatggttgtttaccatcagcttttggattcccaagctggccattgttagagctacccattgtgaaaacatggccagatgtggcaagagcaacagtcatgctatgtccacaggccacctgatggaaattatggtcaacgagtgcttgaacacatgttggaactagcttcgcttctttatcgccatggcccaagcgattcttatctccatctccccatgtaaacagctttcttgacattgcatttgtgcttgcctgaccactgatttccacaattgctgcagaatgccatactccacatgcaactttcattgctctgaatccactcaaagcttctacctcctttggatatgcaacgctttcacggtctccatgaccaagagaaccaaatgtgccatcaccaaatgtgaaaagttttccacttgacatggtcagtgctgaatgccatgagccacatgcaacagagagtacctgaagcccttctagaggccctgaaactcttttcggaagccaatggctaactccagttccgtgcccaagtaatccagcattgtatgatccatcaccccaatcatacagatcaccagatgcagttacaacacaagtatgaaactccccacacgcaatgtattccacattggacactgccaaggattcgacaagtttgggacgacagatatcagtatcagtaccatggcctagccgtccaccaagttcttcaccccaagtgaatacttctccttgccgagtagtaaggccaatgtgcctagagccacatgctatttgctgaacatccaaaacaacatctgattctagaggttttggaattaaaaaatctgttttgctgcacaaatagttggaggatccttcagagggtagcacctcagtccacacctcaccccatacataaacatcgccgagggattcgatgtcatctagtccagaactttgactggaagaactaggggcactggaaatactaactcggctattgtctcctgtacttgctcttagcatatttacgcggtctgatccaacatctgctctaatagaattcaatgaattcggtgtgctataaccagctgagttaaaactacgtgtaatacttgaggcgatatctagcgttgtatcataggaagtgctatcttgatagattgttacgtcctgaaaaaagaaacatttgttaaacaagaacagtaaggtgatgatattctagctaagtcaaacaactattacagaattagtcggtgtcataatgacagaagtgatttactaggtatattaattctctataattgtttaacaataatgattttgtatgctcaaatatggtttttgtgcatcctatatttttattagctcatcggaatctcaaggaagctgaaacctccaacagtccaatcaaatccttaaaagggatggccacatttgtacaaggattggattataaattgttgtagaaaatgaaggtgaatttttgtttgtactcgactttaatataaattaaaataatgtaaatggggaaaggagaataactcacttcagaaaatgatactctatcagtttgaccatcattcagaaaatttagacggcatgaagtaatcagtgactcaagtgtcgaaaaccacacttctacttcagcttgatccttgcaaacctgtaagaaaattattgtgttccataaactatagcacctaggggtaaaatcatttaaccccagttaatgaaaacgagtacaaagaatttatattttaccagatcaagggaacgttggccgttcttgtatataagggaaaatgataggtaatccttctcagggcgtaaaaacctcctaaaaacagcctgttaaaaattgaaaatccataagatcacaacttaaaacgtaaaagttctttggctcgaaaaaaaatgtgaaaattcattaaaatgaaacaatttactctcggagtatcaccaacaagatatatttttcttgctgcatgtttaaaatgaaacagtttactcttggagtatcaccaacaacatatatttttcttgcttcatgtttaccagcaaattaaccaccaacagttaactgtccggtggcaattcaacttacagttctctgtccaggtataactttagacacagaagacagtctgaggcacttttccttgttgtgggagtaccaaactaatgtattttcgtcctgcgataaaaaaaaatatcgtactttcatcctgtagcaaagagctgacattgattgcaaacgaacatacatatgaacttacactagaaagtctgaactcacgaatcttgggttttcccttccggctatacttgataagcttgctgcctttctttaaagtaataagggccttcagatttcagagaatgtgaaaaatagccaggatcaacactaaaaaaatctttagcggacaaatttgtgttgaggcaaaatagagggaaatgaaacaggaaagcattgtgtagaagctcacattatcatctggtgtcatctaaacagcaacaggtcaacattctatttgcaactcttgatcacctgaaactatgcagataaactaacactgagttatcagagagacaataatggattttgttttcaatgacatatatgagagagttgatgtggtttttgtgcccagggagacagagatccttcatcccgtttgctagaagagcatttcagacagcaacaaaacgaaaaacactgcaagcgatgtatatgtacacaaccttcacaatctcgatatcaaatgacaagtagcggccggtttgcttcatattattagtgctggataaaatgctcgtcctgttttgggattttttttgtttttttaatgtgaaaaatttcaaacttatgatatgtatttcgttgggttgcttgaaatttgaacgatacatatttttcaccaagaacacgtcgccacagatacacaaaacgaaatgtaaatgctgaatctactgcagatgggatggacatgaggggcagcgtactgttccttaccaacaaagaagagaacgatccgagccggcggcgcctaggagaggaggatactccggcggaggaaggccgcgtgggttcccgtgtccggtcgccggcggtgaggtcgccgatcgatgattgcgcatcaccggattcccgttgagaggaggacgacgaaaaaagaggagcagaaggaagtcgtagccaacaaatgaaagaaaccaaagcaatccaccatgagggaagagagagaggagaggagggttcagcggcgccggacgcgggagacgcatcatgcattcacgcatggatggatggatggaggagaggagggcgtgtgagtgtgacccttggttgggttcatctccaactccaacaccaacagggcgctagatttctttcgagcattaatacacgtactattttttttttggaagtgactgcggatcgggcgtccgattttagcttccacccacgcatcaattgagatttcctaccgtactgcagacgacctgcatcccccacgcatgcagacgcaccaggtgcagcccactacatgcatcggaagccatgcatccatactagaaaaacaataattaggttggtttaagtttattcgagcaaagtttaaactattttttctcttatattacttctccaattcacgattcgattgtagcatgacacatcagtaagaatttagtaagaaaatgctaggacgtatagccttctccatttctttttgcctttggattgatcatggatggctgacaacagtccgaaactctggatactttaggacatctccatcctaaaatattactcccttttattttatattataagttgtttgactttttaataatcaaacttaatattttctatacaaaataaatatattatcaaaatatattcaatgttaaatttaatgaaactaatttggtattataaatgttgctaattttttctataaacttagccataaaaaatgactaataaaaaagtaaaacaacttataatatgaaacggagggagtacaactacaatctagtatatcctgattcgttgtcctaagatgaatcaaatctcatcataggttcaatattttgggacaaaggaagtattgttttgctatacattcgccgacaactttttccttaaaatttgtcaaatataaatagtataattatgttgtaatttgcatgtactttcatataatttggtttgaactcttcaagatttgtgcaagcagagaaggaaaaaaatcacatagcacaggcacggatgaggggatttggtccccaacctacgccattgcagaaatagcgttttatgatgggatttttaaaagttacatccaagctatattgcagttgcaggttacaatgtaattgcaatgtgattgtcctatatttacatctcacaattttctgagagaaatattatcaacaaatatctaggtaatcccatgacagtttactccaactgaaaatcattaaattttaaaccagcatggttcatgcatgtatgatgtgccctataagcacatgtacctccaatagattgaaccggtatatattttgagattgactaagccatcacattgctttattgtgatgatcttccgagaaccaatcctccttttatgaatcaacaacaatgggttgctcttacacggtttttgttttgtttgcacgtgcacacagaacattcagtgtttctaagaagatgctgatggagcaccataatctatatagagctagcatagaccctgtttgaaaagtttaagattttaaaaatcaattgtttggcaatcaacttttaggaatccagaagaaaagcttggtttctcagcctttgttttctaattaattttctagattgttagctacagattatcaaaagttgggtgagaatctaaattgtttggagagccaaagttcagacgactggaagctgcagctgctataatctcatggactgtgtgtatatcaggtgactctgttgcacaaaagttagataaacttttggatactcgtggcacgcttttcaaactgctaaacagtgtgttttgtgtgaaaactttatatatgaaagttgttctaaaatattagattaatccatttttcaagtttgtaataattaaaacttaattaatcgcacgttattaccacctcattttgcgtgaaacacttaatctttatcttcatcttcatcttgagaagattcaaacaccaccaatgttggctattgctattggagcagtaccatttccgcagcagagcttacaattggattttcacaggcttaaactttcagccctccctgagaaactggaggtgagaagagaaccacgcacattgctccataatctgaaccactattgcccgcatgtttatatttcagaaccttggtttgcacattttccttcaataatttctctgtgatccagtgctggaggaaacgcgaactgaaacttaatgggccattttgacatcaggctgacgtaagttttaatccaagagaaatcttgtttgttttatggcacatctgttactctttttaaaaaaatgatctggaagctatgatcaggaatattctaagagttatcgtcaactcgtacaaaagcctcatctttacttatcagccaaaaattaaattttcaaccttaaatttagagtagattttggaattattttttttcatcatagttcattttcagcttttgcttttaattcgttaagaacacatatataaaagtctcattcacaaaatacttttagagaaaaggcagacgcccagcttttcataaagcataacagagagtacagaatgctggggtttccagctttacaagaagcaacacagttcaaaataaaaggaggactagtgctgctggcatagccaaacaagctagagataaagcaaagaaaacaagtccacaaaggaagcagctttaagatcagaacgtcaaatcttctatttttgcctaagcctagctgatcaaattgtgaatatacacaaaatactttccatttgtaaatatactgtttcactttttcatctttatcagcggtttcgctttctcatctttatcagccaaacgatgaggctgaatgtctccggtcaatgccaatgagaactaaatgtgagctcgcgcgagggcgcttcgccgagtcgacgagcccgtgttgcctccgtcgccggccaccaaaacggcacgcagccccgcacttggcatttgactcactcgggtcgccgttttttgagctttcccctgcgctcaccaactgctaactgaagctcgcctgcagcttccacttgctaatttgctatcgtgtaaaaagtttcgagcttccgtagacgagaacatggcacagatccatggtctattactattaagcacgagcttacaacattaatataatctttctagtagcttgactccgtttggttctttggatatgttcatatgtactttgctgaacagtagtgctgtacagtttaaatagactatagaaagatctcacttctgtgcaagttgtgctgacttggaattgcgtttgtcgaaatatgttctttgttttttgtttttttttcctttatccacttgcgagtatgagtcaattcagttcatcattttattaccgctggtgcaccactgcgtggatcggaggaggcggctttgtctgaatttctgaagcctccaccagagaataatactgctactgctattgttaccttccaagaatgacttggaaagttctgaaacgggaggggctgacttggaaaattctgaaaggaagaagaagaagatgatgatacacctgacctgcaggtggtagctgcagtgcgtcacagccgtcgtcaacgacgaagcctgccctgcgtgcaatcgaattaagcgctgacgcaccacgcagcttcgtgccaaaacatctagttgttcgagaagcctgaatcttctctcgagagacctggaattcgaattgttgtcttcagaactctctctgaaaactggagtctttggcatgcagacttccaccagtccagaacttattcagataaattaattgtggaaactcaactaacttctagaagtcaaatttagggtgatagttttcgtcaaatagaagatctcattatccattttctttttctgcagcaggatgctgactttaaaatggatcatggaggtaacccagcgaatacagtttagttaggtgttcctgcctctgggctctgtggcatactggcaacttgtacacctggatatctctctagaattatgcagctggcatggccactactataactcctatctcccttgctcttcaagaaacatggagaaagttcatgccaagtagtactacaactacaaggttgttcatagcatcaaggtataagtgacaatgacacatggcgatgcttttgacagtttttatcagatgttgagctggcaaccgaattactgaatctactactactctcagatgtagtagaagtgtagatgcagtgatgcccttatttttcttgagaggcactctgtaataattatgtaatggaacataaaaaaaaaagtttgaccagtacatgtatgaacacatgttctaccattacagctgaaaattattgcagctgaaaattttagctagtcaagtggtgttcttaagaactgtaccactagtactaaactactaattctgtagtaattcatgcacaagatcatagagaaatatatatgattaatttggtgccaagtaaaaaaaatgttgtggtagttcaagtactccacaaacaattgtagggatctagaaacaagagcaaacactccactccaagacggtaggcagctagggaaatctatctatccatccagtgtacacctgtccggggtgaggtaatccagagattttggccaagtgtcacccctgatctgcatcatcttcatctccccagctttcctgcagccaccaccaacctgccagcaaacgtgcacactaccaccacatcgtcgccggagcaacagcattgcagcagaagcacttctcctcggccgccgccgccgccacttgtaccgacggcagcagcaggaggagacagtgatgttgctgcagagacggtgaattggattcatgtctagattgagttcagttggttgccacatttggcggcaattggatgaaaaaggttgccattggaatgggattatgcagcttttgttgctgttgctttgagtttgagattgttgtgtatacgggtagtagatgaggagatgtggttgaacgaattggttttgtggtgagttgtcataaaggggggtcacggctacagaggctgtcattttcatgagttccaacgaacacgtctcagttccagcagtaactgaaatggttatcactggttctgaaaattcagaggtttaggtctacgttccatcgttctgaagaattaatgctgatgccgctgccctcgatttcacatttttggaggtttgaagtttcagatttgtagtttgagtttgtagtgttatcagatttgagtgaataaaatcgaaaaaagaaagagaaggggaggaacagaggcagtcaggaattggaggcaataattttacttttctttcatcagaaacatcaacatgaagtacaattgggtcactagtagtaaaatctaaataaatatcttggcggagctgttcatccacaaaggtatcaacagttcgtacattgtgcacgagctcatcatcgtcatcgtccacgtcagcatccattacagcttccgatctttcatcccaagcactcgcgtagctcgtcgtctccaaagccggcgaagccaccggcgattcagaaacttcgctgcgcgtctgctcggccggcgtttcagccgccgcgatgggaagttcggattggctgctcatgacgtcgatccagccatcgtctgattcccaatccggcacggcagagcaggggacggccagcgccatgatcctctcggcccagctctccggcatgtcgtcgtcctcgtcgtcggcgtccgactcccaaaatgcggcatccagcgtgctcttgggagagacccacttgggcttcgtctcctcggcggccacggcgcggcatccggcgagcgccaagaacggatgctccagcagctgcgcggctgtccaccgctcgccggcgcggcgcctgaggcacttgtccaggaagtcgttcgcctccggcgacagccactcggggggctccggcacggcgtcggtgaacccgatcaggcgcacggcggcgaccacgtcgtccacgccgctccagggggcgcggccggtggccatctcgatgacggtgcagcccagcgcccagacgtcggccgccggcccctgctcctccccgcgcgccacctcgggcgccatgaacgccggcgtgccgccgatcggcccagccgagtcggcgcgcctcgcgcacccgaagtccgcgagcttggcgcgccagttggcgccgatcaccacgttcctccccttcacatccccatgcaccatgcccaccccatggaggtacgcgagcccgctcgcgacatccgccgcgtaagcccggacatcgtcctcctcgaggcggcccccattcctcgcaacctcgtcggcgagcgacccaccgggggcgaactcgagaagcagcccgtactccccgccggggacggcgccgaacccgaagcaggggagcacgtgcggcgagcagagcgaggcgaggatgcccgcctcccgctgcagttgcgccgcccccgccggctccgccgcgacttcacggcgagcagctcgtcgtcccccgccgcgatcagcgacaccacgggccccgacgccccgcgcccgagcgtnctcacccttcgtagactncgccgccccgccgccgccgatgatcatnacccgccgcatccatgccactatcgattgaatttctcctctggctatgtatgtctcggaatttttttttggtttttggcctggcatgaccgcagcgagcgcgcgctacttatacgcgagttcggcgcgagttgtggcgcgccgaacgcatgggcgcggcaaaagcacgtgagcgaagcctcgtgcggggtagagacactggcgtgtggggccatcctgatcgcgggggggccacgtggtggtggctttgggtggaacggaacgtggaatttgcgcgcgaggcaagtggaaaacgagggagaattgcagcacgagaagggattcggcgtgtcggtttggggttttttcgcccaaaaactctggtggattggggaaacgtgttgcttgcattgacggatcggggctctttactatggacagatgttactactactacacaaatcttgggtatctgggtttggcaattggattagcatgacagcaactaacaaaaaaatcggatgttgggtgcaactatgcaacggtggctgtgtactggagaatatacgaagaatcagcaaggaaatgatagtcgaaactcgaaatatgaaattgatttcattagaaaaaataaacaaacatggaactgtgtaattttttaaaaaaatgttgggtgtgagggttgcggactggcggtgtactctagaaggagaagaatgagccgggaaatgccagttgaaagtggaaggatccatgcagttttggtgattgggtgaagaagtatatacccttgtgtacagagaaattgcatgcagttttgcttgaagatagatatactgcgtggagactatctaaaaggcaaatatagtatcgcaaaagttatctcctctttggaatgttataaacaatcaatttagttaaagaattctatataagatttttatttatttattttcaccttgataggtgtgttcggatgcacgttttgcagccgctaccacacagccacacaactgcttgtagtgacacaaagtagtgtgcaatattgctatgtcacagctgaagtagtgcagccaaacatacctaattttggtataaggatcatgaagttacgtggaggtgcgaaaaaatattgacacctagtcataaatttcttggcaagtatacgaaacatgaaagtatagagctaacatgtaggtcataatgtgtatatgtggtgtattagaaatttacaatttcattggccataatgtgtatacgtggagacgccccaaatcctcaataatcatatgagtttcgatgctctaagttaatccttttacataaaatgagaaatttaatccttcaattgaattgacgggattgtgtgattttattcgaggtgggactgtcaaatgatactactctattaatggttgaatttaaaatcttgaaataacagtgcttaatttatcctacccaatgcttttaacaacgaagtaaatgctttgttcattttattgttattttcaatgttactaatatttagcacgttttggtgttactaaattttggtatcaacgtttagtttaaagtcttaccaaatattgattgaggttttgagagtaagagcttctgggttttctaattttggcatggtagcaatggcaaaaatgtgtttgatttgttgccttactaaaatttagtaatgtcaaaattgatagagttaaaaatggtagcgaagtgaacaaacttaaaatgataaaatcatgttcattgcattacccactaaaattgagttgcttttcggatctgcttccatcaaatggtatacaactcttgtcaattttctcagattatgcaagtatgcaccagcgtagttgatccaacctcgctaccgccccagctatatctcttttgttttctggaccgatcacttggctgcatttctgccatctggctcacgttccttcggttcccatctaactctctctctctctgtctctctctctctctctcttcttgaacgtggcacctgtgcctgtacgcgggcaaagtgcaggttggtaggttcatcagttcacggatcttcttgctggggtcctgacaagtgtgaagaagctgcagcgattgtttgttgctgctcactgttttcctttctcatataccgtgtgttttggtggtgtgccaatttttttaaagtatatggacccatatttaaaatattaaacataaactaatagtaaaataaattatagattccgtctgtaaactgcgagacgaatctattaaggctaattaatccgtcattagcaaatgtttaccgtagaatcacattgtcaaatcatgacgtaattaggttcaaaagattcgtctcatgatttacatataaactgtgcaattgattttttttcgtctacatttaatactctatgtatgtgttaaaacatttgatgtgacggaaaaatttaaagtttaaagaaaatattttaaatctaaacaggccatagtagtagactagtataattcacatttgtccttcgcatcatcctcgtggaaaatattaggcattgcaagaaatgaatagcaacatcctgcaattatcatgccggaagcacgcgaggtagaaggtagtacgactggaagatcagaaacgcgaagctgtgggcttcaaagagaacgcataagatcattgtccaacacagtacacacagtaagaatagtttataggagtgcttctgagaagtagtagcacatgtcctaaacactttgtgtctttgtcggtgtatctcctctgacctacgatcgatggtctctcgttttaaaaacaataacgaatttgatttttgaccagcgagtaatcaaattcccccggctaattaaacaatgggagccagccagccagccagggtcgccagtgtgaagtcagcccagccgagtcaagtccttagcaaaatctcgctcgatcggtggtttctgcccgaacagctgcaacggagagcaataatgaccatctggctggctgagacgagacgaaacgagacggtgcgatacacgtagccaatgcctatccagttggcacgccggcaccgcgcgcgccggtggcctaacgatcgcgcacgcgagagcgagacggtggggacaaacggcaaatcctacggagaaacggcaaaaaaattccagatgaaaaacgcgcggttttggtgggttgcacaagcgatcgaccgcgcacacatggcgcggcccggttcgccgcctcatgattggccgtttggctttggctcgtcgcgtgagtatactactagtagtaccactattatattgctgatctatgttggctgccatattttgacgccaccgaacttaattaggctgagctggtgattattttggttaattagttcggtggtatcatggggtctaatgattggaaggcctgtattgggacatcaatttggggtttggatatttgtatctagctcgatcaattaccggtcaagttagaatattacaacgtaatttttgacttgggtttgttcagataactacacaccaagcaagcttacctaactagtgccaaccggcttgcaaccaaacccatcccagtccgactgtgcgtgcccaacaattgtcaccaccgttttgccgcatacctaactcatcttgcacaagagatagtataaatcacaactgtcatttgccccaatcatgtttaagctaagggaatattctatcagatgcactaccactacaggtctagtactagtagtagtacttggttttgcttggctcccaagaagattttggctacagcctggaacaataaaatatctgtggtgatgatcctgtcatgtcatgtgagataacccctccgcgtaaaagagctctctctctctctctaatcagtcattattacgccaattccatgagctggttttaattgcgcagccaggacagcgatcgatatgcacatccgatggtccggaagatctctccggacctttaagattccttcactcgatcgatcgatcgatcgggcggccccgttgcttgaaagggaggagaatggcggcgaaagcaacagaaaagcacaaagcgtccagaaagcggcacccgcacaccctcccggaggaaaagaaaaacgaaaaaaataataaataaatcagcaaccgaaagcccgggccgcgcctcgcatcgcactgcgctgctcgggttggcggctcggcatctcgtccgtctcggcaaccggatgagaacgagatgatgagcacgcacggcgaggaggcgcggtggtggtggcggtgagatgcgcaacgccacgccgcgccgcgcgctcggctgcgcgtggactccacacgcacgtacgtactccgtcgtggcgccgcggtgccggtgcgggggaagtggcactgtggcccaggcgcccagctcgatggcgtgatggcgtccacagctttcagggttgtacggctcgcggtggcgaccgggattgtgttgacgcgcttgcggagacgccgaccaaatccaaaccgggcgatttcgatcgacgtatgcgttatgcgtggatgacgctggctcttacgtttgcattgcgggtggttaattaacgagaggggcaatctatcaaacgtctgatatgcaactacctctctgtagttaaatgtatcgcctgggagtactatataatcatcagctggtaagcaccatgacaccttatgttaatttgatttagaatctgcgatttaacaatcttatctgtaattacttgtaagtcgtaagaagtactctccttgatttttaatgcacggtaacatttactttagaaatatgtttaaccattcatcatatcaaaaattacataattatcatatatttgttttgttgtgatttattttatcactaaaaaaattttaagcattatttttttattttacatataatttttttaataaaatgtttggttaaatataaatgcaaaagtcaacatcactacaaattaaaaaaccagagggagagtgttgcatcgttgatttcaattgctgacggcggtccaggcacgatgagcatgtgtaatgttcatccatgctctcatgctaatccaatcgatcactgttctacttctacccgccaaaaatgacgggcataggacttccgctcaaatcgctcgcttttgtgataaaacgggcggcggcgtcccgtacgcgtcgtgtcatcgcgtcgactaataataaaatctacacggagccttttcgcagtcttgcaaacatcggaaaagctaaaagcatatgggcgtcaaccgttaaacccaccggaacaccgactccgcctcatcccgcacccgacacgtacgccatccagaagcgcacgacgggatcgaggaggagtccgcgccgcggtgaattgcacgtagagagagagaggaaaaaacaacggggggacgaatcacgaatcggaccgtgacaccgtcacaccgaagttggcagtagtagcatatcccgttcccatgccggatccccaccggtggaagcaaccgcaacgacgcacgcacgcacgctcgctcgcagtagtaggacgcgacgcttacttgtaaaatgggcaccttttgttaactccttttcttcggttcttccccttgtgcgcctttcaccgtcggctcgctctctctcgcctttgctgaatggacacgggcccatatgctgctgtctgtgctgccgcggcgccacgagaggccgaaggctattgaccgcgcgcgcgcgcggccccctttttgcgtccgccctgacgctgcgctgctgcgatgcgctttccgtgtcgactcgactcgatccctttcgcgtcggaagcgaagcttcgggcgtgtgtatgtgccgtggtggggaagctgaactgctgaagctgatcgatttctcattcctactacgcgggcgcagtgttgcacttgcagagcaagcaagctgccgcgcagtttcactcccgcacgtattggtcaccgcagttaattttggccggtaaattcgcggacacgtggcgcgataggaggagggcagagactaagggtgaggagcgtatgaacagagcagcgaaagggggagaaaaacatttgtgaggagaaaacatggtatgaattcaattgcaatgtgtttgttacaaaatggtgttttacatagtacttgatcgaaaactaaattcgaaggggaaataatgtgctgagcattggcttctcccacattgtgggtggtgttgccattgccgctgtccacgtcaatgtggggaagctcgaattctgcggttctgatgtcgccgttgaggtcagtcgtcgtctcctcgtcggccggcgaggtggtggtctcgcaggattcttcggtaggggtggagatcacatcgatccagccgtcgtcggagtcccaatccggcagcgacgaggcggcgcaggccagtgaaccgatcctctcggccgtgctctgcgacagctcgtcgtcttcctcctcgtcggtgtcggactcccacaatgcggcgtccagggtgctcttgggggacacccatttggacttcgcggcctccggcttgccgtcgccggcggcggaggcgacgaacgggtgttctagcagctgcgccgccgtgctccggtcaatggggcgccgttgcaagcacctggccaagaagtccttcgcgtcggcggacagccaaccggggacctcggggacggcctccgtgtagccaatccggtgcaccgccgcgagcacgtcgtccatgtcgctccacggcgcgcggccggtggccatctcgatgaccgtgcagccgagcgcccagacgtcggcgggtgggctctgctcctccccgcgcgcgaccttgggcgccatgaacgccggcgtgccgccgatcgg

SEQ ID NO: 5078 - DNA, 2283 bp, Oryza sativa
agcccggccatcaccccttgctcccgcctcagggccgccgcgcccgcggcgcccagggatttgacggcgaacagctcccccgacgcgtcgtccgccgccaggaacacctccgccccggacgccccgcgcccaagcgtccgcaccctcgtccattgcttgctcaccgccgccgccgccgccaccgccaccgccatctttccggtgatgtgtcgcccgccgccgccgtggtggtttctgttggttccctctttgtctcgagcttgagctaacttgtggcgagttgtttacctgttttgtggcgggtgagagttatatatagggagagggggagaaatatagggcaggggagacttgtgcttgtggatttatttgggaagctttggaagtttggaacatgggggaaattcgttttggcgtgtgtaaaaagtgagggggattatgggaaaatacggaagaagaaaaagaaagcgtgggaagcaagggggattttttcgcgcacgcggttgctcgcggtgtggatggatggatggacgagcgtcgactccgttgtgccgtgggaacgcgcggcttcttccgtccgtctccctccgcgtcaatctcacctcctcctccgtctcgctactggttcaagtgttctgaaattttctttggcgtttttttaggtcactgggaatttacttgtcaaagtcctgggtcgttcgttcgaatacaggttttttttttggtgaaatgcaattggtgatttgggatgggaagcggagacctacgggtataaacgaattttgatggtcgaagtcagcgggtgcacctaaaaggcgcggcgctgtgggtgttggatgcagaatgctcttcgggggggccacggtgggtggcttgacactgtggcctgttgcgagtccaccacaggattgttttttttatggtctagcgccaccaacaccaggtttcttccaacctccatccaaattccaacagcttgttcgtatctagaaaccgtttttttgcaaagacttggaagatgaaattcgtttccacaaaaaaaggtaaacgcaccgagatacatcagctagatatacgtactccgtgtcttgttccagaatcaaggacacggttgtgaaggagtactgtgacagttaccagtattcaatactacagtacgttcattaaattcacccgtaaaaagcttctcacgtcggcggctcctcgaccggagtagtagtataatattcatatttttaactcctgatcatcggatgagtaataaattcccctgcttctcctcggcggcatgtgcgccgcgcgcacacatgcatattcccgcacccgttcgctgcatatgcagtttatgcacgatgcacaagctatccatccaccagccgcggcatgcatgttcactgcaccaacgtaacgcagagcatgtttggattagggcaagtacaaaaatagagatcgatatggactacgttaattagaggctatcacgttacaatagttaggacaatacggtctctaaccattaatataccaaaatactttcttactagtcatctttcctttattagactcaacgcaacaaaaaaatttcctaataaatattaagactcgactctacgccgttgtcatgcgtagcaaccatctttctctttccttcttcctctctttttcacgtcaccaaatattcttgcatgacaataaagagagaccgctaacaaaaaccattgtacataaccttagtgccaatttgtgccatgtcaaaatatggtagtttcaaatagtcactttgatattatttggattgtgatcaatttttggctgtgtttagttcgtgtgccaaattttttttaaagtatacggacacacatttgatgtattaaacgtaaactaataacaaaataaattacagattctgcatgtaaactgcgagacgaatttattaagcataattaattcgtcattagcaaatgtttattgtagcatcacattgtcaaattatgacgtaattaggcttaaaagattcgtctccgatttacatgcaaacagtgtaattggtttttttccacatttaatgctctatgcattgtgcaaacatttgatgtgacggaaaagttagaagtttgaagaaaaaattttgaatctaaatacagtctttgcctactccctccgtcccaataatataataatctaggattggatgagacatttactagtactacgaatctagacatgcgctaactttttccatcatattaacctgtcctacacacgtaaactttcaatcatatc

SEQ ID NO: 5079 - DNA, 1195 bp, Oryza sativa
gtggcgtggcccatgccctgcgcctgcgcgccgaccgaaagtggtgcgagcgagagcgcggcgctttgcggcgcggggcggccaagcggatggatggggtggacggctcgtcgtcgcgtgtgaggagtcagatgcgtttgcttgcttgtccagcgtgagatcaccagcgcgcgtgcttgtcctcccttgccgccgcctgccttgcgtcgatcggtggcccggtccctccccttttcgccgcggtcggttgattccctctcactccactccacttcaccgccgagccaagcaaaagcaagaatccaacccctttaattttgccgtcgttcacgatacagattgccgaaaattctaccgttttcggtggattctacaaaccaccatgccatggcacaccgtttgttcccaagagaggaaaaaaaaatacagccgcggctatgtagctactgttcacggatcatgtcgtgccgggaactgaaaatctatatatgtttttttttctcttttacaagacaaagacgctgatcgggatatcctgattctgattcaggcttgcatgatcagtgagtatatagcacacagattatacgatgagtaggatgcagctagcgccggtgctggcagcggcagctgctcgaagcctttgcagagctgcaagcgcgtcagatctcacggtgtgaaaaaagctagcggcgttgttcagacggctcgtgcccatgaaaactgaacattttgggatccaaaaaaacctgcctttgcttcgccgaagtcaaacagcaaggatggcaatactctcctggatttttcacattttggtccttttaaaaaaattatttcgtaaatagaccccaagaaaaacttcttctaaaaatggtcctttttgggcgccagagtggctggccccgtcgttcaacaggatggtgccagcctcttagacgccgtccccctgccgacgtggcggggcgatgctaaggtggctagggggagtgcgtcaaagtgactggcgccaccccccgaaattttttattcttgttttatttgtttgatatttttttcacgcttagggacacacaaaaaccaaccatagaaaaattgaactcaaatgaacgtaatatgtgacatgtagaatttttcctctcctctcctctcctctctttccgaactagtgcagaggagagagatgtgcaactttttt

SEQ ID NO: 5080 - DNA, 9280 bp, Oryza sativa
tcggttcgcgtgcgccacggtggcagaaggacgacgccagagaggctggcgccgtcccgctctggcgccccaaaaaggaccatttctgggataagttttttcaggggtctatttgcgaaataagttttttaaaagcgccaaaatgtgaaaaatccagcaatactctcaccactacaggtcaacctttcattacagtttcttgtttcttagagcaagtttaatagtatagcccactactagctccaatttatctatagccgatctaatagccaattcatacaatagttgcttactacactattaacatatgatctcacatgtcatatacacattgcgtcttggagtccttcctacagctggctacagatctgtagcccgctactcttctctctcatcttttatctcattaaaatatctcatcttttatcttattaaaatatgtttatagctggctaatagccttgctattgtacctgctcttacggtacaggacatcaaggctcatcaaccaatgattgcatcgaagtattttcttgtagaaaaattccttccagtcccagtgcaattccattgggcattccacttgtttaatccactattgcgcctgttacaatcatgccaaaagttgaagggccccttttcgttacaccggctccagctctgtagcaggtcaaccgctctgaaagaagaactcgtttcaactggtcttatccaagtgcacaagaactcagtttgccatttgaccaaaagcagatgtgcaggcatgaacgcgaaaactttgcagttgacgagtgatggatcggacagggatacgagagatcggccattgtgcgtccggtttgatctgcgagatcggtagggatgagcagataagaaagtgatggacacgagctctgaaagtagtatgaaccgtgtgtacggacaagtgacaccaatgccagcagagtgccactttggacgatctgttccatcctttttgccgtttagcactgcatttcaccgatcattggtgatcactctctgaattgtgctgtggtttcagcttcgttttcagctcgagattttcgaccgtgaattcttggtttatttcttgtggctcgcaagagccagaaggtacatatgctgtgtacttgtgttatgcctcactctgatctctgacgaaggtgagctgaaagattatgcttttgagggatttgtcaacatctgttgcttgacaacgatgcgcagtcgacgaaaaatgtctgcgtgctttacttggtgtttcagatactggcagagtcaacgtccgagttattcttattctgaaataaagggggtcaacagccgtcccaaaaagagaaggtacagggaaaagggcacctcgaacttcagtctttaggcaatggatgttgacttttgatgaggctgcagatatagtttattcgattaaagaagttgcccaaagtgaaaaaatgccatttgatattgtatatccacgttctttaggggaataattgtatcagcatcaatgtgagtgtgggtgatcatttgattgacgaaacaggaatccagtagagaagcgtatacatgggcttttggccaactccaccaaaatctttcatccaatcgtaattctgaattgattccggccagtcgcactggcattaaaccgttgtcacattgggatgttgaataaggcagttggctaaccactcacactcagcgtctctacctctgaagatcaagtgtttttctcttcttgagatgagtaatcaagtaactgattttgtcagattggtggtgctaagcactgtatcttgttcggtggaagcagttattgccttacactgaaggtcaatagtcgatagaaagttcgcataacaagtgggcgtataggattaggggtgaaatcgagccgagccgagccaaaccgagccgagccagacttggctcggctcgtgaaagcttgacaaagaataggctcggcttgattaatgaaacgagctaaaatagcggctcggctcggctcgtttcaaagctcgagctagcttggttcagatacaggcagcgaggcgatggatggcatcgacaccgtaggggagggaggcggtggaccggtggcgctggggatggaggcggtagaccggcggtgttggccgctggggatggaggcgacgccgttggggagcaaggccgcggcgcagccacacaggggagggagatggtgggctgtcggcgctgggatggaggcggcgccataggggagggaggcagcagaccggcggtgtagcggagggaagaggcgccgcaggggaggcaggagacgacacagcgcagtgcctcgatgtcctcactccctcagttcctcatgcagtcgcggcgcgacttcgtgttgaaggaggcgggcggactcgttgaaaggcttcagtggcggactcgctgtctcgcgtggtgggaaagggagaagaacggctggctatgcgtggggtgggtgggagattgggggaataggttagggacttaggatttttgatgggccttgggccacaccagcgacaataatgggctaggccatttttatgcaaaagcttgacgagctgaacgagcggcttgcaagctagcttgggcgcggcttgatttagaaacgagctgcgcaggcggttgagctcggcttgtttaggtttcaagccgagccgagcttttgcgagctcgagccaagcccgagcctgctcacgagcccaagcttttttgtccacccctatataggatagtaggatgaacttttgactgtggaatgctggagatatcatgatctttttcccttttttaccaaggatatttcacaagaacagtccgtgcttaaacaagtggaacattgtctcttagtagtccataatttgacaattacagtataaactgatttcattatatttaacacaagatgtagactcaataatccatattgaattttgactgttttgaaaaaaaaattcttatgaagtccccacgttccaaagtccaaaaagaacagcgtatctgacgggttaatgaaataaaaagttgcattaaccgcaaaaaaggaaaaaaaaagagaaaaggggaggcgctgccaaaagtactgtgccggactagtttgaggttgagaaaaatttaagaaatgccattaacaatcacataattccaagaaatgctatcaacaagtacgagttacataaaatatcattgtataagcgtatttgtcacaaaaatggtatcgccgctagggatctgttagcagctttcctttagtgatataggataaacaatacatttaacgtcacaggatggacggaaccctaacgacgatagtatttttgggacaaaatcatttgtacgatgatattttattaaacttgcactcgtcgatgacatttctttagatttgggtgtttgtcaatggtttttcttggatttttctctacaaaattatgtggtgacgctagtaaaatgtgccaccacagaatctcccatatgggctctcatctaactgggccaccgtctcttagcaacttgggctctctattgggctttcgcgtcgccttgatattgtagagccttcgcggactccggttccggattgctctgcgaagccgagccctcacagatagagaagaaaccctcgcttcgccgcttcgccggcgcggctggccggccgccaccggcgataacctcgccgccgacgactccgcatccgcttccgccgcagtccgccgcacccggtacgctccccttcctccctccctctctcttttttttggcggctcctcggactgaggccgcacaaaaccctagcgattccgcgatttttcttcgtagtgctgttctgaatcggtttggtttgggggtgatgctgctccaggtggggaatggcttcggcggtggagcggagggagcattcccggaggtcggggcgctcgaggtcgcgctcgccggcgagggaccggggctcgccgccgcgcaggagggagaggtcgccggctgcgaggagtcggtcgcctaggaggaggtctcctgttaagtctactagctcacatagggagaggtcgcctgttcggaggaatggctcacctaggaggtctcctgttaggagtattgggaggtcgccacaaagagatagggtgaaggagcaggtcaggtcaccgaaacagtcatggtcacggtctccgtcacctgccaggaaacgggagtcttggtcgccatcgccgcagagcaaacggctgagaagggctcagagtgagcgggaaggtgcagatgctactgagggtgaccgccggaagaccaccagggagcgtgatgagggaaaggatgtgtcaagggatagaaaggctgagagggaggagggctcttttaaggacaggaaactggattgcgatgatgatagggatcactcaagagatagaaggtctgatcggtcgggtgcttcaagggagacatggtcaagccgagattatgaagggcgtgattcaaggggtagaaggtctgatggggatgatcaaaaaggcatttgcagggagcaaagggcagatcatgatgatagaaaggattctgcaagagagagaagggcagaccgggatgagagcaatggtgaatcagggagatcatctaggcgtgggcgatcagtgtctccagaagagcataggcataggggtagacatgaatcccaatcccaccagtcaccgaggtcatctagaagtgcagcacgtggtgaggtgtgtaatgatatctgacccttttcttatacatatccacctgttagttggcatactatgttcttttgtttcatgtttgtcccttgttgctgttctttgtctgataacctgcacccaaatgaatagaaagtgaaaaaaattatgccttgttatcagcattgttgacactaaacttgtgggtctgtattccatgtaaacccttcttgcttcagagttcagattctagaggatataattagttacccgctatccttttcatttcatactaatgtggtttcttttcatgtttgctatcatatgtggcccgtaagttgcaacctaaactttgtatttgatttgtttcaggacttcatgccatatgacttctttgtgcagggacattctgattggaagaagtttaggccaggcttgccggaatatttgcctgaaatggaccgaatgtttgagggtgttgctgtggatggttccgcatcgtttgtggccactgccgaggagcctatagagtgtgatagctctgacgaagcggatggtgatgagcaagaggacgagctgacccctcttagtgttggcaacaaaaggacgagtccaagtaaaaagtccaagagtccagcagtgagggcaatggttagcaacatgagggagtacaatgaccttcaaaggagcaaaatcagcctaatgcaatccatgttgcaagttatgcaggatgtcgccgaagccaaacggaaagccgccgaagccgaaaggagagccgcggaagcccatatgatagccgccgaagctcaagccaacgctcatgagatgaagattaaaaaggtactcgagatggccggagtgtggggtcactccagaaggaagcccaaagctgttcatgggcgtggtcaacattacccagaatggtagcgcgatggatgcattcattcacacctgtccagcaggaaggatgctcatcatcaagaaatatgttgaggtcgacaactagtccatctcatgttctgttgtgtcattaattttaagttcatgtattattgtctgtttgttcaatcctgtgtatgattatgtatgtgtgtactatggttgtgatgtctgttatatgaacattgttatggtactaagtgtgatgcacttttaatacattgctgatttgaactatgtgctgcatggctgagatttatttgcaaatgttttgttattctttactaacataactcattgtttgctttgacaggatgcagggcagtcgttgtcgtcatcattctcgtcgcggtcgtcgttattctcgtcattctcgtcgtggtcgttgtcagcatcccacaatcgtcgtgctcgaagacagcgcatggatgaagacttaaacaagatgatgttggacttgttggacgatgatgacgaaggtttcttccacgttatgtttcagtatgccatccacattgacaagcatttgactagagtgagtataggcaacctgccttgactgggttgtaatgggtacataataagcttggggatagaaaggcatgttataacatgtttagaatgagtccaactatgttcctcctcctgcatgacctattggttcagtcctatggcctaaaatctagtagcaaatccacctcggtagaagctcttgcgatgtttctttggatggttggcaccccacaatcagttaggcaagctgaggacagatttgagaggtccatggggactgtaagtagcttgtttaacaaagtgttgcagtctgtggtcaagcttgctgttgatgtcataaagcctgtggacccgcaattcagaacaatgcacccaagactgaggaaccgtaggttctatccctacttcaaggattgcataggggctatagatgggactcatgtcccttgcgtggtgccaaacaacaagttcatgcagtacttgtgccgcaagggcatgaccacacaaaatgtcatggctgcatgtgacttcgacatgaggtttacatttgtactatctggatgggcctggttcggtacatgacatgagagtatttgatgatgcacactcaacatacaaccatgtgtttccacatcctcctacaggtatagtgttgcattgtacttcattttgatttgttagttgtagaatgtggcactaactgatgtttcttgctgtaggaaagtattaccttgtggactccggctaccctaaccggccaggttaccttgcaccttacaagggaaccaaatatcatctacaggagtatcgagacagccctgaacctcaaggtaaggaagaaaaattcaactatgcacactcatctcttaggaatgtcattgaaagatcatttggagttttgaaaatgaagtggcgcatgttggaaaaaggtctctagttatgctcctaataaacaggccaaaatcatagttgcatgctgtgctctccataacttcattagggttagtggcatacgggataagcactttgatcgttgtgaccgtgatgagaactatgtgccctcacaagctactgccgatcagcctgagacagaagaagtgtttgatgattgcgatccgatgaatgcatttcatgattccattgcactttgtttggttaaccgttcttgaaagttgtttgtaaagcacaaacatggttatgtactgtaatgcttgcgactgctgtgtatgtttgagaacattttttcggttcctattgcatgaataattgtggtttcacttttttgctgtgattatgtatgccatgttcttgttgttgtatgggagcaccaacagcaacagcagaagccgaagcactaggttcactgccagccctccctctgcatctggatgattgtattttgtgaagcaacagcagctgtgggattgaccatcatgttttgtgacctgaatacatgtgatggttgtctgtgtgattggcattaaggcagcattaaatatgggcaaatctggaatcttgtgtttactgcttgcaaaccttttgccaaaccttgtgattcactataggccgtgtttagtttcaaagtttttcttcgaacttccaactttttcatcacatcaaaacttttctatacagacaaacttctaacttttccatcacatcgtttcaatttcaactaaacttctaaatttggcgcgaactaaacacggcctatgtaactatgtaactgattctattagtgtctcagtgatctttatgcttatctaagtaatgattattcatggaagatttgtgagagctcgtgttgatttggtttgtaagattagtgatatatattacctatttaattatttttaatttgagtgaatcgcctatttggtgcaatattcagatatatattgcatataaaaatatccctactatttgaacattttaaaaggaaataattgtgtgatggcacagctaggagaaatatattaaataaaaagtccctacagttttagaaacataggggaagtcactttacatgtggatcacaaatgccatgtaatgtggatcacaaatgccatgtaagcaatgttccctaccatttcatatcctaggaatctagcttttatagctgaaatcgtagggcacttttatttccccacgaatatgttcccatggaaggtttccctacgaaaaagtgtagggaaactgtttccctactagtttcaggctgttccctagcagaaaaaacagtaggggacatggtgatggtgagttctggtagtgattgacaattacagtataaactgatttcattatatatatttaacataagatgtagactcaataatccataatgaattttgactgttttgaaaaaaacatttcttatgaagtccccacgttccatagtccaaaaagaacagtgtatctgacgggttaagtgtctcaaattcttcctttccctagtgaaataaaatgaaaagttgcattacccgcaaaaaaggaaaagaaaaaaaaaaggagaggcactgccaaaagtgttgggctggactagtttgtggttgagaaaatccaagaaataccaccgacaatcaaccaaatccaagaaatacgatatatgagtgtatgttccataaaatatcatcgtacaagaggattatcctagaaatgctatagccattaagattctgttagtagcctcccgttaaatgctataggataaacaacacatctaatgctgcaggatggactgctaacggaaccttaacggtgatgacatttctaggacgaattcacttgtacgatgatatttcatagaactcgtatttattgatggtattttttttgaaatttggtgcttgtcatttcttggattttctcttcaaaaggaataagttcactttggggtcctctatttgtcgcccggtccgattttcgtcccttgaccgcaaaaccggatacgacccgtcccccaacttacgaaaactgggcaaacgaggtccctctgcggttttaaaggcgggtttggctgatgtggcacctacatgacttgtttgactagttctctgtcccacgtggcatttgacgtggcgcttacgtggcaattatatcttgaaaaaataataaaaaccatgggc

SEQ ID NO: 5081 - DNA, 8542 bp, Oryza sativa
gcgcggcggccggcaggagaggaaggggtggtgggaggtggccctggctgccgcagtcgttgagcccacgggcgtcgcgctctgcaggcgagcgtgtgcagaggagcgttgactcggcggtggggggagcggcccgcggcgtcgtcgtcaggtgcgtcgctgtccgcggtagcgccgccgaggcgggcggagctgccgggtgccgtggctgctgcagttggccgacttcctccaccgatggggtgtcgacagccgggcgggcgcggtcctctcttgcgtcggcacggcgggagcgggagcgggagcggcaacaggggaaccgccttaccccgagcggccacggcgagtcagggaggtgggcggcgccaccggtcgccgggctgcggtggcggctggggtcgtgtcgtcggtgggcgcgggcggcgagaatgcggtggaacatggggtggaggaaaagggggagagaatgacatgtgggcccacgtgggccccaccttttttataatttctgtgtaaaactgacatgtgggtcccacaaggtttatttatttttcaggtttaattgccacgtcaatgtcacgtgggacggagacctagtcaaacaagccacgtaggcaccacgtcatccaaaatcaccgagggaccttgtttgcccggtttcgtaagttgggggatgggtagtacccggttttgcggtcaagggacgaaaatcggacggggcgacaaatagagggacccaaagtgaactttttcctcttcaaaattatgggggtgggaataagttcatcttaggtcccttaacttgtcaacgaatccgattttcatccttcaaccataaaaccaggtacaatgggtccctgaactatcaaaaccggtgcggattaggtccctcggcggtttcgatggcggttttggctgacgtggcgtctacgtggctagtttaactcggtcttcatctgatgtggcattgacgtggcgcttacgtggcaatttgatccagaaaaaaaataaaacctatgggacccacgtgtcagtttcacacaaaagaataaaaaacaatgggacccatgtgggccccacatgtcaggctaactcaccccttcccatcttcctcctctccccagctcccctctcttcatctctcttgcgccagatgcggatgggatgggcaccaaaggcggccgggctggtcctcggcggtgacggagggcagcacaggcgcctccccccactcgaccgcgccgctgcggagctccacccgaacggcgacgtaggacacggtctccagccgcgacgacgcgatggtgaagggcgcggccaggggcacgttcagcggccgcgcctcggccgccaccacgtcaacggagaaagtctccttgagggcatcggacccgaacgcctccgccggcgcgggcggtgtcggtgacggcgagacggcgcggaggcgggtagcgccggcgggtggttgctgcctgctcacccccgccgccggtgccgggcgattgcagcaaggtaaagggaggaggaagctgccgctgcaacagggagggacggcgcagtcgctggacctcctgctgatccagttcctgatgcccgacaacgacgcgtgccggcaggcggaggagcagacccggcggctggcgtgggacccgcaattggtgccggtgctcgtggatacaaagcagcggtggagctggtggttcatggccgttgccctctcgatcttcacggccttccatgtacggtgagggggcgcagcagctcgttgtccagctctccgtcttctaggccatcgtctggctcacactgctgctgttcgtgctcgaggtcaggaaggccgccatcgggatgtacgtcgacggcacctcgtcctccgacgagtcgtcgtcgacgacgacgacgccggccagcaaggacgtcgaggccagcgccggcgccgcatccacggtcgtcgtcgtcgtcgcggcgagcggcaagccggaagcagaagaggaggggtgattttgactgacatgtggggtcacgtggaccccgccattcttttattaatttgtgtgtgaaactgatatttaggtcccacggaatttattatttttccggatcaaattgccacatcagtgccacgtcagatcgtgatcgagtcaaattagccacgtaggtgccacgtcagccaaaaccaccatcgaaaccgccgagggacctaatatgcatcggttttgatagttcagggacccatagtatctggttttacggttgaaggacgaaaatcggattccttgacaagttaagggaccctagatgaacttattccctatgggccaccacagagtcttccatatgggccctcatctaactgggccgccgtcgcttagcaacttgggctctctattgggctttcgcggtcgtcttgatattgtacagccttcccggactccgcctccggttccggattgttctctgaagccgagccctcacagagaagaaaccctcggttcgcggtcgccgctggccggtcgccaccggcgataacctcgccgccgacgactccgcatccgcttccgccgcacccggtacgctccccttcctccctccctccctccctctttttttttttggcggctcctcggactgaggccgcacaaaaccctagcgattccgcgatttttcttcgtagtgctgttctgaatcggtttggtttgggggtgatgctgctccaggtggggaatggcttcggcggtggagcggagggagcattcgcggaggtcggggcgctcgaggtcgcgctcgccggcgagggaccgtggctcgccgccgcgcaggcggagcccgcctgctcggagggagaggtcaccggctccgaggagtcgctcgcctaggaggaggtctcctgttaagactactagctcacatagggagaggtcgcctgttcggaggaatggctcacctaggaggtctcctgttaggagtattgggaggtcgccacagagagatagggtgaaggagcaggtcaggtcgccgaaacaagctcagtcacggtcacggtctccgtcacctgccaggaaacgggagtctcggtcgccctcaccacggagcaaacgattgagaagggctcagagtgagcgggaaggtgcagatgctactgagggtgaccgtcggaagaccaccagcagggaagagcgggactcggggaggtacagggagcgtgatgagggaaaggatgtgtcaagggatagaaagactgagagggaggatagtaggggctcttttaaggacaggaaactggatcatgatgatgatagggatcactcaagagatagaaggtctgatcggtcgggtgcttcaagggagacatggtcaagccgagatgatgaaaggcgtgattcaaggggtagaaggtctgatggggatgatcgaaaagtcaattccagggagcaaagggcagatcatgatgatagaagggattctgcaagagagagaagggcagaccgggatgagagcaatggtgaatcagggagatcatctaggcgtgggcgatcagtgtctccagaagagcataggcataggggtagacgtgaatcccgccagtcaccgaggtcatctagaagtgcagcacatggtgaggtgtgtaatgatatctgacccttttcttatacatatccacctgttagttggcgtagtgtgttcttttgtttcatgattgtcccttgtttctgttctttgtctgataacctgcacccaaatgaatagaagtgaaaaaaaattactacctccgtacttgtaaaggaagtagtttaggacaatgtttaagtcaaaccttgggaatataaatcatgaataactctcaagttgagtttgaaaatgtaaaaattatacgaatagatttgtcttgaaaaatacttttataaaagtatacatatatcacttttcattaaatatttttatagaaacaagaagtcaaagttatgttttggagaccgtgtcgctgtccaaaacgacttcctttacgagtacagagggagtacgccttgttatcagcattgttgacactaaacttgtgggtctgtattccatgtaaacccttcttgcttcagagttcagattctagaggatataattagttgcccgctatccttttcatttcataccaatttggtttcttttcatgtttgctatcatatatggcccgttagttgcaacctaaactttgttttgatttatttcaggatacaagctctgtaacagatgcagcgtcacggtaagcatgcaaaactctatattcaatacgaattgtaaatttttagtagaagcattgcttgcaattgttttcttgttgtatcaatggggctacgcgtgttatgggtgtcataccctcttgctggaatggttttgaacttttgatgcatatcagcatatccgttaagcaactgtagcagtagtacctaaaacaaacaaatgtatatttgaccagctacatgagcgcaatgtttttgtacctgaaattttagaactgaaaatattatatttgatactattttggccaggagtgttgatcctgattctttggtgaagatgaatgctactgcagaagctctggaagcaaaagaaaaggtagggcatactccatgatgaaatttaaaataataacaatcttccttttgttgtgtacagtttatttatatgatgcttgctgttttcgcagatacaaaatacttgccatgtcagctttctttttatttaacctttctcttcatttgtcatacactagtattttaataatttcattggtgttttgcagcaaaaaccatcatttgaattgtctggaaagcttgctgaggagactaacagagttgcaggtgctgttttgaagccctatatctttctttttggtcatgaacctaaatgttacactttacattaatgtttgtttaaccaccaatgagaatttgtaattccttgttctttgctgtattgcattgtcctcagagtttgcaatttacttccatttcaggtgtaaatctgttgcattcagaacctccagaggctcgcaagtcagatattagatggagactctacgtcttcaagggtggtgaaccactcgaaggtagttattcttgacttgttactctatatatgaagctaacttttttccttttgtcatgctatctgttcgagttaatagtttttaataaatagaagaaaaaaacattttttggatttgccagtctgtagaggcatgttcttgtctagttcaacagctgtttctctatttcccttcccaacatggccaaaccaaaagtaggttctgttaaaagcagtaagcttaactgactgtgatgaagcgagtatggaacataaaaacattttcgaactagcttaatttcggagagttttggaacgaaccatttaacgtgagcaaaggcactaacgagtgggtcactatgatatgagcttgcattgaatcagtatcattatttacattttccccggggagtaaaagggctctttcttttctagagtaaggtcgatatgtgtacacggcacagccacccaagttaaatgcatgcgtgtgtgcacgtgcctaactagagtggaggtctagatctcataaaaggtgttcacatgctttgagaactaaacatgcccttatctgtggcttagttgtctagccctggggaaaggaaagagaacctttgttcaatcgatggatcaaacacaggaccattggtttgtaataatgaagcctgcctagtgctttgctattgttcagttccttacgatacactggcttgtgaatatatccaatgatactgtttgagcattggtattgtatggatagctcactagttttagttttgaacggaagtgaaataactgaagtaatgaagtttattgtgatgaacagcaagttaaaggttgggcattatagtggtataaattaaatgtgtacggtggtaaaaaaattcacgtgcttacattagtgattaaatacttcagttttgctcttcttgtttgactgtgtcttgtgatgctatcttgattgaacagaaccattatatgttcaccggatgagcagctacctttttggaagggaacggaaagttgcagacatccccacagatcatccctcctgcagtaagcaacatgcagttcttcaatataggtaagcatagcaatcttattgttttttgcctttactagcatattgcctgtgcgtggcaacaggattttaaataaagaaaattatcattaactcattattatcatcattttctgtgtatatcgccccttaatttatgtatatatttgttactgacatgtgcactgtcctattttcttctcacaaaaagtaggaagttggtggtaggggtggttgacatgtaggccccccttttctattccaaaaaaactagggagctggtggtggggtggtggcagattcaccactcaccatcaccactactcccttttaaaaggagtatagattgagaaataatattgtgattcactcatctctttgccttttcagacttgtagagaaggagcagccagatggcatgatgtcaaagcaagtgaggtactccttgctagtaacgcatatattttttttaataacaagtactaataattcatgattatcttagttctgtatgctagtctagattatgatgttttttgctgctttgtttgataggccttatctgatggatcttggtagtaccaatggaactttcattaatgtaagtcctccagtgatacttttactactaatcagatacactagtcgcatttctaataatattttctacccagtcaatatttatgttttgatttttttttcaggagaatcgtattgagcccagccgttattatgaactctttgaaaaggataccattaagtttggcaatagtaggtatgatcaattaaagaaagcatcacttttttgtttatttgtatattgctcaatgtatatgtatctttggtatgtgatgacttaaattaacaacttattatgaaagtgacagtctggcttttggcattctctttaattagagattttattttgatttgtggtactcttgggataaacattttttctccaataatctaagtaatatctttgtaaactacgcctaattgtttttctcaatacaatttccaaatgaatctttaggtggtatattaatgtttataaatatcaaggaatctcaaaatgtctacattatggaaacataattttcctttatggagccttgacttgcaagctcaatcatgtataaatgtataacatatgttcggagctgtggagattttgaagtttgcacacagtgccccttcctagttcatacggttttcatccttcagaagcctcatctttttgttcttagatggatggtactatttctaatccatatttagggcccttttgagtctagttgcccaaaagtaaatataatataatgatgatcagcctctgcttctatatgcctccttactaaccccgttcatctaaaatctgacaaatgttttattgttttttttgcagccgggagtatgttttgcttcatgaaaactcgaaagattgaggattgaaattgctggaaactttgctccattgttacctgagattttgacgtccctctgctgcttgttgtttgtactatggtttcagtcgcctgaatatttttcaagaatgcctgaaggaacatggcagaggccggtaatcttccgttacatttataggattctagagcctagacttgttttattatccagtggttgatctagtaccgctactgacttcatggttttgtcaaatataatgtcatattgtcactgccatatcataattataatctgcaatttgtgactagtgaaatgttggcactctaatctatttgaagtctgagaatcttgacacgagatgagcaataatctgatatagccaagcactgaagcagttctgttggctcagattttatcatttagaggtagccaggtaggggatactctagcttcattactattctacagttaagcaggcatcgagaaacaaagcaggtagcccactttgggcccaaaaaaaaaaagagagcatctttcgactgtgcacatggtagattgctagtgtataatgctcgaaacctcgacaactcgtcaactacacaaggtcagtggtttctagccgctatatatactgaccgtgttcccaaaacctttctccatccgtgtaccgattgatctgcagcaagcttcagcttgctcctgcatctatcgatcatggatagatcaccgtctcatagtcttctccttctcctctgctacctcctcttcgctcagccgttgcaagcacggatgctaggtaggcaacatagacgctttcactcgcatgcatcatgtgaaaaaagagagagagaggagtgcatttggtagctagtaatttgtcattcactgaccaaacgcatcacgcattgaccatgtgaaaaatactacgtataacaaatggtttgatagctaatttgtctgtctgttcttcactgacga

SEQ ID NO: 5082 - DNA, 5064 bp, Oryza sativa
  unsure (1)..(5064): unsure at all n locations
atgatggccaacctgcaccgcgacagcgtcccccaagccggcaagtatacacggtttagacgtttagttatttgttgtaaccttgatgttacaaggtagtcactgccattcgtgtgattggaatgccgttttgtttgggaaatttgagagccatcgggtgagaatacgaaaaacaagctaaattctacttattcttagggcctgtttgggggagtttttagctactgcagcttctcccagaatcagaagctcccctaaacagtctagcttttggtctaaattataagaagctgtagttgtagaatccagaaaataaaaagctagaagctgggaaacccagttttttcagattcttagaagctggcaaccagccagctgtttctcagaatcttaagctccctcaaacagacccctagttcatttttcagattctacaactacagattttcagaatctgggtaaaaaactggactgtttgagggagtttttggcaactggagattctaggagaagttgcagctactagaagctcctccaaacagacccttagaatctagatgaaaagctagattgtttgaagagccgaagatgaaattgcagttacaagaagctcccttaaacatggcctgattggctgattatgttgtcaattatcaaaactgtcagctcctcgccatcaggcttccaaaacctgctagtgactggctgtagcctgtagcaactagcaaccggtttgtggtaagtgcataaaaaatcgttgaatgctcgcatggtttgatggtttgaatgctcgcattaagattcatgtgactgcaagccaaaaatctcaccaattcacggccagatcgatcgcgatcgagtgagcgcagaagtttgacactagctccggtcattcacgcacgtgggttttcgcggttgcttccttgctgttgaacatttttttttctcttttgtaactaatagctgttgaacagttatgttgctagcaaccttagctcgcagagaaaaaatgcgtacggtagcaactaactgacaacatactgtcattcgtgctcctttcctgttactactccctccgtcccggattttgagtttttccatactacgtttcaccactcgtcttattcaattttattttgcaaatataaaaaacgaaaagttgtgcttaaagtactgtagataataaagtaagtcacgaataaaataaataataattttaaatttttttaaataagacaagtggtcaaacgttgcaagtaaaaactcaaaatctctcatattatggtatatatattatggtacagggagtactaaacattaacgacgactagttgatccaaattaaatatatattttttgatggttcagcaatactaaggctgtgtttagatccaaagtttggatccaaacttcagtcattttccatcacatcaacctgtcatacacacacaacttttcagtcacatcatctccaatttcagtccttttccaaactttacaacgatctaaacacagcctaactaacaaaaccgttgactcaccaatcgccacacacattgtcgacaagtacaagcgccgtacgcaattaaaccctacctatgtaaagagctcgccgcgagcgctgcatcttgcaaacacacatgcatacatctctcgatccatcgatcgaatcgatcagcttccttctgatctccttcattcccgccatggagagttcgtctcgatctccctgcatttgcaagctgctggcgatgctgatgcttcacgtngtnctgctcgctcctncgctggtccaagctcggccgctcgcgctctgacatggacatcgtctgctggagtcgtcgccgccggttataatgctgccgaccgacgacggcgaggccgtggccgccgcctcgccgggactggatgtgccgggacagctgggacgatccggcggggcgccgccgccgcctcagtcaaatcggccggggacaccgctggccgggggttacagcggcgtgtctggggggagggcgcccaccaatactccgccgtcgcctcaaccgggtgggtcgacgaagccgctctccgacgacgacgggaagccgccgctggggatcgctccgccgtcgccgcagggaaacaagccgcctatcacgtctccacgtcttcgaacaagcacggatcccccgctccggccgccggcgccggcggatgatgccgccggtttgctccgcctgatccgcgacgccgtcgaatacgtgatcggcgaactcgaagcctgatcgatcgagaccgaggaagaagatgaagttatataaactgtaccattaattaccaactgtatgaatatatgtctagcttaagtagacgagcacatgtgtatatttattttgcatgcatgttaatttcgtcactagctaagtaggctagcatatatatctatcgatcctcatggtagtatttcgaccttaattaacatgtatcttttcgatgtttcaataagtctgaaattctgaatcaataaaaactaagttgtattcagattggtgtcttaattataagtttgccatgatttaataaatttcaaaatttgtaattaataatatccggttgtacttagtttgggtctcacaattataatattttcagttttgataactttatagaatttgggattaatgcttattgtcgacgggctatactcgttgacgagatttgtagagtatactcaaatagttatagaaaaaattaaaaaaaaaatagtaacatcaattgtgatgatataagtctatacacaaacatgcatgactaaatttgatctataactaaagaaacaaaaataataaaatcagacagtgactagtccctgtacagtgcagataaaatttgttattttttttctttgtatgtcgattaaatttagacttgtatgtttgtatagtgttttatattaacatagcctatcttattaaattttataaaacttttatatgactgtttaaattacatgtatacacctaggtaccatgtgtagaaaatactttcccggtgatatacccaaaacgaagcgctgcagcttgcaacacacgtacacatcacatctctcgattggcttccttctccttcccggcttcccgccatggagagttcgtctcgatctccttgcactgttgctgctgctgatgcttcacgtcgtccggctcgcccctccgctgctccaagcacggccgctcggacacggcggactacgtctgcaggagtcgccgccggttataatgctgccgaccgacgacgacggcttgctgaggacgaagaagagccgctctcctccgccgtgccgatcagtctggccgacgacgacggcgtgctggggaggccgcgccgctctcctccgccgccgtcaaccttggtaccccggtgtgccgcgacgcacatgcagctcgccgacgacggtggcggcttgccgaggaggcagtggcatggcccccgacaccccggtgcaaccgccctccgatggcgcgcgtgtcgcggtgggacggccggcagcacgctccgccgacgccagcggccgggaaacccgccgcgtggacacaacgtcgccgtcgtttgcgccggctgccggccgccgcttttctccgggtgatccgcgacgccgtgcaatacatatggtcggcggactcggagcctgatctgtcagaagtataatttccttgttttaatttcaatatgtttatttgtatcgttatatggtataggatcagctgagcaggagccaaatgtacgtgtgttgatttccgtgacatatgcataaatttcttttcgcatcgatatatatatatcaggaccactttctttcacccatcgagttcgcgaggaggaagaatcctaaccctagattgtgattcggcaagcggagatgagaaggcccaccatagaagagaaattggcgacctactcgatgttccaggttcgttagggatccaccgtcctgatcaccgcgcgggagtggctggactccctgcccacggcagggtcaggcgaggccccagcgaggaggaagaggacgcctgggagatggagaaggatccctcgcacgctacctcatccttgcctgagaaagaggctcatgacatgggaggagcttctcgcggacagcttggacatgagcgatgaggctcactgctttagtgaggaggataagcccgctttccgcgagtgcaaggcgcatatggccaggttctatcggaggatgatcgacatcgagaagaacaacatcaaacaaatctcccgaccccgcgtcctgtccgatacaccgtgtgttaattaaaccccttctttttactaccattgtttcatatcataagtagtttgattttttttcttaatgaaaatcttttgcctgcttgctcctttcgtccccacggacggcgccaaatgttgggacaaaatccaacaagcgtatgtgtatcacttctgtattcattatgcccaaatgtgagcaatgtttacatatttatacaaggatgtacaaggggaaattacatcgctaccctaatagctaatttatctagccggttggctggtgggccagctttagggctcttcggtcagctcctcggtgataggagggctgcgcccattaagggagtggcgccgattcccgagggcgccggctattacccgggtatctgggtaatagcgtgcgcggtatgccctcatcaacagcgtcagaggtggttggcagatgtgtagtgcgtatttatggcgtcccactacgatccgatcacccatcttacgtccaaggctcttgaagccctggcttccttcagagcccttgaacagctccggagggtctagaaggctttggagtccttggatggctccggagcccacggacagctccggaggccttgatcggccccagagcccttagatggctccgaaggccttggatgaccccggagcacctaggtggctccgaaggctcgggttggctccagcgcctctagttagctccggagcctaaatcagtagatgcctccggtcattctcctggggtggatggctccggtaggtgct

SEQ ID NO: 5083 - DNA, 21508 bp, Oryza sativa
tttttttttttgctcatgggtatgtcaactacatcactaagaaaacatcatacaaatagaactttcctttcgtagatcctaacacacgtgaaattgcgcacccattatattcctcagtacaaaattcatgtgaaaaactatcattgtttttttatcacttataaaacagtagtgatcacagcaaacaagacatcgataattcagcttagaatagatctcctaaggacacaaggaagaggtggagacagaaaagccaaagttactttggagatgaatcctgcacgatcctgtaaatgggtaaactgatattagaacctgcaaccattttaattaataagaaatgtggattttttttaagctgcatttccattcttggttactaaaacagttaaattataaaataacttcagttgattcatttagctggtggtcagagatagaacgcattaacaattgaagtcctgtatatgcaacagaaatacagaatgcaatagttgaagtgaaattaaacttttaagtgaatacctaaaattggttttgtccaacacactgttgaatctattactcttttgaatatattgcagtgagcaacatttgaccgcagaagagatggaggcagagctcgctggcaagaaagtttgtccccaagctcatcgcttcgccaatttagcaattaaccattacaacaatattgagaagaacattgtaatagcccttttcctttttttgctttccatgacatgataagtcttaatgttgtaaactactaacctttctattttttgtttgttcaggttaagattgagctttgtactgttcttttatcaacctgttttcatgaggtctgtgggtccacatacgcccatgtcaactttactgccagggctcagaatgatgatcaggctaagaagagcctgtactttgcagagctcaaattgaatccggatcttctggcaaagaggatggaacgctttgcagagttgagccttgatcctaatattgttggatgtgctgatgatatcgagcccatgtgtgtcgtctctatccacaacctccagggttcttgttttggtatgtttattattgtcgaccaattgactgtattctgattaatatgcttgcttatttgtaattactgtaaggttattgatgtttgtacgtgtgattgtaggaccttctcagcgatttatttgatatgttgatgttgctttaattgtaggtggatgccatgagatcaacaggagaattgattatgtaatgacgaggaatcaggactatgagcgttgtcactcatgtagtgaccgtatcaagcatccatatgggacagaatttgttgcagggcatgatagttccaagattccgtattacactgcaggctgatgtaataagagcatattcattgttggtttttagaggggatcctagaggagagagaagtcatagtgctaacggtatacattgtggctatttttctagcagaaggtctcatctaaagaccatgtaattaaactttttgaaataggatagtgctatctatctaatccacgactaaattttccattttcaggttaacattagaagttttgagtattcaattagtataagtataaaatatagtgttgatgcttttgtcaccacaacgatttacaacggtcactggtcggtgcccctccgtccaaaaaaaaaagaccaatcctatagaagacttgtggctaggaattcttttttttttttacagaatagaacggctttgtatagaaggctcgagcttcttttcaaatttggtcaaactttattatatttcttccttagtgtcaaatttagctgtcaacagatagattggaagtacagtgcagcggaaattttgaagtctcgcaatgcaatttctagttcatagagttttcatccttgagtaccctgataattttattcttaggtactcctaaatggcattatatgtcattaatcctatgttcccttttgcgcccagttacccaacaaattaatgattatagggtagaaataatgatgtgatggatgtctctgcttctatatttgtcctttaaaacaacttactaactccgttcaactaaatggtggcaaatgttctattgtttttgctgctggcgggagtatgtttcgcttcatatgagaactggaaattaagaatgaggattgaaattgctggtactgtggtacattgttacctcagattttgacatccctcagcatgctgcctgttgtctgtactatggttgcagtcgcctgaatatatttctccttggagcaccacaagaatgtctgaactctgaacattgcaaagagcttttttttttttttggaatatgcagggagcgtattttttaattaaaagaaataaaattttacaaacaaacccaaaaaaaataaaaggagaagggaagcgggaaacattaaagactaagaaaccgaagcctattcctgactcaacatttggcgaccagccgctctagtggctaaggacttaacaccggcaccaacgcattgggcagacgccaaagcgtcgcatcggctgccatcgccttggccaccttgggctatgttcgctgttgtttgttgcacactctattgtttctttctttctagattgtacacgtcacaagagttgcaacggtgtcagagcctcgcctatgagccttgtcgaccttcttgcggctatcgcagagccatagtgtagtgcccgttccgtcgtggcgcctagcaggaaaattaattcttaaaaaccctaattgcgaaatttgtttccttgcttgttgtctagtgtccgtgccatctcaagatctcaatccccgatctatcgtcgagttcaaatccgaatccaaatcctttcaaatcgattccctccgcaaagtttagtttgcctcccccggggttcgatgggccgaattccgctcggcccatctctctctctctcggccgagctctctttctctctctctctccccccccggcgcgctcctccccccccgctcagcctcgcccgcgcgctgctcgcgcgtgcgagagtcgccccgagcgcctcttctccctacgattcgccccgcccgcacgccgcgcgcgcgtgagcgcgtgtgccgccgcgcctcctgttgttttcccgcgcgcgcgtgccgaatggccgaccgcccggtcgccgccgtcgtcagggcctgcccgcgcctgccgccagtgtcgccgatccgctccaaaccgccgccgttataggcgtcggtatagcccccaccgctccctacttcttttaccgatccggcaaaggggcaagccccctttctccccctcctttttcccttttcctcccgccggcgtcatcctccctgtcgccaattcggtcgctagccggagcgccagctcgcgccttgaccgcgcaagtcggttctcaaaccgacattgcgtcccctttaaacccccggctgcccttaccccccctccttttccattcgtctccgcgccatagccgccgccccgtgctctgtctcacctccgccgtccttcgccgagcgccgggagagccggtgcattcgaggacgcggaaggggacttcggccgcgccctctccttccccttccccggcccgaggccggagagattactcccgcgccgacggtctctcgtacagcgcccctcctcttctcggtgatgtctctctccgttctttctcctcgctccaactcctcccctagctttcggtagtagctcgagtagaccccccgtagctagccggcgccgccccaaccgtcgccttcgctcgccgtgtgctcgccgccgtcgcccgcccgagcttcgtagcacccgctcgtcgccggcctcgctcggcgtagttccgcccaatccgacgctagcgtcgagtttccgaagccgcgtaggtgctctcaccgacgggaatcgacccctcgtggcctcgtcgccagttccctcttcttccgccgccgggtgccgccgccgcaatacgccgccatcgagcgacctcggacgaatccgacccggtggctcgcctccccctgtcacgaacaaccgcccggtgtgctcgcttttgccgtatcaccgtgttggttccgccggttgccgcccgcgcccgcgtccattcgcgggcgggtcgtcgtctacctcccggcgtgctgcgtggcagccacgtaggcgccacgtcggcgccagctcagcttagaccgggtcgagccgaccccggtcggtccctccccgtgcgcgcgttccaccgcaagccgtgaggctgcgcgtgggcccgtcgcatctgcgttcgccgcggaccgcgtgcgtgcaccgcgttcctccccgcccgcgcgcgtgcgccctccgcacggtgagccgagccgctgacaagcgggtcccacccgggaccgcgtgtggtgagcccggtccaccggactctctctcccctcccccgcgcacgcgcgcgcttgggacggccggcccatttagttcggccggtccgttccaattcccttgggccgcgccttagccgcccgaggaaaagtctataatccctccctcttttcttttctttttcttttccaaaaaggatttaatttaatcctttttccgttagaccagaaatccaataatcttagaaattcaatatcttcccaaccgtaaatccgattgactccgttcaacttccaaaattcctcaaatctcgagatctatctaatggcatgcttagaggtcattaatagggctttattttcgccgtttgttgagttgttccgtttcgcgtgtagttccggagcccgaagacccgcagtgcgaggatttcgaggatcaagctccagatctcgagcaaggcaagccacctttgaacaccttgagcctatatttgaaatttaattatgttgcttgcaaagtattatgcattgataggatcacacttaatctgttgtcccgtctgcgaagcagattggcggacttacctaacttgtcgcatttgatccttccattgttaattgctatgccatgtccccttgtaaccatccagttgcgcctcgatactcgtgcactctgtgcgagtatcgacggtcgccttcaaagttaaaatctgagtaacaacttgggtaaaactggagctttacaaaagacttggaaaaacccgacacttgggtcgatgtctgcgaactaaatgaattttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctaggacccctctcgtcggcatatggtaaacctgcatcggctttcgaaatgccttgtcatgaaagcttggaggtctcccgacgtggctgatccccacgggctgggtgacccgggttagtaatgtcgtgtgggtaaagtgtaccccctctgcagaggtcattaaactgttcgaacagccgtgcccacggtcatgggcggatgtgaggtgattcctagcgtagttttgtttgactactgcttgtgaaattgctgttgtgaaactgggttcgatgtttggaaaacctgcagctgacgggatcagctaggcccgggtggcagtttaaaagttgtgggcccgggtggccgtttgaaaagagttggcccgggtggtcgttcaaaaagcttttggccgggtgccaaccttgtttcaggatctaaagactgatacattgcacatactccgaccggacgagacgcactgtctcaaccgtgtcgtttgagaagcactcacttagttgcttttagaaaagagttcaaataaaatcaattgcaaaaacaacagcctttccttgaagcctgcattaaacacttatttcccctggcttgctgagtactcccgtactcacccttgctctatataaatatctcccccccagttgctgaagaagatgaagcggatcctgctgatgagaagttcttccaggagcaagtcggctatgatgagttttagggtttcggcctagttcccaagtcgcgcctgtgattgtttggtccaagtcctggcttccgctttccttttgtaatgcagttgtgagctcgggatctgtccgcagcccaacatgactgtacttctactctataataaagaggcttctgttgctgtgatattctgtctccctgtgataccagcactgtttcctgggactggtatcgattaacaggttaatttggagcgtcacgggttagttccggtcgggactaattcggggcgtgacaagagatggtatcagagcacaggcttggccctagggcgaaacccgacgcttaggatgaccctaaggatactaagttcaaaactacttgcgaaaagctaaggtttcttttgttttctttattttcaatagtttgtttctaaaatggttactgatctttctccctctttcaaaattgtagatggcagtgaacgccagcttcagttcccacggttttggtgagggtcaccacgtcgctcagcttcgtgacctctcccgtttccttggcttctcgtgtcccgagtacacggggtactccgtggaccgtgttccccctcactgtaagctctctgtgtacctttaccctcgtggaggtatacacggagctggccttcgcccccaccacttcactgtggccaggcccactctccagatcgcgtaccaggacctctcctggactgcgcttcgtcgcctggcccacgactacagccaccgtctcggaggctccggctttcggcagctttcacgtcttccctctggccactcagacgccaggtacccttgtccgtacagcgagtctcagccagtgctgactcgcatggtcgagctttcggaggctcaggccactcagcacgacctactccttgaggcttaccgctcccttgcccgccgctacgccgctttggaggcccgtctggccgaggagggtgtcacctcagttgacactatctcttgggactcaggccgtctctgccacgctagccacctgtcctcccacagctcccgcggctctgctcgcactcccagtggcccgcgctcccccagctcgcgtgcgccgtactcaccagtgtactccccctacccacacccagttagcccttcctacacccccggacacaccccagttgcttcctcccgccgtggcccacgctttatccgcactgcgcggaagcgtgttgttggttcttccaccgtgttccgtttccgccacccagctcccccaccgccagcggcccgtgctgctgccggccctcgacaggtcccgccggtcccttcgcgccagccgatcgacgtttcttcaactgaggagccgactacaggaggcagccaggccgacgaggagtagaggaggcagtcttcagcagccgtccgtgtgataggccccttttgttccgccgccaactcttttggagtcgtggcgaggtagtgcgtgcgtgtgtttgttgtgggtgttgtttggtagtctggttctcctaggtggtgtgtgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgccccttttctgggagtttagatggctagccgcccccgtcgtacagctcgtgcaccagcccgctttggttttgaagatggtagagttgaagcagaagcaaatcacgaaccagctaatgagcattctcaccacagcaaccgttcgcaccgtactgttccccgcaacgcagaggttgagcaacctcgccgcagtagccgctcgcatcgcacagtttcccgtgatgcagagctggagcagtctcaccgctctcaccgcactgccagtcacaattctggagaagaacgcctcccttccccacctcatgtggaaaacaacatgcaacacataatggcagttcagacacaaatcttgcaaggactaaccacagccatagccagctttcagcataatgcgcatggaaatggccaccctcacgtgggcaacaatagatccaagctgacagactttctgaggtcacgtccgccagagttctctcagaccgtcgagcccgtcgaggctgacgattggttgaaagatgttgatagaaaactcaacttagtgcagtgtactccggttgagaagacgctctacgcctctcaccagctaagaggacctgccgcagattggtgggagaattaccgcaatgcacaccctgaacccactaacattgcttgggatgagttcgctacggctttccgtgcagctcatgtgcccgaaagcactattgacatgaagaaagaagaattcaacagacttaaacaaggcaacaacagtgtcaatgagtacctaagtcagttcaacaagttggctcggtacgcccctgaggaagttgacttcctagccaaaccgatagtcctagactcgcaaagcttggacatcatcctagggatggattggttggctaagcataaaggacagatagattgtgccgaaaagtccatcaccttgcaaggacctggaggaaagcaagtccgctttacccctaacacccctaccgcaagtcggtctatcctaacctgtttgcaagtcacctccttggagtcggtgcccatagtctgtgaatatcccgacgtatttccggaagaattaacaagaatgccaccagaccgagagatcgagttcaccatagaactggctccaagcacagctccaattgcaaaaagaccctaccgaatggcagctaatgagttagcagaagtcaaaagacaaatcgaagagttagggagtaaaggttatgtgcgacctagctcatccctttggggagccccagtgctcctggttaagaaaaaggatggctctgagagaatggtaatcgactatagagccctgaatgaagtaactataaagaacaagtacccgttgccacggattgacgacttattcgatcaacttaaaggagcaagagtcttctcaaaaattgacttgaggtcaggttaccaccaactgaaaatcagatctgaagatattccgaagaccgctttctcgacgcgttatggtctatatgagttcacagtaatgtccttcggactcaccaatgctccagcattcttcatgaacttaatgaacaaaatctttatggaatacctggaccagtttgtcgtggtattcatcgatgacatcctgatatactctaagaacgaggaagaacatgctgaacacctgaggctgataatggaaaagctcagagatcatcaactattcgctaaattctcgaagtgtgaattctggttggaccgagtagcatttcttggacacgtgatctcctccaacggtgtcgaagtagatcccagcaaggttgaagctgtacttgcttggaacccgcccaagaatgtgtcagagattcgcagcttccttggcttagcgggatattatcgaagattcattgaaggattctctaagctagccagacctatgaccgagctgttaaagaaggaaaagaaatttcaatggtctgtagcctgtgaagacagctttcaagaaatgaagaaaaggctgaccactgccccagttcttaccttgccagatatccgaaaagatttcgagatcttctgtgacgcatcaagacaaggcttaggatgtgtcctaatgcaagaacgtaaggttgtggcctacgcatccaggcagctcaggcctcatgaagtcaattatcccacccatgatctcgagttggcagccgtggttcatgctcttaagatctggaggcactatttaatcgggaacagatgtgaagtatacaccgatcacaaaagtcttaaatatatcttcacacagaccgagttaaatatgaggcagagaagatggttggaactaatcaaggattacgatcttggaatccactatcatcctggtaaagccaacgtggtcgctgatgcgctaagtcgcaaggcctattgcaatgtagctcaaatacggcctgaccaagatcatctgtgcagagaattggagaagttaaggctgaccgtggtacagtcaggagtcccagccagcttgacagtacagcctaccctagagtcgcaaatccgggaggcccagaaagacgacgaaggggtaaaagaattaataaaaagaatacagttgcttttagaaaagagttcaaataaaatcaattgcaaaaacaacagcctttccttgaagcctgcattaaacacttatttcccctggcttgctgagtactcccgtactcacccttgctctatataaatatctccccccccagttgctgaagaagatgaagcggatcctgctgatgaggagttcttccaggagcaagtcggctacgatgagttttagggtttcggcctagttcccaagtcgcgcctgtgattgtttggtccaagtcctggcttccgctttccttttgtaatgcagttgtgagctcgggatctgtccacagcccaacatgactgtacttctactctataataaagaggcttctgttgctgtgatattctgtctccctgtgataccagcactgtttcctgggactggtatcgattaacaggttaatttggagcgtcacgggttagttccggtcgggactaattcggggcgtgacacatagatagaaagagttttcattcatcataggcatctgccttgcccaatggccgagagttcaagccaccaaagttgacgggactatgggcaagcgaccaaaatatgacaaagagcaatcttccattacatccgtaggatgataggcttgcggccccattttttcgcttatacttatacttattagccaaaatttaaattttcaactttaaatttggagttgattttggggtttaatcattgtagtttacttttctgcttttgcttttatatcgttaaaaacacgtgtataaaagttttttcataaattattttttatttgtaaatatgttgttttgcttattcctctcaacagccaaacgatggggctgttttcttcggtggttgatctactatcactattgaattcatggtttgtccaaaataccaggttgtattgggtttttcgccggccccatgtcttgttattatcataacatgcatgattataaatggacaatttgtgactaatgatatatatgtcaacattttaaattgttgaagtcccgagaatcttgttatgagataagaaataatctagtgccaagcagttagctcgaattttatcatacagaggtagagataaggttctaagctgtaggttcagtactatactacaattatgcattttgggtgcaaacaaataagttagagacaaagcaggtaacccaatttgggtgcaggaaaatgagtagagaggtgacagaagagctaatcacatggaagtatgagcatctttaggtattgtctactgggctgtacacatgccaatgctggaagcctggaatccttgaactacaccatagaccagaggtcgtcctctggtcttaaagaaaaaccatttcgacaacagaagtgcagtttcagccactataaatgctaatgttcccaaacctttaatttcttcatccatgtaccaatcgatctacaacaagctaagagcacattcagctattagctttcattttgctctccttgcatagtattctcgatcggccatggacagatcactgtctacttcactgcttcttgtcctcgcccatttcatcatcatctttgctcatcttttggatgcacgaacactaggtaggcaacacaacagcacgcagaattgcattggttcctttcagtcgcattgatcatgtgaaaaagaatggttttgattgctaatctggcctagaatagtgggttactgggtttgatagctagtaatttgtcattcaccgagaaaatttcttgtgctgtttctgtccatccaggagacgcataccaaccacacgtacatgcgtcgtcgtcgtcggcggcggcgttgcggctgtggagcagcgcggatgccgacggtggcgcgctggcgaagtcgtcgccgcgcgctccgccgccgccgaggtcatcacattcgccaacgccgcgctggcatgacggagatggcgcgccggcgaggtggccggcggcggctgctcctcctcctccgtttgcaggagatgtcgttggccaacctgtgctctccccaagccgcccggcagtgtacacggcttagttacgaggtcgtaatctttgatcaattcgaggtgttgtactgctcgctgacatatgagcacgagatcatatgttattaatgtcaatgattagtactccactgcactgagtccaaccttgatgtttacgagtcacagagtcactgtttcatttcctgatcacaagcccgttttcttatgttgtgtactcatgtgtgaactatcgaccgttcttttgtgtgtgtgctcgtgttaactatcaaaactgttaccataaactcaatttttaactatcaatccattgtccatcaggcttgtttagttcacgaacagattttagatgtcacatcgaacgtttgaccagatgtcggaaaagattttcggacacgaataaaaaaactaatttcataactcgcctggaaaccgcgaaacgaatttattaagcttaattaatctatcattagcacttgtggttagtgtagcacttatgactaatcatggactaattagtctcaaaagattcgtctcgcgatttccatgtaaactgtgcgattagtttttcattttatttatatttaatgcttcatgcatgtgtccagagattctatggctctatttttttcttcaaacttccaacttttccgtcacatcaaacttttctacacacaaattttcaacatttccgtcatatcgtttcaattttttcaaacttctaattttaacatggaactaaacacaaacacagtttatgtgatgttttggggaaaaaaattggaaactaaacaaggccagtacttcaaaacgaacgtgtgtgtaacgtcacgacaaacatatacttacagttttgcactccttaatttcctaaaagaaaaaataaaacaccctttcacaccagcgtgaaagcgttggtttgacagtccggccatgtacgcgttaataattgacgatgatatgaccgaaacacgcggcggacatacatagacaaaattccgaattcaatctaaaacaatatacttcctccatctcaaaatatttgatgccgctgatttttttttaaatgtttgaccgttcatcttattaaaaaaaataagtaattattaattcttttcctatcatttgatttattgttaaatataccttaatgtatacatatagttttacatatttcacaaaagttttgaataaaacaaacggtcaaatatgtttaaaaaagttaatgacgtcaaatatttagaaaaggagcaagtatgttctcagaaaatctaaaacgatatatgaattatgaaacttccagttcatctcaatgtctcgatgcatgtgtggtcgtcgatatatcccatggttgccgtcgattcctcgtcgtccgtaactccgtatgtcttggtgtttgtgtcctacgtgcactggcagcggagcgatggtggtgcgggtagaatacgatgtaattaattttgaaaatatattatttctttcttcaattttttttggttagaaatatacctcgctatcacataaccaccgcacgagaatgacgtggagtaacgacgcgccaaggttttgcaagggaattccacgaaagcgtacggtctcgcacaaccaatacgcgagaccgcacggcatggctgaatgattaatgttttaatcacattgattagcaactaattaatcttagttatcattaaataataactaattatggtaattaatcactaattttggaccagagattcggtatgctgtttcttatgcgatactgttcggtattgctgtttcgttatgtctcgcgcaacgattatgtgaggtcgatgtatatttctaccaataagcttgcatcctgaatatttttaagaaaaaacaaattaacagtatattttgaaatttatttcgaatacaatgcacgtcgtcctacatataccacaggaatacgacgtggaaaaaaatcaaaaatactttacagatctatcatgctttaagattggtgaggatacatgtacgtgtacgcgtacgtggcacccatttagccagctaggtaggatggtgctccacttggtgcggtttagggcggaggcttcacaccccggactactttcgccgttctaaaaaaacataacctataaacgaaatatgatataatataatacaataaatttaaaaaacatttagatagaaattcatcccattttaggtgtttttttatacagttcctgttccttccgtgtcaaaccattaacttgtttttccttccgtgtcaaaccattaacaaatcaatccgagcattttctttcttttgatggattaattaggcaaaaaaccgttgactcagtcatcacacatgcacaccacgcgagtccacgacgaccacacgagcgccgtaccaaatcctgcctatataacagagctcatgtgggtgtggctagctgcagcctagtagcttgcatcagagtttcatctcatctatcgatcggctaatttctagcttaattagcttgtgatccctttccttcccgccatggaggcctcgtcgtctccttgcaagcttcttcttcttcttcttcttcacgtcgtcctgctcgcgttcgcgccgctgctccaagcacggccactcggtcatcaggtggtggtggcgccgctaatgttgccgagcgacggcggcgaggtcgtcggaggtgtcgggcggccggaggatcacatcccaccgtcaccttttgcgcctggcgggccgatcacgctcgccggcggatggctggtggggaggccggtcggccccactccgccgccttcttcgcaccccgttgtgccgactccgacgcagctcgccgccgacgatgacggcggattgctgaggaggccgggcggccccactccgccgtctccttggcaccccggtgtgccgacgcagacgcagctcgccggcggcgacgacggcggcgtcggcggattgcttgggaggccgtggcctaaggctcccccgccgcctgacccgaacacgccgccggtgcagccgctctccaactacggcgtgtcgcggtgttgcggccggccaggacccgctccgccgacgccggccggaaacccgccgggtgaaaccaacgtcgccgtcgcgctcgcgccgccgatcccctgcgccgcttttctccgggtgatccgcgacgccgtgcagtacatggtcggcggcggactcggagcctgaaacgatcgagagctcgacaccgagaagaagagatatatacgagagagttgtacttgtacgtgtatatttgtacgcatacagaagcaaagctataggcaagtatgtatacggtataacgactgtataatcgtatatattgtatagtcgttttttatttaattataagtgtcgtagcagagtctaggtaagtagacaccagctgagcaaaaagactagctggctagtagctgcacgttgttgcgtcgctcaactacgaaaaatggagatgcagtaattataatctctctgtggccaattggcgcagtatatgcatatatatatacacggtggtgaatccggctgaaatcagaggatagatttaaagtctaaatcttttttgttaaaaaaaaagataaaaatacatcctctgtatcaacccaccatatttggtttgcaattgaaatttcaaacattagttacaggggacaacaccggatactttttgcaccacggatccataaagcatcaagaaaaaaatagatgaaatcccacgtgttgctgctagaattttatatgatattagtagaaataacatgtgacagtggattttaaagtcttcggcaaacattcctttgttgtttttatgccattcaaatagttatgaaaaaaattaaaaaaattgagaagatgtactaatatgtgatatatcacccccacaaacatgcaatttaaaaatccaactaatacaagttaaaaatccaactaatacaagttaaaaaaaaattaaactacaactagttaacatatattcacagccaatttttttttaaagttacagaccttacatgcttgtgaagtaatctatcacgtactacactaaatagggagtagtaatccatcttatcatttttttctagaatatatagtttcccttaactacactagataaactttatagatatatatatgatgttccacggtaccagagacactgacaaatgagcgttggatggtttgacatcatcgatacatcgaaaataaaaatattaaatagatacagaatatatatatttgatttagaataaaactaaaacgatttacatatttacagtataaaacgaagaaaggtgtgccgcacatcaggatcatatcccctggcaggtgcaaggtgtgcacttgatcaggccactaaaataagagacatccaaatctattagtcctacaatttatctaagctaattaacaaggaaaagaaaaaaaagaaaagaaaaacagcacaagtatgaaaggcccaggcagccaaacacactagcttggccgggctccatgttgccatcacggtttctctccgtgaacaaaagttgttttgactcacgcggtggctgttgtctgtcgcggttgtttcttgtctgttgaatggtcaactttgaccgcaaccttagctcgtagcgaaaatcttcgcccggtagcggttccaacagctagctatttgcagcaactaactgacgatttacgcacatttatacactgctattcgtgttcttttcaagttaaatattggctctgtttggggaacttgttccagctgcagcttttcctaaaagctgcttctgctagaagctgccccaaacagtatacagcttctgagaatctgtaggtacaggttctgaaaaatgaactaagaagccagaagctgggtttcagagcttttccagattctcagaagctggctaccaaacaactgcttctcagaatataaaactccaccaaacagacccattaactagtatatcgaagattctttttgaaaatgctactatcctattcgaacgggataatatctcaggggtatcacctgatatataaaaatcaatagatatgtatcacttagagatattatccagtttaaatagttataaaccgatatctaacacgtatcatatcagataatagcttagaaatatcatatcgttcgaatgggatattgtcatgtagcattttatggattaagaagaaacagttgacttgtcaactttctagccgtcataagcaattctaatctttgcctatatatataagagctcacgcggccatgtcgttcttcgcgcgcgctgccgcttgcaacatctcgaattctcgatcgatcgattcattgtttttccttcccgccatggcgggttcgtcttcgtcttctccaaagctgctgctgctgcttcttcttcccgtcgtcctcctcgctccgctgctcgaagcacggcgtctgcacgtgctgccgccgctgatgttgccgagcgacggcgtggtcgtcggaggcgccgtcgaggtcgagggcggcaggtcgggtaacgccccgccatcgcctcgtccgcatggccgggtgacgccgctcgccgacggcggcggcggcggcgtgctgaggaggccgccaggacgcggtccgccgccacctggtccaggtggccatgtggggccgctctccggcggcgtgtcgtcgtcggccgggagatcgtcgacgaggccgctgatgatctccgacgacgacggcggcgtgtcggggaggcagtggcctgctcccccgccgccgcctgacccgaacaccccggtgcagccgctctccggcggcgacgggcggccgcggcagctcgcgccgccgccgccgatgggaaacccgccgcccaacacccaccgtcgacgcaccgatcgtcctccccgccggctgccggcggacgacgacatggccggtttgctactccgcgtgatccgcgacgccgtcgaatacatggtcggcgaactcggagcctgatatccatcgagaccgagaagaagatacgagagatccgagaattatacgtatatttgatttgtacgcatgctgaagaaaggcaagtacttacgtattaattaacgtataccaactgtatagtcgtatactcgtatgtatgtattattgtatttgtattagtatacagtgtacagttgtaagcctagctaagaggctagctgagtaaacgagatcagacagttgcatgcatgttggtagctactcaagctgttgaattcgtcggtctggttgtggttcacactgaagtttgaaagtttggttaaaattgatacgatgtgatagaaaagttacgtgtgtatgaaaggtttgatgtgatgaaaagtttgaagtttagaaaaaaaaactttgaaactaaactgggcctctgacgtgtatatttggaccctaattaattaacagtgagtttttttttcaattacatggtagaaacatgcgcacacgcaactactcacactccgtgaatgtgtcagctaacatatgctctaataaacggaaattaatgatatatcaccgatctcattgattttctattgaaactccaccagtatatacgtaatattcatgaacaacaggacacttgtaatggagtagtatttaaattataattacacagcatcataatctttgcaaaaaactgtttctgatctatctgcccaggccattcaagataacaagaccggacagtttctagccggaaaaagctctaaccgatacaaaacaggatccaggggggaaaaataaaatcataaacagcaatcatgcgctgtagtgtacttatataatgaacaaagcacataaattaaccaaaccctgtaacaacgaaaggctaacaaccataagaattcagaagggagtggttcacaaaaatctgccggtatggtatagctctagcactactaattatttttaactaattatccgtgcttgccattagcatattaccggttatatataaattataagtatatactagtaataattaatcaacaaattcaactcaagacgagttttgaaaaactgtcctagtactccatgtcatacgacgatccttgacttttaattgacgacgtgtctttgtttagagtccactaattaattatagcttgcagccaaaagttaggcctaccaatcgaacatccgagttcataatatatgataatgagtacagacaaacgcatcttagataagctgagagcgcccattaactgtaatctatcaatatttgtccatcatttgatatagttaacgtctgtccatgttaaatattggtcagaaaaagaagaccttcgagaagatagatttgattactactgacacgcttggtgctgatatatgagttagaaccgccccataaaagtttcggcctaattaagataagtttacttggtgaaaaatcaaggttttcaatggacctttaattttatcccaggccccagacctggcctagctttgctcggggcctggatttgcccccgctaccggaattcatctaccgacaaaacatcagacaggagcaactaacatactcatgatatgatggatacacacttcggagaagtcgaaagtttgaatgtcatcagtggaacaagccaaaccaaactcgaattaattcatatacggccaaatatccatcaaatagtcgctcaagttttgatggttgttgatatagcgtttgataatcatcatttttagcaagcagttttgcgctacggcagactcctccaccagctcatcgtacacacaacacacatgcagctagtcatcgtcgtcaaggacgctccggcgcctctgaatctgcgaaataaaacatagtaaaaagaatcagttgtgtattggatgctttcccttcacagactagcctatattagcatcattttctcttcctttttttgatgatgtacaatcagtgacttggaaagaatcacaacaaacgagaatctttacaaaccaaactaaattagttgtagtgaagctacccaaaaccactattggaagcatggtaggtttgtttagttaagtgcacatggtatgtcaaaaactgatagaagtttccacgtttatcataccgtaactttcgtctgtttgctagtgtgggtattgatttgctccagaagtgagataagcctttcttcagacacctgaaagccagaaaattccccccaaagaaagtcagctttcagataaacctttcttctgagtctcttgacacagtaaagattatgctacccgcctctattaccttttcagatattccaccggactgagcagctctcagaagaacatcctctacccctcttgctttatcaggtttgaccaaagctatgcgagagactgaaaactccagagagtaaaaaattacatcattatagaaccttttcatcaccttaacctcaagtgagattaacggtatgactttttcatagaatcatccttattcagagcatttgattctgataagcaaactatgcattatgtatccatgcaattgtttgccagtttggtccagcctactgcataacatatgttcggagctgtggagattttgaagtgtgcacacagtgccccttcctagttcatacggttttcatccttcagaagcctcatctttttgttccattggtttgtaataatgaagcctgcctagtgctttgctattgttcagttccttacgatacagtatacactggcttgtgaatatatccaatgatactgtttgagcattggtatcgtatggatagctcattagttttagttttgaacggaagtgaaataactgaagtgatgaagtttattgtgatgaacagcaagttaaaggttgggcattatagtggtataaattaaatgtgtagggtggtaaaaaaattcacatgcttacgttagtgattaaatacttcagttttgctcttcttgtttgactgtgtcttatgatgctatcttgatcgatcagaaccattatatgttcaccggatgagcagctacctttttggaagggaacggaaagttgcagacatccccatagatcatccctcctgcagtaaacaacatgcagttcttcaatataggtaagcatagcaatcttattgttatttgcctttattagcatattgcc

SEQ ID NO: 5084 - DNA, 4347 bp, Oryza sativa
cctctgcggcttgttgtttgtactatggttcagtcgcctgaatatttttcaagaatgcctgaaggaacaaaacagaggccggtaatcttccgttacatttataggattctagagcctagacatgttttatccagtggttgatctagtaccgctacatacttcatggttttgtcaaataccatgtcatattgtcactgccatatcataattataatctgcaatttgtgactattgaaatgttggcactctaatctatttgaaatctgcgaatcttgacacgagatgagcaataatctagatatagcgaagcactgaagcagttctgttggttccaattttatcatttagaggtagccagctggtagggatattctagcttcattactattctacagttaaacaggcatcgagaaacaaagcaggtagccactttgggccccccaaaaaaaatgagagcatctttagttgtgtccactcggctgtgcacatggtagattgctaatgtatctctgtaagtgaaggcagtgtttggctaacgagaaaaggaaatgattttccacccaccaaaagatatttttaaatcctaaccgtttattttccctcttccatttaatcctaactcttcattcattttccaatctcaatcccaatcccacctcccatttcccattatccaaacacacccgaaaagttttcctcacaatgcttctagggtgagccacgtcatcaagtgaaatatgaccgttggattcataggtgaaaccaatatcaaccgttggatgaaatgtgatggtgaagaaaggatatagaaatggaaaggaggaatccggaaccttcatgtggcttaggttggaaggattcatcggatattgagagaaatgagaaaaacaaaagcggctaaaaagataaagatgtaatgaccctttgcaatatttattttacaaagtaaaaatttatttacaaatagatccatagattcacacatatttttaaatgagtgtttaacaaataaacatattttaatttacctaaattcacataagtataatacatataaaatgtatctagacttacataagtataagtatagtaaaaataagtatgttctaataaatatgctactccctccgtatttgaatgtacgacgtcgttgactttttgactaacgtttaaccatttattttattcaaaatatttatgtaattatcatttattttattataacttgatttgtcatcaaatattatttaagcatgatataaatatttttatatttgcacaaaaaatttaaataagacgaatagttaaacgttgataaaaagtcaacgacgtcacacgttaaaatatggagggagtataagacatgatggaaaactgacaaatttcaatggaatacgatctacatgttaaattaaaggtcattttgaatgtataatccttgcaataatttaatggagaataaatatattaatccagtaatcctacaaaaatcatgcattttctttagaggctctttatcactaatgcatgggctacaaagaggggctaaagagtttgtgtcaacaagaggtatagggtgtactcttttaccataatggaatagaacatatatatgcattttttttaagaaaaatgctacatctgactttcttttctttaaataccatttatgtatttttcatccatgggttcctcgaatcattaaactttcaaccttccatattccatctgattcagccttataaaataacacgcctaaacctaaacagaacatgtttacacctatgaggaaattcgaccaagggtggctactcatggccatgtaagtaacttagcataatttatcgcaaactttatattaccatgtcagtctattacatagttttaagtgagtagttgttacaaatttaaactaattactactctctccatctacttttgatagtcatatttcatcttgacacacagaccaagaataagtaattgtacctatcatccatttaaatatactactagttatttctcgtaaagaagcgatttatgaatatttacatttctcgatgtccatgtagctaatcttatgtggaagaatagagagtcatgcattaaattctagaaaatcattaagaggataggttgttggattgaaatatgcttatcaaaaataaatttttcagatttagaaaatatgcctatcaaaaatagatggagggagtacaatataacgtgtaaaagtatttaataaagatggtggttacagtcgcctgaaaacgcgacttaatagactagtaatgcttgaaagttgaaacctcgacagctcgtcaactacacaaggtcggtggtctctagccgctatatatactgccagtgttcccaaaacctttcttcatccgtgtaccgattgatctacagcaagcttcagcttgctcctgcatctatcgatcatggatagatcaccgtctcatagtcttctccttctcctctgcttcttcctcctcttcgctcagctgttgcaagcacggatgctaggtaggcaacatagacgctttcactcgcatggatcacgtgaaaatagagagaaacagagaagagtgcatttcatttggtagctaatttgtcattcactgacgaaacgcatcacgcattgaccatgtgaaaatattataacaatggtttgatagctaatttgtctgtcctacactgacgaaatttctcctgctgttttctcgcttcaggagaagcctactactcctatccacatcggatccggattaaatgcagtagtagtatggactgcaacttaagcagttgtagctgctacgttggatctaaatccaacggtaaggattaggccggttactgtagcaaaagtaccacggcgtaaaatattgttcagggtactgtagcacgagtactgtagcagttgatctggactgttgatcacaaaaatgaatggctgaaaatgcatgcagtccctaagactgcacccgatctcaatccatccacatcttcgtgcgtcggcgtggcggagcagcgtcagcacggatgacggtggtgcgctggtgaggccgtcctcgtacaccccgccgtcgccgaagcacccggggccgcctcaccagcacggcggaggtggtgcgccgcccgccgatgtggtggccggttgctgttgctccgccgttggcaggacacaatggccggccaaccaagcccggcagtgtacacggcttagttattcgtaaccttgatgttacaaggtagccaactctgccattcgtgtgattggaagcccgtttgtttggggaatttgagagccatccggtgagaatatggaaaaactaaatcctacgtttcttaaaatctaagtaaaaggttagactatttgaagacccgaagattctaggaaaaaactgtagttacaataagctcccttaaacatgatttgattatgttgtcaattatcaggctggtttggtttgtgtcataaattgattttaccaattttcgtccatgtctaattttagcaagttttagcatggctgatcttagtaaggtaaagttgtgtttgaattaaagctaaaatagcctaaattaactattgaagtgacctatttttcttaggtttgctaaaatttggcttcaaaccaaatagacactaagtactactccctccgttccagaatataagtatttttagagttggacacggttattaagaaagtagatagaatttaatagaggaaggttgtgattggacaagaagtggatgtaggtgaaaaatttaaatggtggaggattgtgattgattgagaagagaatgttggtgtagaaattgttatattttgggataaattctagaggctaaaagttgttatattttgggacgaatgcagtattaaaattatcaaatattggtaatatcaatatagaccacagaccaaaccagcccatcaaaacttcagctcctcaccatcaggcttccaagacctgctagtgactggttgtagcaagttccaaggactccaaagccttccagtccctccggagctgttcaagggctccggaggaagccagggcttcaagagcccaagccctgggcgtaagatgggtgatcggatgtgtagtgggacgccataaatacgcactacgcatctgccaaccacctctgacgccgctgacgagggcagacaacgcacgctattacccagagcacgcctttactcgggtaatagcaggcgcctttgggaatcgacgtcgctcccttaatgggcgcaaccctccctgtcaccgaggagctgaccaaagagccctaaagatggcccagcagccagccgcctagataattcagcg

SEQ ID NO: 5085 - DNA, 1908 bp, Oryza sativa
aagaatattcataagaaaaaaatcaaacgacttatgatatgaaacaaaggtagtaaaaagaaggtttttcggacaggacgcggggtcgggagatttgtttgatgttgttcttctcgatgtcgatcatcctatgatagaacgtagccatatgcgcattggactcgcggaaagcgggcttatcctcctctctgaagcagtgagcctcatcgctcatgtccaagctgtccgcgagaagctcctcccatgtcatgggcccctttattaggcaaggatgaggtagtgtgcgagggatgagggatcctcctccaactcctaggcgtcctcttcctcctcgtcggggcctcgcctgaccccgccgccggcacggaggtggaggaattagcccccgattgcgacagcagcggcgacagagagtccagccactcctgcgctgtgatcgggacggtggatccctgatgaaactggaacatcgagtaggtcgcaaatttctcttctatggtgggccttctcatctccgtctgccgaatcgcaatctagggttaggattcttcctcctcgtgaacacgatgggagaaagaaagtggttagggctgaggagaggtgacacgacgcgtccctgatatatatatgatgcagcacctaccggagccatccaccctaggagaatgaccggaggcatctactgatttaggctccggagctagctcgggagccaacacgggtcctcggagccacctaggggctccggggtcatccaaggccttcggagccatctaatggctccggggccgatcaagcccaccagagctgttcgtgggctccggagccatccaaggactccaaagccttccaggccctccgaagctgttcaagggctccagaggaagctagggcttgaagagccctgggcataagatgggtgatcggatgcgtagtggcacgccataaatacgcactacgcatctgccaaccacctctgacgccgctgacgagggcagacagcgcacgctattacccagagcacgcctttacccgagtaatagcaggcgccttcgggaatcggcgccgctcccttaatgggcgcagccctcctgtcaccgaggagctgaccaaagagccctaaagctggcccgctagccagccgcctagataaatcagcgattagggtagcgatgtaatttccccttgtacatccttgtataaatatgtaaacattgctcacagctgggcatattgaatacagaagtgatacacatacgcttgttgaattttgtcccaacatttggcgtcatccgtggggacgaaagaagcaagcaggcaaggaattttcattaagaaaaaaaaaatcaaacggcttatgatatgaaacaaaggtagcaaaaagaaggtgtatcagacaggacgcggggtcaggagatttgtttgatgttgttcttctcgatgtcgatcatcctctgatagaacctggccatatgcgccttggactcacggaaagcgggcttatcctcctctctgaagcagtgagcctcatcgctcatgtccaagctgtccgcgagaagctcctcccatgtcatgggcctctttctcaggcaaggatgaggtagtgtgcgagggatcctcctccatctcccagatgttcgcttcctcctcgctgggccttgcctgaccccgccgccggcaggtaggtggaggaattagcccccgattgcaacggcggcggcggaagagagtccagccactcccgcgcggttatcaggacggtggatccctgacgaacctagaacatagagtaggtcaccaatttctcttctgtggtgggccttctcatctccgtcttctgaatcgcaatctagggttaggattcttcctcctcgtgaacacgatatatatatatatatatatatatat

SEQ ID NO: 5086 - DNA, 2821 bp, Oryza sativa
ctccgggtagcggagccagcctccgtcatgtgatgcaacacctaccggagccattcaccccaggagaatgaccggaggcatctactgatttaggctccggagctaaccagaggctccggagccaacctaggccttcggagccacctaggggctccggggtcatccaaggccttcgaggtcatctaagtgctctggggccgatcaaggcctccgaagctgtccgtgggctccgaagccatccatagcaacccgtttgcggtgcgtgcaggagaatcgtcgaatgctcgtatggtttgatggattcgtactctcatttcacgcctaactgttagccaaaatatcagctattcacggccagatcgatcgagtgagcgcagaaggctgtgtttagttgctgaaaaaagttggaagtttggggaaagttaaaagtttgaaaaaaaagttaaaagtttatgtgtgtaggaaagttttggatatgatataatgtgatgaaaagttggaagtttagggtagctgaggtgaactaaacacggccgaagtttgacactccggccatgcacgcagcctgatgcacgcgctggtttaattacctggttttcgctgttgcttcctggagtagctgttgaacaggtgctagcgaaaaattgcgtcgggtagctttcgctgtttaattacctggttttcgctgtttgcgtcgtgttcctttccagtttaaacattaattaggctgcgttcgatatcaggagttcctaactccccctgtttttcgcgtgtacgcttttgaaactaataaacggtgtgtttttaaaaggtttatatatgaaagttgcttaaaaaaattatattatctttttttaaaaaaatagctaataattaattaatcacgcgttaatagaccattgtgttttccgtgcgtgaatgatgggttcccaacccccaccacccaacacagccaagtcattagccgtcctatttttaatactccatgatttaggaagaaataaaccgttgactgccactcgatcgccatacacacgtacaagagcagatgcaataatcctagtcagcaggctccaaaagctattatattgtttttttttattagatggagggaagagaatcgatgagagagaacggagcgggagctaatctggcgcccggcgatagcacgcgttttcacgcgcactcacgattaaaaacatattttgtgggtcccacggtcacttatccgatcccgtgcgcatccttcttcgttccaccctccggtgcttcgtcgaccgacggacggcgtcttccactagcgtaatctgagtatttctcgtcggcgagcgagaaaactccatcgcccccacagatcacgtaggcccatcctccatcctgaaccacgcacgctcatcctcgattcctcatcctcgtccaggaagtcttggcggcggaattgcagccgaccagaagcatctcatacgggcgtcggatcctgtacgcggcgaggtacgtagcgatgactgtgctcgtcttgtgcttttgcataggctgatcaatcatcattgatgaagacccgggaggatcgatgtacagatggagctaatccatcgcgagcttgctccgctatgatcaaccaccggctagctgcaaaaccgttttcctttgctgttttttcccttccttgcattttcatgcttccatgtgaatggagatggataacaggataaacaatctatcattatcttttagttgctatttctgttgtcgattttaggcagggtgactgttgcgatttcgcctaggaagaagaagagaggggaaactcgaagaagaaagatgagccagcatgcacaaaaccaaacgttttctttttctttgatgtgttcaccttcatagttcatatcacagcaatggccacaaaaataggatccacttatgatcatacatgtcaacacgtgcatacataattaattgtttgatataaaattatactgtagtcagctccctccgtctcacaatataagtattttgagtttttccttgtaacatttgaccactcgtcttattcaatttttttttgcaaatataaaaaatgaaaagttgtgcttaaaatactgtagataataaagtaagtcacaaataaaataaataataattttaaaatttttttaataagacgagtggtcaaacgttgcaaacagaaactcaaaatcccttatattatgggagggagtacaaaatatggttagagccggcagtcggcggcactattgaccttgctcacgtaatcctgcccatataaagagctcacgtggccacacatagttcgtcgatcgatcggctcccttcccgccatggagggttcgtctcgatctccttgcgtttgcatgctgctgctgctgcttcacgtcgtcctgctcgctccggtgctccaagcacggctgctcggactcggacatggacgtcgtctgctggtggcgccgccgctaataatgctgccggtctcgattctattgccgaagcggagacggcaggcgtaacaaaaaaaaaaaaaaacgcaatgcacttgtcgtgtccgaccttttttttttcggaaaaagtatacttcgactccttcaactatgacccgagtatgattcatgacctccaatcacaaaaccttgactcctccaactatcaaaaccaatacaaactatatccctcggtggttttggaagcggttttcgctgacgtggcacttacgtggcagtgttgacccggtcttcgtcccacgtgtcgcttatgtggcattagagtaaaaaaatattgtgggaccaacatgtcattcaaaaaaaaa

SEQ ID NO: 5087 - DNA, 2598 bp, Oryza sativa
  unsure (1)..(2598): unsure at all n locations
gagggggagaaatgacgataacatgtggggcccacgtgtcggtgggtcccacatttttttttgaatgacatgggggtcccacaatttttttaactctaatgccacgtaagcgacacgtcgacgacacgtgggctgaagagcgggtcaacattgccacgtaggcgccacatcagccaaanccgcttccaaccccaccaaaggatatagtttgcatcggttttgatagttggaggagtctatatacctggttttgtggttcgaggatatgaatcatactagttgagggagtcaaagtataatttttcctttttttttcccaccgggccacggcgcccatgggccaggcccaggcgaggcatcctattccgtgacgtggataaatttctttttcgtctcccctgatcgcttctttccccatcgagagttcgccagaaggaagaaacctaaccctaagattgcgattcggcggcagcgacgaggcgcgggcggagatgaggaggcccaccatagaagagaaactggcgacctactccatgttccaggttcgtcagggatccaccgtcccgatcaccgcgcgggagtggctggactctgtgatggctggagttggctcgatctctctggcggtgcggggtgctggctcgatctcggcggcggcaggagcgggagatggggcttgctcgagctcagtggcggtggcggggactggctcgatctcggcggcgggagcggcagatgggccttcctcaagctcagtggcggtggcggggactggcttgatctcggcggcgggagcggcagatggggcttgctcgagctcagtggcggtggcggggactggctcgatctcggcggcgcgagcgggagatgggcctttctcgagctcagtggcgggggcgggggctggctccatctcggcgacggcgggagcgggacatggagctgggtcgagctcagttgcggcggcggggtcaggcgaagccccggcgaggaggaagaggacgcctgggagatggaggaggatccctcgcacgctacctcatccttgcctgagaaagaggcccatgacatgggaggagcttctcgcggacagcttggacatgagcgatgaggttcactgcttcagagaggaggataagcccgctttccgcaagtccaaggcgcagatggccaggttctatcagaggatgatcgacatcgagaataacaagatcaaacaaatcttccgaccccgcgtcccatccgatacacagtatgttaaaccccttcttctttctttcttttttttttctcatgggtatgtcaactacaccactaagaaaacatcatacaaatagaactttcctttcgtagatcctaacacacgtgaaatagcacacccattatattcctcattacaaagttcatgtgaaaaactatcattgtttttatcacttataaaacagtagtgaccgcaaacaagacatcgataattcagcttagaatagatctcctaaggacacaaggaagaggtggagacagaaaagccaaagttacttaatttggagacgaattctgtacaatcctttaaatgggtaaactgacattacaacttgcaaccattttaattaataagaaatgtggattttttaagctgcatttccattcttggtcactgaaacagttaaattataaaacttcagttgattcatttagctagtggtaagagatagaacatattaacaattgaactcttgtatatgcaacggatgtaatagttgaagtacgctatcgtcatagtattttaactcatcagatgcatcatgttcctgtgcaaacataggtggccatcttttatacagtctagcaactctttggtacttggccaaccttcacaaaaggtgcttgcatttataaattgaacaatcaaaggtcagatatgcgacagcaacagtgaatctgaaagaatgtcaggtactaacttctagagttagtttgaccatctcagcatcccaggatcaaataaaaattttaaggatggtttaagaatgtgcagtccaacttaggagttgccattagtcaattctctgagtttgaaaacaacactaaaatctgagctaattttaaaggaatgatccatcctgtgtgctgcactaatattcaataattatgttccaatctggatggcagacacaatctggatgggcttgaccaaggtttcatgcatgttgggtaatgaatattcccggggacaaaattaagcttgggtatgggtattcactattgatgcccgccatgcccaattgtcatccctatctatattcctgacaaaattaagtgaatacctaaaattggttttgtccaacacactgttgaatctattactcttttgaatatattgcagcgagcaacatttgaccgcagaagagatggaggcagagttcgctggcaagaaagtttcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5088 - DNA, 683 bp, Oryza sativa
tattttattttttcggatgatgcttcacactcaggatcacgatacaacaaaccacaaaaaaaatttaaactcgaactaccacttagtctgaaaatatctagcataccacttaatctactttgcaccttcactaaaattagaccataactcttttaataaaaccctttgatcagcatgttaaacataatgcactctaccactatatgaaattacttaatctaattcaaaatataaccacatgaaatgacatatataagttaaacagtacatagagatgcaattttttatttttattttatttttttgatattttttttatacttaggagaacataggaaccaaccgtataaaaaataaactcaaacggacaaaatatgtgacatgtagaattttccaaaactctaccgaaacggacaaaatatgtcatctattaaaataggcgtaactttctcatacggactcggaatcaggcaagtaatatatgcacggacatctacagaaaaagttacatccgattctccctgcttcgccgggttcggcgatattaaaacctccaaattccgcttgcaagattgtattttcgaggagagaagtttttcggtagagctttggaaaattccacatgttatatatttcgtccgtttgagtttattttttatatggttggttcctgtgagttccta

SEQ ID NO: 5089 - DNA, 1911 bp, Oryza sativa
cctcacttcaggcggagcctctccgcttggatgatagaccgattatttgagcctctccacttggatgatagaccgactatttaagcttggaaggagttgctttcctcctttctctccgttaatttgtaatctgtaatttgaacaatttgctatgtatctctttcctctaattagctctccccctgttgatatttcaaaaaacaacactcgctggaatagtggaagcagctagcaccccaaagatcattcaaatcacagatggacaatagacataggtaacggcgcttaattgattactctgtgcattagcatttgtttacctcagcttcccccaacccaagggccaaggccccaatcccaagcgtcgaccgacaacaaacggccccattgtcctgtagcatttccagtaaaaaaaaacaaccctattgcttcacttattcgagaaataagtgaaacgatgtaaatcctattgcttcacttattcgagaaataagtgaaatgaagtatttacagataaaaagtaatttataaataattttttttatgtacgtgttcttaacaatttaaaatcaaaggtcaaaaataaacttagatgaaaaaaaacataaaatcaactctaaaaattgaaaattcaaattttagctgataagtataagcataagcgaaaagatgaggctgaaagctagcagagccgcagaggaaccttgaaactgatcgaaacccaccaggtttcagccacccgtttgctcgaaatgaaccagaatgaagcgctcaggcagagccgcagaggcgaacatcacatccttgccgtattttcctcttcgattcaaataccatgcggcacgcacggcctgttggcctgattctggattccagtcgctcacatacacagccacgcaggaattcatatggcacatcaatacatatatgtacctcagcaataacaggaaaaatcgatattggaataacgggtctagaatgggccagatcggagaagataaaagatcatctagtttacaggagtactaattaatgaattgacagtactctgatcgacaggtaggatcaaacactgaaagcctgcatatatgcaggaacccgatgcaaaaacaagcattgttctgttcctgctggagcatgagagcatgcatgcatatatatatgcctgatcgcttgatcagctagcacgcgcgaacgattgattaagggaggcttgggaacatcttggttaattcagagggctctcgctttgacgatgtccatgctcatctcgctgggatcggtcgcctgcagctccacctggatcccgtccagctccctcttgaaccggtccttggagctcgcgtacagcatcttgctcctcaccttcgacgtgtccggcgacctggaaaccaagtgatcacaccgcagattcagagatccaagattagtcgaggcatgcaattcaatgtgaaggcaaaaattaattaaaaggcgctggttaaattcatatattttaccaggagatgaagaagatcttgctcttctggcagttctcgtcggtgacgaagtcgaagtcgaagacggcgtagcggcactcgctggcgggcatggaggcggtgaagtcgtcgtaggtgtcgcccggctggcccagcctgtccacgaccacctgctgcgtccgctcgtcgatcttgaacgtgatgaagcggaagctcctcttcgacttgagctcctggaacttgagcttgcactcgtcgcccacggccatccccgacgctgagttcgcctgcatgcccagatcaagcagcaacagcaacagcagcagttagacgtcgatcgtattggcatatgtaattggtcgatcgtatactcaccatggttgataggtttcgatctctgcacggcggtgacgaggagagacggatcggcgtg

SEQ ID NO: 5090 - DNA, 20330 bp, Oryza sativa
cgaattattgatgactatgatggtaacaaaacaactagagactggcagagaagaggcgttaacagactggcagagctccttgaatcaacacaaacgcaatgttgacacccaagaacatcacttctcaaaacattgaacagtagatcatattaaattcccgttgtacgttacaaaaccgtgatcccccaatagacaaaattgttcggaaggatcttcttctgtatcattactggtaagctacaaaggttacatagtttaaccaaagaattttacaactttcggagcttgttttacttttgccttagtgttggtattcttgtcaccatcgcctgtctctgtggtagattttgaactagattgtttagccttctttgccttggtgtgtcttgtttcttcttcttcaataaaatcgtcatcaaggtcatctccaccccggagaacagcattgtcttccaggtgatgctcctccgtattgaaagctagaaataagcagaagaccaaataaatgagcggctactaataactgtacggaaaaaagttaccagatgtttgatagcaccatcggacaaaattatagaccatctcaaacatataagaaatcataacttatctcacacattagcatgatggcatctgcttggcgccttagccagactgctactactaaaggcgtattcacccaattacccatcggcacagattctatgttacagtatagcatcatgttatgtttctttaacaaaacaaaagaggcacgcctggcaggctagtcattttctcctcataaggttagccaaatgcttacatctaagtattaatccttaattctcacatggatagaaaaggtaaacataatctgttcttctttctccaatgtattgtcaaaacaagcgtatggtctatacatccatgaaaacacttcaatggttatttactaaatgtaaacagtattaataacaagtggatacaaagatcagctacaagaagttagtgaaagttccaaattttttaaaatgaatcagcaaaagtacaatacacatgataccgtggaggaatgttaagacagttcccacaaaatgttacagttgaggtttgtgtttaccatcatccccagaagatatcaagtcttgcctccctctgtttggacaatgcttggccaggtgtgtaacttcaccacatatcttacagcaacctccctaacaaatgtatagagttagaatccacacgtaatggagacatgcaactaaataaaggaaagataatgcaagcagaacatccttcaaagtggacattttgagcccctaaatgcagaatgttatctcagtccaagatcttgtggtgataagggacaacagagtatctgataatacctttggataaatgccgtgtttgttttcaggacaattcttgctcaaatgtccctgctgtttgcagacaaaacagcttgcgaactttgtaccccctgtatgcaaaaatcatgctaaatgtgcgaggaaatcatatggctgagggtaactatttgcaggtatcgagtatggaaactggcaactgtatgagatgaaaggatgtattatttaccattttcaatgggtttggggcacttggaaagtgagtgcccagattcaccacaattataacagaatttcttcaaattttcatcatttttgtcagggcaattcttcaggctatgacctcgttgcctgcagagcaagcaaatctgaaagaagaaaatataaatattaaattttagcttgaaaaccacaaatgaactggtcagactttgaggcaactaagtactgaaaaaaaaaatactactgactgaaaatatataactgtgacagccagaatccactgattaaaggttggaatggaagcagtaaaacacttatcaggatggcctccagaagtcaccgttttgccattcacctagagatagatacaacgtgtgataaaacaaaaaaatacagaacaaccaatacacgcactgcccagtgcccactgctaggtattgcataacgtaaataacaccccgcaacattaaacagaacaaggcataaacagaacaataaacagaaaacccatactgatttcgttggttttaacccccaataataacagaaagtcagaaagtacaaatgctgatctaaacctaaggtcaccttaattgacgttcttaggtccatggcttctatagcaaaagacattgggccgagcaaaaattatccccaagagcttgcaaaaggcagggattttgagacgaatggtggtaggcagataccttgttcttctcccagagggacttctcggggcagaccttggcgacgtggtccgcggccttgcagatgaagcaccgctccccgggccgcatcccggggacccggagcgggtgcttcgacctccccgcgcctcccccacccgctttactcgtcttcttgaacatgctcttcttgttgttcttcttcttcttggtgccgtcggcggaaggggtcgggttggcgggaaaaaggcccgggttcgcctcgcggaagcgcttccgcgcttcccgctgccgcttgttcgccatcgccttgggctacggacgctctctcgccgtcgcgcgtggtgctgtcctcgagcttggtatctcactctctctctctctctctctgggcggcggcgcgcggcggcgggggacgggagtcgggaggggagcaagggaacagccgagcaaggagggcttcgttttgggaggcgctgacgctttgagattcgggctcacgccttgatccaccgtccacgcatctagaagcagtgggagccactccgcgaaataacggctaaacgaggggtatttctgaaaaaggcaaatcagggatctttttgtaaaattcgcgtcaagcgatctttttagataattcaaaaaaaaaaaaaaaaatggattacatcgattctgccataagacatacttcctccgtttcacaatgtaaatcattctagcatttcccacattcgtatcgatgctaatgaatccaagacatatatatgtcttagattcattacacaatgtaaatcattctagcattccccacattcatattgatgctaatgaatctaagacatatatacatttttcacattcatattgatgctaatgaatctaagacatgcatcaatatgaatgtgggaaatgctaaaatgacttatattgtgaaacagaggaagtacaaccataagtttaataagaaaaaggtaaagataaaaaatgtaaggggagaaatctaacgcaaaaatggtccagatgtccagcagttcagcaatcagcactctagactgaagtattgaagtcaatggcaatgcaatttcctgcatcgagtaattcagcagccaaggcaatttcctgtaaggaaccaatggatttacaggttttacagctactagccccgtctattcaaattcaggtacagatttcatcagtggtacaaactggactgtccaatcaacgtttatagagagactcccagaggacaccgaggtcaacattgcctccagaaacaatgatccctatcttactgctctcatgccaagcagagctttgcttaaactcgtcagagagggcggctgcgaggcctattgctccactcggctcaacagccaccttcagcatctcgtagcacattttcatggcgtccacaatggcattgtcatccacaacaatgatatcatccaccaagtcgcgcaccaccggcctaaaatgcagagatcaaatctaagaagttttcttgaagcatgactgcctgctgggtcaatagatatttcaaataaaaccgcataaatatttgcaaatgcatttggaaaagattgatgctgacaacaggttaacattttactatggttgtaattagtgtggggaatgcatttggagaagattgatgctgagaatcggttcaatgtataatgctttaccatgtcaggtcaccaagaaaagctcgaagtccatcagcaatggtgttggttgaaggcaatgttatgatctttccagcagccttggactgggcagaatcatcagcaccctttggttctgctgccagaatacgtattgaagggtttatggccttggcagccagtgccacaccagaaattaaaccaccacctgtagtgtagccaaaagtatatgcatgcgtcaaaatagaaaagaaagacttgtgttacagaagaagttaatacagtagagtacagaccactgattggaacaattattgtgtcaatttcagggacttcctccaaaagttggggagactcgcatacctggtcgactgaaagaaatcatcatatcagaatttgcatgattcactgaaaagttcatgtttgctattcaataagctaagagtacacattttaaagtggcaagacatggaaagaaactaaggttgttaaacacaagctgtatgaaatatgtcaagtagatattgccctttttagtctaggctggtatataaaaaaaatcatgaaacctggatgaaatatgatttaagagtaatgatatcatatacagtttgaattaagtgctgatttcatgaattgatagtgaaccaaggctactatcaagtaatttcatatactcgtaagaagaagagcctatcaaagttcaccccgctctgtccatttcaaatcccaaatggacttcttttgcatcaaagtagtaagctcaggaattgggactaccagataaacaatagagtactagtgacatgttcaatccacttagactttagcagcaccagtatctaggggtatgatatgttaaagcaaacagcttttagtctctgtacaatgtgttcatgatttgagatatgaacaaactttccgcatagcaacagagcaactcaataaaaaagaacttagaacagagaaatcatacctgatagtgtttttattattgaatgggtgaacaagaatagcaccagtttcctcctgaactcttttagcaacagattctcttgattcaatggagacatcactccagataatatggccaccgtaccgcttaacattgtcaaccttacatgccggtgcatttcttggaatgacaatgtaagcaggtattccgcgtagctttgcagcaagagccactgcagcagcatggttcccactgagaagaaaccatttcaatcagttcagttcactgtgatgcttcttaggattaggatgccaggtaacattgcaataactatgaagctagcactaacctgctatgcgtcacaacgcccttggatgcctcatcatcatcaagcgcaaatatcgaattggaagcgcctcggatcttgaacgcccctctacatcatatattcatatccccacacaagcaattagcagcaggtagaaattagcatggcagatatgccaaacaacacgcgggggggggggggggggcagggactctcacgccttttggaagcactcgcacttgaagaacaactgtttccccactttggcatcgatcgatgttgatgacagaacgggcgtcttgtgcacgtatggtgcgatgcgagcctgcgcctccctgatggagtggatttccgcagcattaccattgctttcttcgccatcgccgccacttccacctttgctccccatcaggccctagtaagtactcgtgttagctagcaccacatcaattctcaatattgtccttagctcagtgatatgggcttcaaattcagtgactgaaatactgcgcgcaagatagtaactagtattccatcaaaagaactgcacaaaaaataaaatctatcccattacattgaggggagggcaaacgcaaatggggactacatcagtgaagtagtactgcatccccagaaagcattcaccagagaaaaataccaagaactttatgattcgagcaggcaaggtgactcaagaaactaacggaggatttgaaggagcaggtgcagaaatcttgcgcggagaggaatccgaagcaaggagaaatcgcctaaccttgagtgacagtccggcaggagatttggaagttttttttttttcctatttgagcgatgaaatccaagaacctaacgagaagaagatggcgttgtggtgattgacgacttgaggggcagccgtgcagcctgcaggccactgtcttgtttgggctaaacttatctaatgggcctccattgttgatatctacgagatcgtgtttccgagcccatttaaagcaatttgcatctgctcagcccatatcgggtattaaccctaccgattctgagcaagaaagtcttcacctgaatctttcgcatttctgcttttacgtttgctccctggaatactagattcccagagcatcgagctgcgacaagtaatagctattaagccgataataattatactcgtcaagcatttcttgatcaatctgtgatcacgtaatggcggtagatacagaaagtattctagttttgcctttagggagtaatcgatcactgagtgtgagtcattcgcagatcaccatacgtaaggaaaggatcacagggaaacgctcatcactgtcagtgttccccagggaggtcatgaaatctgctcaatggggcacggcatagtgtattgcctctattttttacaagcatttgtcgcgcttgactaaaaaatgcacacattaaggaaatcactgtcatattaattttgacaaaaatgtcatctgctaatgctgttgcatgaaaaaatttgacagttatcatctgctaaaagagaataagagaccatattgatgattggctcctgctaagggtggagatcgctctatgcgggctgattccagagttgacattcacattttgcctgggcactaaattaactacggatagatacagcttagctggacgatgacttgccacttggaatgtcggatactgcttggcttttcttcagtgattccgtaggctactgctacaatcgatgtcagtagtgacacctgcctctacctgcagttcttcaggattcatgtactaagaacccactcaggaacaaccttcccctaaacgagctgaacagctagtcttaaacaaaccagttgtttaactagaaattaagcagccagctcaactgattgactgtcaggttaagctatcgcctatcggatgacgccacgatgcagtaaaacaaaaaacagcgccttgattaactatcacgcaactcgatcggattagctcccatgtgtttgacttttggatgccaactttgcgttaaatcgtccgagtttgaatttttcgcgcgattttaaacgaagatgccagatggctcttctctaaacaacgcttaaagataccatcagagcaagaaatctctgcgtggttcgagagattagctgttatccagggagaaccgtcacctgtttttgttactactccagttaaaaataacccaaacctgatttgacttcgattgtttttgaaacgccggccggttcgcttacacgtctgtgcttgaaaacaaattaatctgagttgaatttgattcgttgtttcaagaggatttcctggcagcatgcccaaccttgttcggctgttcccacatattctataattcaaaatttgatgcgaacgattgcagacgcaagtatgctggcaccacaagcgaacgaagcaaatccaggtcaaatttgaatttaaaactttttctatccaaagcgctccggtcatccaggcgtttaaatatttattcggggagtacttgacgtgtggaacgtttaaacgggaggcgtgatttcaaattgtaaacggcatctttgtcttttgtgtatgaatgtcttagcccgaaagacgtggacagatgcattttcaaaatgacctataccctccgtttatgaatctggacatacctaaatgtccagattcgttatgtcaaaattcgttgtattatactaggttaatctatttttgaaacgaatagagttattaaaaggctgcatgttaccgtcttccagagccttccagcccgctcaaaacaaaaagaaaggccctgaaaatgtcagcaaacggtagtgatccagcccacgtattcttgaggcccaagcccaagtttgattgtggaaaagaatctactatacgcacacacgtccataacaccggaacgcgcatcagcgcatcactgctagtgtttaatcagtgaaaaatgcctaggatgcataaaatttaataggcgttcatattccagctatatgaaaaataataacgctaaagtgtcaaacaagatttggtattactcgaagcacctcattttatctgtatgttaaaggcttattcacttctcctttgaaatggacactacattatcatttattttaaaagattgcaccaaagaaaaattcctatgcctccacttcaatcctttggatcgtttgctacacaaccataagaaattttcctatgtttttcaattcttaaaagtttgcacaagtattcccatactatttctacatttttttctattattacattttgaatatcctagaaacttaacaagccctaaacttataccattcacgttttgaatattaagtaaccatcgagttgtattttttgtgggggttgggggggtgtgataaatcttctcacactttggtttgtgtttaaagcttgaaaacctcctctcccattgacccatttatttgttgaaaccacgttttcgtatgggaactagaattgattacctgatgacaatgtaaccacatcacatctatttgtaacataccatacctgttaaataacttcccattataaagatcttaaataggagtacagtctaaataataatgcattgcaatctgaaaaaaaaaaacaccagtttcaagtggtgcacttaaccatgtcacaagcatatgctcgaaatgcaatggcgcctgacgtgtaccccaaccaggctgagagagcggtcatcggtcgacgtcccaactttcttttcacctcacgctacatgttgcagcgtttgcgccgttgcgctagcatttatgaggtgcacccataatttttcctactccaatgctgcgttcgcgagcactttcgtgttgcgggtttccaatacgtaaccatgcgctagagcggtcgcgctctcttttttctttcttttttcattttttaccctctttttagtttttgagcgagcacgacgatccaccccaccaccccggggccccttacgccgccctccccgaccctataaattcggccatgtttaaaccatttcaccacaaaccagcagcaaatcaaacgatcaaattgtaagaaaggaaaataaaaacagaagccctcttccccaaactcgagggggtcacgcgaacacgctgccaatggcggcgagcactcgagccctcttcctctcctgcttccacggaagcggcggcggcggcggcacttccgaggtgagccgccgcctcgtgctgcggccgcggtacccgtccatgccgcggcgaccgaggtcggccgcggtcgccggagagggaggggaaagaggaggaggaggaggcgacggcgatctggaggcggcggccgtgggggcggaggaggaggaaaaggtggcggtgttcgaggtgtccgggatgacgtgcgccgcgtgcgcgggctcggtggagaaggccgtcaagcggctccagggcatccacgacgccgccgtcgacgtcctcgggggccgcgcgcaggtcgtcttctacccggcgttcgtctcggtgagtatcgaaggctccgtcgctccgatttttccatatattttttttaaagcatgccgcgtttcttacgggctgcttgcttcccgcacgaccagattgatcagcctgtggatagctaggtaaatttaataaggggaaaaaaatgaatgatgctttgtgtgcgacatttttcggttcatactccataccgttagttgcgggtgcttatacgcaaagtggtttgatcttggaagtaggtacacgggaactttattaaattccaggctcccaggctccgggctcccagctatttagcgcgtagagacaaatacatagctgtgtaacattagcagtagatagacaggtagcatatcagacacactgattaaagcatgtttttatgaacatgttattagaaatgtccatacgcatagtatcacgaaaaaggatttgagtgagctttaattgatgctccacaagttcagaaatacttgaaatgtgaggtgggttcgtgaaaagttctctttgcggtttagaaggttacaagtagacatctttgcttgtgacgttgaactgctagctgcttttggggatcccttgaaacatggattggcctgttggatcccaccaactccttcagctgcaagtattaagatttgcacagacctgtagtttcaatatgaagacgtatttgataaaaaaatggacgtcctgcttattgtttgtagcagacaacctctgcttctggacagaaagtagaaaggaagaacaatctaatgtgcatgtgccatgtaattctaatttacctgatattcccaaaacgactgtttcaagttctttttactgaaatcagaatttcagatttaactaactaattttctgtaccacgtaaactttgtacttacctgttttgcttggcgacttttacactgttgcactcttcattctgttgcaaagttccaaattgttcatttggtgttccttccactagatgcaggcatatgcctgattagttactactaatactacaagttggaatatattttcttattcaggaacaatttgttactcacgtttatcatctcataattacgctctctgatcagtggcgcatttggggatgcaaaattgtaatcttattccccatcattattatcctgaatatattttcggaaaaactaatattttatttgatcaagatgtgtcgcttttaatcagtatcttgaaatttattagaacgaaagggggtgccttttctattattggatgtcattttcccactgtgcaaggctgtaagttcactgttaaagataatttcatttgatccccattgtaggacatgaaacaaaccaaagatatttcaacatagtggttgcttggtcatgcatttccttatttgtgtcaactctctctgcatctagtaacttttggtcagtaatagttagaagatgctggcacacttatggataaagtacattgcaaaggactgatattacaattcgagaaataatctttgatgtaaggattgaagttttgtttacaatcttttgagttgggtggcctgtataacacaaacagtatttcagttatctctgtcaggatcccactatgagctgaagcctgtctttgtcaccgtcccattggatagtgcctctttcttcgtagcgctttatattgattgggaattaaaaagaaagactatttgtgttttggatctgttgaatttctagaaaacatatattagttccattgcattttggataactttgttgttttctgtatttgatcaacatctaacagaacattttcatagtggtaccctttttccattttttcaatagttttacttcatgtttttacattacacatgtccacatgtttcaatccaatttttcttcctttcttatatgtttggaaattgtgctcatcaatgccatttgacaggaggaaaaaattagggaaaccatccaggatgtgggctttgaagctaagctgattgatgaggaagtcaaggaaaaaaacattctagtatgcaggctgcacataaaaggaatgacctgcacatcttgtgcgagcacagtggaatccatcttgcaagttgttcctggtgttcagagagcttctgtcgcattggctactgaagaggcagaaatccgttatgaccgtagaatcgttactgccagtcaactaacccatgcagttgaagagacgggttttgaagcaatactgatcaccactggagatgatcagagcaggatagacctcaaagtggatggcacactcaacgagagatcaatcatgatagtgaaaagctctgtccaagctcttcctggtgtggaagacataaaagttgatcctgagctccacaagatcaccatctcatacaaacctgaccagacaggtcctcgagacctcattgaagtcattgagtcagctgcctctggtgatcttactgtatcgatatacccagaagcagatggaaggcagcagcatagacatggggagatcaagcgatacaggcagtctttcttgtggagtttagtattcaccatcccggtattcctcacctccatggtgttcatgtacatcccagggctgaaggatgggctcgaaaagaaggttattaacatgatgagcattggtgagctcttgcggtggattttgtcaacgccagttcaatttgtaattggccgcagattttatactggtgcttataaagcgttatcccacggctcatcaaacatggatgtactcattgctcttgggaccaacacagcttacttctactcagtttactccatcctccgagctgcctcctcacataattacatggcaactgatttttttgaaactagttcaatgctcatatcgtttatccttcttggaaagtaccttgagatcttggcaaaagggaagacctctgaggctattgccaagcttatggatcttgcaccagaaactgcaactatgttgatatatgatcatgaagggaatgttgtgggcgagaaggaaattgacagtaggttgattcagaaaaatgatgtgatcaaagtagtcccaggtgggaaagttgcttctgatggctttgttatatggggacagagccatgtgaatgaaagcatgatcaccggagaatcacgacctgtggcaaagaggaagggtgacactgtcataggagggacggtgaatgagaatggtgtgcttcatgtccgtgcaacatttgttggatcagagagtgcccttgcacagattgtacggctagtagagtcagcgcaaatggcaaaagctcctgtacaaaagtttgctgatcagatatctagagtctttgttcccctggtaagttcagtttcatcgtggtaattcaacggatatcatttcttatcaattctaaatagtcttcttcatcctttcaggtcatcattctttctttgcttacttggcttgcttggttcttagctgggaggcttcatggttaccctaactcatggataccatcttccatggatagctttcaactagctctccaattcgggatatcagttatggttattgcatgcccttgcgccttagggcttgcaactccaacagctgtgatggttgctactggagttggtgcctcacaaggagttcttatcaagggtgggcaagctctggagagtgcacagaaggtccataaaaaaacattgtacttttagatgcacatgtttgcaaacatcaaattattgacaaattttttatggcatttataggtcgactgcatcgttttcgacaagacagggacactaaccattgggaagcctgttgtggtcaacacaagactgttaaaaaacatggtcttgcgtgaattctatgcttacgttgcagcagcagaggtatgctttcaagcttgctagatctttttgattcaatgcctttattacttgtagcaaaatatcattcctttgtgatatatgaaaaggttggttgagggcatagatgtatgcctagacccacccaagttcaagtcctcatcgaggcgaattcggatgcctatttcttcttaattaattaaaaatgtcacctagttcctcctaggttggttaaggttcttttgttgtgatttgtaaaaagaaacattgctcaaattttatcggttctggtcttcaggtcaacagtgagcacccactgggtaaggcagtcgtggagcatgccaagaagttccattcggaagagagccatgtctggactgaagcaagggatttcatttcagtgacagggcacggtgtcaaggcaaaaataagtggcagggctgttatggtgggaaacaagagctttatgttgacttcaggcattgatatcccggtggaagctttggaaatcctaacggaagaagaggagaaggcccaaacagcgatcattgtggctatggatcaagaagtcgtgggcattatctctgtatctgatccaataaaaccaaatgcccgcgaagtgatttcgtatctcaaatctatgaaggtggagagtataatggtgactggggacaactgggggactgccaatgccattagcaaagaggttggcattgagaacacagttgcagaagcgaaaccagagcagaaagctgagaaggtgaaagaacttcaggtgagctatcataaaatcttttgcatgtctcctggttttttttgccgtaccgttatttggttattcacaccctccgatttttttttactcttgcagtcggccggaaggaccgtggcaatggttggtgatggaatcaacgattctccagcgcttgtatcagccgacgttggcctggcgattggcgcaggcactgacgtcgccattgaagcggccgacatcgtcctcatgaagagcaacctggaagacgtgatcaccgccatcgatctgtccagaaaaaccttcttccgcatacggatgaactacgtctgggcgctcggctacaacatcatcggcataccgatcgctgccggggtgctcttcccgtcgacccggttccgcttgccgccatgggtcgccggcgctgcgatggctgcttcctccgttagcgtcgtctgctggtccctgctgttgaggtactacaagagcccaaaactgggccgttgatcatgcagtacacacgcatagcatttgcttagaataagaggtgtagatatctgttgacaatgtgctaatgtggttctaaaagaaatgtgctagtgtgtgttgtgtggcacctgaaatgtgtacattacctacgtatatatgcaccgtgtgtttacaagtgttaaatatggagcactttgccaacactagcaggtgatacgttgtagtgcaatccatctaatcttggcacttcctaacaatggaggggacaggtcgtcaatctcaaaagcagaaatgctaatgcttcgtgatgatgcccgggtttcccgtgcaacttggctaatcgacgttggtagttacctaactctttttctgggtggcatcatagtaacctaactaagcagtttagcacgcaacgcgcaattgagcacacttcgaaccaaaagatgccctgaactttactactactacctacgtggctcgcagtgggaacatttggtatctgagctgaaactttgcatgggaatttgggataatttggccacttgcattctgagctgaaagatagtgctccgactagggcagtggagctatcttgccgagagcaggcaaacacaactggttcagtcttcagcttagctacctatacaccttcgctcttgtggccgatcattgtcaagggccataacccagccaccgaattaaggcttctacctgatccactgacctcattgcacttgatgatagtatacgatcatacgactctggaaaacatgctcgatggctatcggttgcattattgaatttgttgcttgatccgccccatgaacaacagtaacccatcataaacattgggacctgtagtgagtttttatgggctccatagcctgttaaagcaaaaggttactttagatccttaaataaaggtctctcaaccacaaatctagatataaaataaccctaactattaaagccaatacaaatttaatccctcagtgagagatcgagcaggaattcctaacggcggtgacaccgagctaggatatcccctctcttcaaagtcgctgcagctcagggtaggtgtgctatacgctgttgggaagagagagggcgagggagtttaggctttttttttataatgtgaatgacatgtggatcttatatttttaaaagttttaatgtaccattattactaacatataggtcccattatatatttatttttattatttttttcagatggtgtcacacataaactccacgtcaaacaaagactaagtcaacgtgttatgtaggacaaaacaaccatctaaaaagatcaagagacttgatttgtataggttttgctagttgggctacgcattatagctggttttacaattgagggatacgattcaaaactcgactcctagacaaaggacctacaattggacgttatcccctgttaaaaggcacacggctagaccagaccagaccacctacgttgatcgttcatcgtgtccgaagcctaataaagcccaaacaaaggattttcggcccagcacagcctagctccacataggagaaagtacacccaaggtccctcaacttgtcatctaattacaaaatcgtcccccaaccgcaaaaccgcacacaaggcatccatcaacttacaaaaccattgtagactagatcactcggcggttttaaccctggttttgtccgaagtggtggctgagtcagcgtgagacccatgtgggacccacatgtcattgaaacattagtctattttcccacacttctttctatcccctcccttccaagcagatcggcaacggcgtggggagcggccgtccggccggcggagcgggcaggcgacggcgcggggagcggccgggcggcgggtgctcgtcctcctggtcatcgaggccagtggccggcatgctggtcggcaacgggcgcaagcaccaggctctgacgacgaggttctccaagacgggcgcttgtccccccggtctgcggcgaaacggcattcggcatggcggacgaaggcggcgcaacatccgggtgggggagaagcgagcggaggagggtggcgccgataaatcggtgaaggcggcggcgtccctccccctggtggcgatggagacccagcggcccttccacaggcggcgcaatgcacggtcatcggcaccaccatatgccggccgttcttgtgctgccgccaccgccaagccgacaccgacgccggcggcgagcgcggggaggcgttgaccgagctggaggaggacgacaagatggcgccggcgctgagactcctcatgcgccgtttgccgcttcctccactccgccgccctgctcctcgtcgccgtccgctccatccctaaggagctctcccctcgcctcctctggacccccgccttcgagttcatcgccaacgaccgtggccaccccacctcctccattccacgcgggggagctcgccgacgactgatttggacttgggaggagctcgccggcctccccgcgccttctctgggccctcgccttcgaactcatcggcgacgaccgcggccaccccgcctcctctctttccacgcggtggagctcgccggcgatgaacgatttggacttgggaggagctcaccggcctctccgcgcctccgccgggccttcactctcgctcgttcgctggcctccgccgtgcctctgccgatgctcaaggggagaaatgggagagagagagagagaggagtaacggaggggagggagaagagaaagggtgttgacgtggcatcctgacatgtggggtccacatgggtcccacattgactcagccaccacatcggacaaaaccgtggtcaaaaccaccgagggattttgcaatggttttgtaagttggggatgcgttgtatccagttttgcagttgggggacgattttgtaattcgataacaagttgagggaccttgggtgtactttttccctccacatacgatattcgtgttgcggcccatgaggccatagaccatcagttaccccagcccgacccatcgtgctgcaagcctttgcaaccatcgacagttgagcaggccccccaaacgcgatgggcgtgggccgcgtggcgataatgtgtgcgccccgctcccctcatatccgtgtccgtgcacgagtgaacaacccaacccaaccgatgcgcgacgcagtgacgcaggcacagcgagttgaccggccgcgccacgtacggttggttcctcctcccaacacgcggcgggacccgtctccacgagccgccgttccctagaacgcggcggcaacgagcatcctcctccgcgtgggccacacgctgcgtttacaagcgttcacaccttcggcctggccttttttatactcccccccttccccaaggtgatcacgtctcgtctctgtctctcggcccaccgcttccatcgttcgtcctcgtctccacgctaccgtttcgcaaccacccgcttcctcctccggagaccgctcggccgccgctcgctccagcatggccgccgcgccgtccgccacctccgtccacgacttcaccgtcaaggtcagttcctcctctcggtcggcggcgctcccttctcgaagggatctgtcctgcagtgattgggatgggctttccaaaacccgaacccgctcgagcagtcgagccgtgcgtactttggggggtgggtggggggggggtgcctgtaatccggggtggtgcttgacgtgaatttgttgagcagtagtaattgggtgtttcaccgaatttcttagcttgttttgcttggtgcgagggcgtgcaggatgcaagcggaaaagacgtgaacctgagcacctacaaggggaaggttctcctcatcgttaacgtcgcatcccaatggtacttaattcacttcattacgccccccattttatgatggaattttactactacaccgtctacacatcaacaggttgatgtaggattgttttagcggaatggctagctagaaaacttccgcaagtttttttttcccccaaaactttcagatttgttgtcttttgccaaagagaataataaactgctgcaaaacagaatatcactagcagattcagagcatccccagccctgttgagcagttgaactgaaccggtcccatatgaatcatgcaaatatcatgatacaagcacagctcattaactcattaactcgtattgtgaactgcgatactgtctttgtttggtctactgcaaagatggtccaaatcaataggtccactgctgcttattttatggaaccgttttctgcataattgtccttatctgacgtaggcagctctatatatatttttttatctatatggaaccatttcaccttacaccgctaagcattttcttcgaccaattatttcagtggcttaactaactccaactacactgagctgagccagctgtatgagaagtacaaggtccaaggtgtgtctttgacccgttgcctttgtatatctttgtatattgtaattgcctttgcatattgtactccttcaccatggaagttggaataattatctagttcatggtcacatggatcattaagctttagttattatatgtgctagtagttcttcactttaaacaattccggttgttgtggttcaaaccgctaaggaatattaccaatgtgtgatttgtaggctttgagatattggctttcccgtgcaatcagtttggagggcaggaacccggctccaatgaggagattgtccagtttgcttgcactcgcttcaaggctgagtatcccatttttgacaaggtaagttaacgcaatacttttaactcaatcagagtaattatcagtgtgaagcaaaatgatataagtcacatgttttatctatcgaagaggtgtttctgtggagtagcattgagtctcttttttttttatctgtcaggttgatgtcaacggtaacaatgctgcacccctgtacaagtatctgaagtctaacaaaggtgggcttttcggtgatagcatcaagtggaacttctccaaattcttggttgacaaggagggtcgcgtggtggatcgctatgcgcccaccacctcccctcttagtattgaggtaatgtcctgcactaccacttgcaatctctttctacaggctgaattgttaggctctcattataacatttccatactatctctgcagaaggatatcaagaagctgcttgggagctcttaaacctaaaggtcgggatctgtagagcaacctgcacttatgcactgtattcagcactgagagttgtattaataaattggtgacatgtacttcacaggttgcatttgcactatactccttgcatcctgaatctttattgtactctgtacctgtatagttttcatgtcaataaatttccttgctgtatctgtgtgtatgcatctcattggatcctttgtcggcgtgcactgtattgttcgtttattaagatagattcggccaaataaacatgcaagtatgcatttgagctgtcccaaccatggcaagcacaagaagttgcatggggggatgccttggtcatgcgttccaacagtttaagatgaa

SEQ ID NO: 5091 - DNA, 4641 bp, Oryza sativa
cacacactgtgctgaggtccatcagaagttctaacaatcgtcttgtgacacctgaaaggaacagggaagcgaacagcaaattgggaacaggaagccgcatccaaaccttcaatgccagaacttgaggcagaagtgaaaagggcacatcagacactgcattaacaggatagcttgatcctttcaactcaggctctgtgtagttcccaaaagaaaattttttacactgacaaattgaatatttggacacatacatggagtattaacaattacatagattacgtgtaaattgcgagacgaatcttttaagcctaattgcgccatgatttgacaatgtgctgctacaataaacatttgctaatgatggattaattagtaggggtgaaaacggatcggattcgggtggatagtagtcataccatatcctataccatattttttaatcggattcggaggcggtgcggataatgtgcggatgcggatgcggagcggattattttggatgtcggaaatggtgcggagtcggtgcggactcggctcggaaacggataaaaataatcggatgtggcatgtatatacaatcgatacaacatctgatcatctgtacaatgagcaacaatgactcacaattcacatgactcatgaaagcaccgatcacatcataatataatgtcaagttgttaacgattgacttgtcttctgtccatgtaatcgacacatatagtattgacatcatgatatatcgcattcacataacacgtaagacatagaaattccacaaatattagaaaaaacaatatcacatgacatgggtgatagaacattggaggtccacaaatgatgtccaattctcatacagtactactaataagttgcatattgcatatgacataataacacatatgcagctaaggtcagaaggagatgatctagagaagtagacttcaattctgataataacacatacgacagagttggtgctggagatggcaggaggcgtcgccggcgccgagacggagacaaccaggtgactttggggtggagaaggtaggccgcggcgccggggtggaaaaggcaggtggcggcggtggcgctgggtggagaagtcatgcggcggcgtgggaggaatggaagaagagaagtctcgatgaaaaaattggttgacacgacgccgacggagtcacggactgaactcctagatagattgatggataaggtggacgtggatgggctgaatgtttacacgatgaaaatgctcgtgtcaaatgggccaaattgagaggttatatgggctgtgaaattcggattatccgccaaaacgtttatcggataatccgcttaaaatagcggataatccatatccgccggatataaccgataccatatccgcatccgcatccgcatccggccggatatctaaaaacccttaccatatcctcacttcggacggattcggagcggataatatccgtttcgttttcacccctattaattaggcttaataaatttgtctcgcagtttccttacggaatatgtaatttgttttgttactagattacgtttaatactttaaatatataccgtatatccgatgtgacaaacaaacccaaaaattttccccaactaaacaaggcctcagtaagtttacttcatgatctgcccccaactaaacagggccactaaattgatcgagcagtggctgacatggaagcctgctgctgctcctatggccggaatggcgacgtggccagatgggccttgagatataagatggtggcctggcccaatggcaaagccaattggattaccagaacagaatcatcaattccaacgtggcaatctcggtacgtgattacctcgtgatgtaagcaacgaagtcatccaggtctttgcgcgacgaccgacgagccggcggcggccacggaggcgcggatggcatctccgagctcccgtgcacgttgtcgcatggctactcctccgttagaaagcatggcctcctcgatggcttcctggatgtccttcgccggcgtgacctcgttgtgcttctcccatggccgcacgaggacgccggccttgaggtacttgcagaggagctcggcgtcccatggctggtcgcagtgcatgggccaggcaagaatcagctacccgtggctcaggctctccatggtggagttccagccgcagtggctcatgaacgccgccgtggcgtcgtgcgccaggatctccagctgcggcgcccacccggtgatcaccagccccgtactcccttcgttgtgctgcgtgaactcgcgcagcagcttcgcgtggcggctgatgatctcgccggagtcctccgcgaatatgtctccgcggtcggcgtcccgcaacacccagatgaaccgctgattgctgccgcgcagcgccgatgcgagctcttcgatttgctccgctcgcagcgacgatgtcgtgccgaaggagacgtacagcaccgacgcagggggctgcttgtcgagccagtccaggcactcgtggcgctgccgctggtcgccctgcttcgacgcgttcccgtgcagcagtgggttcaacggtccgacggcgaaaaccttcttgccgtcggcgggccaggttccccgcgacgacgtcgatgaactcgccctcgagcgcgcgacacgtgttggtcaggatacctctgggaggcgacatctccttggtcgccctcgtccgtctgatgtaatccacgaactcctccgttgcacagtcttccacggtgatgttggtaaggccgttctcgcgcaggatccgttggtgctcctgggagcaattcctcctagcgagcatcgacacggccaagcagtacatgacgaacgcttcgccgttgtgcagccgcgccgcctcttgtgcgcggaagtcgttgatccggtcgtacccgacgacaacccgccggtaggagccggaaagcttgtcgagaaaacccccgaccggggcgggcgccccgccggtgtaggcttcccaaaggggcataaggtggaagggaaaggccaagcgccggcggggtcggaagcggttaggcgtacgtgcaaatgccgaggtcgtggaaccggacggagcggagcgccgcgtcgtccccgccctgcacccgctcgcgggcctggcggacgtgagccgcgggcgccgcgtagtgcacgtccaccccgccgcgcgaggcgagctgcagcgacaggtgcaggagctggttgaggtggccctgcgccgggaacggcaccgccacgacggccaccggctccattgtaggctcgatgactgtgctcaaccttgatgggcagatgcggctatatgtaggctgcgggcactggcgtttgcgggtcagagtgagctcagccagtggtgaatcaaaaggcaacttggcatccgtgtggaaatgggttgcaccggaagcttccgctgcaccgctaacggctagaattgctccgatgcacagccgactagcaaataatattccacagtccacccggctccattgtgtgtcataccaccatttttctgcgggagaggattctaataactcgagtggatgtccacccgtttattgcatatgaactagatggttatgaaaaatttttaaaaaaattgacaagatatatcaatatgtaatatatcactccacaaacatgcaagttcaaattcaacttctacaggttgtaacaaaaataacaaatttaattgtaaatatacatatagtaatttgagttttgtttgttacaacttgtagaagttaaattttaacttctatgtttatgtattgatatattacatattgatctatcttattcatattttttttatttttttataactatttagataacatacaataaacgggtgaacgtccactcgagctgttaaacagtttcccatttttctgcgcctcgttcggcggcctatatatgaggttattttttcccaaagacaatgttgtacgtagtactacgtatatgcttacgtgcagacaccaccatacacatccatccatccatcctctcaagcatgcggttttgccggctgcagattggaccacgtggcaccgttaaaagttgagataaatacgagaaattacgaatggtaaaaaactccacagcggtaatttcgggtgtttggtctcgcgcggagagtcacgtccttgtcaatctctctcgtggatgggcttgatcagcccatgagcgtagccaggagccatgttggcccatcactatgcgtggacagtgcgggctgagccaacctcgtgcagtcgtgctgagctgcccagcctcccacgcacgtgggatgtggcttagccatgttggtgcacaaacattgctacgggctgaacgccaagccttgtggacagtataaacatgttgcagtatcaaatcctaaaataataataaagaagtgtggtattttgaaaattgaagattaaagatgtaggtgccaaaccaagctgttagggcatccacaatgtacttcaaaattaagtagtccataagcaatataatatttattcagctacctagcaacattgtggaattagtccataaaaaaaaataacaaaagctacccataagcatatgggttgcccatagagaataaaatatattatttgtctctatctcttctctcctactaata

SEQ ID NO: 5092 - DNA, 4504 bp, Oryza sativa
aacatgtagcagtatcaaatcctaaaataatattaaagaagcgtggtattttgaaaattgaagattaaagatgtaggtgccaaaccaagctgttagggcatccacaatgtacttcaaaattaagtagtccataagcaatataatatttattcagctacctagcaacattgtggaattagtccataaaaaaaaataacaaaagctacccataagcatatgggttgcccatagagaataaaatatattatttgtctctatctcttctctcctactaatactatttgctatccatatagtttgtgaaggttacaatagttaaagttcatatatatgggtctcatctctatagactacttttgccatatacattgttgttgcccttagcatcctgtattatcaaagtaatattaacatacaaaccataaagtagcaaagcttttatccttccttcaaataacaaataaaatataaattgtaaattgtaaaaacatttaatgctaactctacgagttttactgtttagggaagtgtggatataaacaactccaagaaatacaatgggtgaaactgaaattcctaacaagcaagttaacaatgatgttatcctatatctatattcgtagagaatgaaaaaaaaaagaaccagagaatgcaaaacaatcagtactagtatatgtattttcttataattccccaaattcaaacagattatatgtaaatactttcaattcacaaaagtggcaaaagattccaaaaatacagttttctacattaaactaactaccaccttgaatgctttttaagcatatattactatcatactttcatttttttctcttcataattctacaaacatgaaactaagaacacactaaaacatacctttaaaagtatggtgtttataagaaattttatgagtatgtaactaactgctataaaaatgtaaattccaaaaaagatttaaatagcatatatataatctccaacaaataagataagacacatgcttaattagcgatcacgccaacaagcgcgcctatcttctagtacatctttctattattctatacacattcgtgagtatttctttctaattaatatattttgattttgaagatgtggaggctaacggtgaatttttgagctccactaaactctattaagatccgccatttggaccttcacatttcctaattgttatttccaattttttcgagtgccgggggtatatgttcgtaaataaataataacgtgtttctatatctgagtaagattgttcagaaaaaaacaaagactctgactcaccaccctcttccccgctgcccgccgaccttgccgctggtctgtcaccccggatctggacggcaccttctccgctgcctcggtgcacctgcccgctgtagtgtcctcgggggaaggaagggagctccgccgttgtgatccttgcggtcagctggcttgtcggtggcctgctcaagcagcggcgatgcggagaagaggagggaggtggcgggcgacgcgggcgcttggtcgccatctgatggggctggagcgagacacaggtagtcaggcagttcccttgaaaaaatatatatcataccaccgttcataaatataatcactttaggttgtttagcgaaatttgaagataagagaaaatattagttttcagtgattgatcaaattttaaatttggaattgttagtatccccctggtaggatcctcatagtctgaaaataatttgaatccccgtaaattgagatcagtatttcagaaatgcttatattgctgacataatttgaattctacaaatacttatatttgataacagagagagtagtacatatattttcctactgtgagcatttttcaaatttaatatattttgacgaatgattcaaatctactccctccgtccagatgtgatacatcctagtactacgaatccggatatacatgtctagatttatagtgctataatatgttacatcatgttctagatttgtttttaataggacggagtatagtatatccgaccgctcgaagaattagagacattcctgcttcatcttgtgatgtagccaacgaagtcatccaagcctttccgcgaggacccgccgtctgccacagacgcgcggacggcctcgccgagctcctttgcccgccgccgtattgtcatccctttctcaggcagcatcgcctcctcaatgacctcctggatggcctccgccgggaccacctcgctgtgcttctcccatggcctcacgaggaggccagccttgaggtatttgcacaccagctctgcgtcccatggctggtcggagtgcatgggccacgcaagaatcggcttcccgtaactcaggctctccatggtcgagttccagccgcagtggctcatgaacgccgccgtggcgccgtgcgcgaggatctccagctgcggcgcccacccggtgatcaccaaccccactccctcggtttctgcggtgaaccgggacagcagctccgcgtgccggctctcgccggagtcggcgaatatgttggcgcggtcggcatcgcgaagcacccagatgaacctctgcttgctgcccttcagcgccgcggcgagctccgcgacttgatcgccacggagggacgacgttgtgccgaatgacacgtagaggacggacgccagcggctgcttgtcgagccagtccatgcactcgtgccgcgtctggcctggcgtccgggcggtcgcgtcgagcagtgggttcagtggaccggccgcgaaaagcttcatctctttgaacatcgggtgcgcggcgatctcgtcgatgaactcggcctcgatcgcccgggacgtgttcatgagcatgccggagctggtcgcgttctcttcgtcctgctcttcccggctgatgaactccacgaattcctttggcatgcaggcctccacggggtggaacttgaggccgtgctcgcgtacgagccggttctcggggtccaaccacccgatgttgtacgacatggccacgcactgcagcccgaacgcctcgccgttcggcagacgcgccgcctgggcggcggcgaaggagttcaaccggtcgtacacgacgaccacgcggctatagctggccgagatcctctcgagcagcgcggcgagagggacgcgcgccgcgacggcgaagctctccagcatgggcatcaggtgggacgggaagggcggggcggtcgggtcggggggcggggactcgtaggcggggacgtcgaggtcgtggaaacggatggagcggagcgcgtcggggtcccagccgtgcaggcgcaaccgcgcctgccggaggtgcgccggcggcgccgcgtagtgcacgtccagcccccgcgacgcgagcagcagagacaggtgcatgagctggttcaggtggccctgcgccgggaagggcaccgcgacgacggccaccgattccaccgtgccaatcgccatcgagtgctcttgtcactggttgcttgtttatgcttgtctatttctaggatttttaatgccccgtagcctatacacttttacaggttatatatagagttataggcacacacgcacgaacagtcgaagacaaatatgtggggaaaaagttacatcagtagcttccaattcccattgctgatatcgcgcagatccagagcatcagagattcgagggctgacacggacgcacatctgttcccgccccctcgcgctcatccgcccttcctagaatgctcgtcagcaacaacggcgcttccagccgctggctcaatcattgtcagagactgcaggagcgtggcgcgctcgtcatcagtgacgactaacgacggcgtcggcgggccgatcgcttgtatcgcggcctctccaaaacggtacgtaccgccctgttgcggctctgcgatgatatcgttttgtataccattttggcatgtgctctgtatctcgattctcgaggcagagaagttgttggttggttccagggaatcttactgtttaaattgtactacgactaatgcactgttgtcatgtgatgttttagttcactaatagtatatgcacttttggtgcattagttaaacttgcagcaaattcatgtgtggaactgtggatcgacgaccagggcgtcgcacatcgcacatcaggctgattggatactacagtactactcccgtgcgatgaggctcttggaccagaccggcctccttcttcgttacgtacgttacgcgaagatgccatcgtccggcagtcggcagagtcccagagattactacatagccgttctccccgtgtggtttgtttctttctccctcgcgcgcatgcagcaaacgcgaagaatctaccgcacggtccgcaccgcgtttaaatttctgcatggtcgtcgccgtccttgctgcggacccttgcctctgcgtcgttgtccaaattgggtgccacgaaaaaaaggcccaactggctgatcaccacttgccaattgtagtcgagcgccgcaggcaagttgctcgactgctg

SEQ ID NO: 5093 - DNA, 2853 bp, Oryza sativa
  unsure (1)..(2853): unsure at all n locations
nnnnnnnnnnnnnnnnnnnnnnnnnnnnnnnnnnnnnnnnnnnnnnnnnnnnnnnagcagtaggggtaaaacgattatataaaacgaaaaacgagataagttattaacggatgattagggttcaattcattttctaactgaagattattactggtacgtaaaatgagataagttattaatggatgattaattaaatataaactattataaattataaaaaaatatataaatatacctattgtttaaccgttcattaagaatgttaattgaaaataaggaaaagtcaaaacagagatgttgaaacgaactcaaccttacaaaatgtaacaaatgctgtactattttatgggggttgctatatgttttttcgattttttttttgcgctctccccatttgctggcgcgttttccttttctcgatcttttaatctttagcgagtgtttttttatttttaatgtattttacaatttagatattttatctcaactttcaaaacattctatttaaaactttcaacttaaaattcaaaacttaaataaatcttgagttgaaagtttttaaatcttaactcgaaagtttaaattttgagtcaaaaattttcaaaatttgacttgaaagttcaaattttgagttgaaagttttaaaaatttgagttgaaagttttaaaaatatgaaatgtaagtttatatacatgtatgtatgtatgtgtgtgtattagtagtgctatttgtagtatagtagtagtactactaccaccaccacctagcagcagcaacagcaatgctagtagttctagctgcgcgtggggcccactagtagcagcagaagcgctagtaggcgctagtaataacagtagtaatctcttcatgttgtaagactttcaagcattgtttatattcatttagaagttatgtgtctagatttattaacatctatatgaatatgggtaatgctagaaagtcttacagaggaagtagtagactggtactctagtagtagtactagtagactagtagtagtagtaggagcgaactgttcatgtgcccacaccctgcgcgaccagtcgcgcattagcccccccccggaaaacttgtctgtcggcctgtacacgggccacgtgtggaggggaggaaaggaataagttcaccagccgtcccttaagctttatgtcgagtttgtataacatccctaatccttaatactagaaattttcactcctaaactatataaaaccgtgcaatttatatcttatagcagtactgatctctagtttcacttacgtggcatcctagtaacaaaaaaaaaaattataggacccatatgtaagagagaagaagaaaatgtagggtccacatctcttattttttctcttttctcttttcttttctactctctcttatcttcttcagcgagcctgggaggccgtcggtggcaaaggggggagaggtggttcaacggttctgggagagagggggaggtgtccggtgagcccgtccgagctctgccaccgccttgagctccatgcgaagggaggagggaacggggtagatgtagagattgacgaaaatcttggcatggtagacgctggacagggtggcaggtgaggatgacatgtgggcccgcatattttgttttaattttttagtttctagttttgctcctaatgccacatcagccactgcggacttaccatgcatcgagggaccttgtttgaatgattttgaaagttgggggcctcgtttgcatgattcatggacgattttgaaactcaacgacaaagcgagagacctcgagtgaactttttcttttcaccatggtagagcaatgtgagcccattagaatatgctgggcctgttggcccgtccggcatacatctaagcacctgtaggtttttgtttagaaaaagaaaaagataagaccaaatatttcgtttcaatcaccttatatcaaattttaaattgttaaaatcccctcatagcacttgattgtctgaagatgatttgaatttccatacaatggaatcagtatttcagaaatggctactgcatacagaatttgaatccgggaaatgcttatttgagaatggagggagtggtacacatattttcctacttaggccattttttaaaatttgatatgtttcgacgtaagattaatatttatagcatatccgaccactcgaagaatcacaggatattcctgcttcatcttgtgatgtagccaacgaagtcatccaggtctttccgcgaggacccgccgtctgccacggacgcgcggacgacttcgccgagctccattgcccgccgccgtattgccatccctttctcaggcagcatcgcctcttcgatgacctcttggatggcctccgccgggaccacctcgctgtgcttctccaatggtctcacgagcagaccagccttgaggtatttgcacaccagctctgcgtcccatggctggtcggagtgcatgggccacgcaagaatcggctttccatggctcaggctctccatcgtcgagttccagccacagtggctcatgaacgccgcaatggcgccgtgcgcgaggatctccagctgcggcgcccacccggtgatcaccagccccactccctcggtttctgcggtgaaccgggacagcagcttcgcgtgccggctcttcgcggagtccgcgaatatgtcggcgcggtcggcgtcgcgaagcacccagatgaacctctgcttgctgccctttaacgccgcggcgagcttcgcgacttgatcgccacggagggacgacgttgtgcccaatgacacctaaaggaccgacgccgcccgctggttgtcgaggcagtccatgcactcgtgccgcgtctg

SEQ ID NO: 5094 - DNA, 1277 bp, Oryza sativa
aaccggtagtacaagacaaccacgcggctatagctggccgagatcctctcgatcagcgcggcgaacggggcgcgcgccgcgacggcaaagctctggatcatgggcatcatgtgggacgggaacggcggggcggtcgggtcgggcggcggggactcgtaggcggggacgtcgaggtcgtggaagcggatggagcggagcgcgtcggggtcccagccgtgcaggcgcgaccgcgcctgccggaggtgcgccggcggcgccgcgtagtgcacgtccagcccacgcgacgcgagcagcagggacaggtgcatgagctggttcaggtggccctgcgccgggaagggcaccgcgacaacggccacggattccaccgagccaatcgccattgagcgcttatgtcgtcactgatatatggttgtttatgcttgtctaccttccagaattctagtgcccagtagcctctagacttgcaggctttatataggcacacaataatgaggctgtgtttagttccacgctaaaattaaaagtttaaagaaattaaaacgatgtgacggaaaagttaaaagtttgtgtgtgtaggaaagttcgatgtgacgaaaaagttagaaatttgaagaaaaataggtgaatagttaatttagcccctcaagtttcagcgaaggctcaatttgatccttcacctattattttgtccacatagatacttcaaatatttgttttggcttgaaatcatccttggatccacttaatatgccatatggctatttctagtcaatatttctattagaaaatgtcctttttgcccccaatttatatacatctatatactagaaaagagaaagccaacataaataaacaacattacagatctacttcccattatttcaacatgtgcacatgaaacttaagcaattgctatcgtatacacttgctaatacatatttttttttcgttttacataatatactatgtattatctataaaaaaaattcaagcatgcaatttctctcttatatatgtgaatgatgaggggtataagtatcatttatgaagagagttgttggttaaggataagtttgaactaaaatgaaaacttgaaggactaatatggatagattgaaatatcaaggactaaactgagcctcagatgaaatttggaggaccactttgcctattcacccaataaaaaatattagaatctaaacagggcaagagttggagtataagagccccatcggtagaactaaaaatcaataagcaaaagtcaaaatttaaat

SEQ ID NO: 5095 - DNA, 6464 bp, Oryza sativa
acggggccgggggccgtcgtaggcgatttcaacctcattctcgaagctcaggataaaaacaaccttaatctcaatcgtcgtatgatgggtcgttttcgtcggctcatcgacgagttggaactccgggagctgccgcttgacggacgtcgcttcacttggagcaatgagcgtgagtcgcccacgcttgttaagctcgaccgcgtcctcttctctgcggattgggaagagcttttcccctcttgcctcctccaagcggcctcttctatcgcctctgatcactgtgctcttctccttcatacctgcgtcacctccccgaaagcgcatcgttttcgttttgaggccttttggcccaagttcgacggctttcttcaagtcgtgtaggacgcctggcatccccctgccaacctaccccctcttgccgctcttgcttggtgcttctctaccatggccaagcgcttacagagctggagtgaccgtcacattggcagtgttcgtctgcagcttcagatggcgaaggaacttgtcttccggcttgatgttgcgcaggagagtcggtctctttcccccttggaaacctggctgcggcgagatttaaagttgaagtgtcttggtcttgcctcgcttgagcgtactatcgcgcgtcagcgttcgcgtttggtctggcttaaggagggtgacgccaataccaagttcttccacctgcacgccagagctcgtaggcggaagaacttcatcacgcgcctttatgatggtgaccagcttgccgtctcccatgatgcgctgcaagagcttgcctcctctcacttttgcgccatcttggggacgagcgtcgagcgtgaactcgccctagacctccactctcttggcctccgccctgcgtagcttgaggggctggactgtcccttcacagaggatgaggtctgggcggtgatcaagtccttgccctctgataaggcgcccggtcctgacggttttacgggccgtttctacaagtcttgctggccggtgatcaaggtcgaaattctggcggctcttaactccttgttcctgaccaacggccaaggtttcgcttccctcaacgacgccctaatctccctcttgccgaagaaggacgaggctgttgacgttaaggatttcaggccgattagccttattcacagctttgggaagctgttctccaagatcttggcctctcgtctctctcctcgcctggacgagcttgtggcgcctaatcagagcgctttcatcaagggccgctctctccatgacaactttcgctatgtccagcttgcggcaagggcgctccacgccaaacgcgttccccgacttcttctcaaggtggatatcgcgaaggcctttgacacggtcagctggcctttcttgcttgaggtgctagcccagcttggcttcagtcaacgttggcgtgattggatctccctcattctcagtgcctcctcttcccgggtgctggttaatggggtgccaggtccacggttcccccatcggagaggtcttcgccaaggagatcctctttcccccatgcttttcattctagtcatggatgtgctcaatgcgatgctccgcaaagcctctgactcgggtggttttcttcccctcaatgatcgttctattcgacatcgtgcatccctctacgccgatgatctagttctcttcctttcccccgttcggcaagaccttgagttcatccaaggcatcctctctgtcttcggtgccgcttccgggcttcggaccaacttcaccaagtgctcgattactccgatccgctgctcggttcttgacctggagctggttcagtcctcttttccttgctcgatctcggagtttccctgcacctacctcggcattccactgtcagttcgcaagctgccaaaagcggccctgcaaccgcttgtggataaagtctcccattggctccccccctggaagggctgtctaaccactctggcgggtcgctcggttctagtccagtcggttctctcttccattccggtccatgtttctatggcgatcggcttgccaagctgggttatcaaagccattgacaagaagcgtcgcgccttcttgtggacaggtacggactcggccaatgggggacagtgccgggtgtcctggacgagggtttgtcgtcctagggatctcggtggactgggcattccggatctcagggtggctggctttgccttgagagttcgctggctctggcttcagcgctcgggacacccctactggtctgatctgaaggcccctgttgagcggagcgtctccgacatgttcgtagcatccaccttctctatcctgggagatggtcagtccacgctcttctggactgatcggtggatcgatggtcgctcgatagcttctatagctcctgacctcctccacgtcgtgcctccacgcttccggggatcgcgcacagttgctgctgggttagcgaacaactcctgggttggtgacatacgtggcgccctcactgtcccggtcatctctcagttcctgttagtctgggacgcggtggttcctacccagctctcgccgggtgttgaggatcacctcgtctggcgttggacgggtgaccagtgctactcagcgtgatcagcgtatcaggcgttcttccttggccagcactcttttgcctgtgccgacttactctggcacgcgaagggccctgctaaatgcaagttcttcctttggtttgcatttcagcagcgctgctggactgccgatcttctccaaaagcgtggtatcgatagccactctgcttgccccttttgcgctcaggagcttgagacagcgaaccacatcctcatcgattgcgtgttcgctcggcaggtctggctccgtgtgttgtcccctcctggctgggctgccctctctccccctcgtggcagctggctccaggattggttgtcatcctccagggtatgtttacctgagcaccttcgcagcggcttcgactccttggtactcctagtctcctggcagctgtggaaggaacgaaactccagggttttcgactctgcgctcgcttcggtcgcagtggttctagagtccttccgctcggagggccagctgtggtctttagccggtgttacttgttttggggatttcttgggagtgaagcgtggctctgccccctcccgctgtttggagttgcgtttttaaccgtcgtagtagttcctagcttcaagtccccccctttagacataagccagtctagctgattgctttgtgtaacaaaaactcttttcctgctaatattttgacgtgcaatccttttgcgcgttcgcaaaaaagtttccacttgtgcatgccatatatactccatactagtataactaaacatgcatcagtgatcagtcaggtctgcatctataattatatttcacttcattttgaattaaagatcacaaatgaacctatatgttactccaactattttcaggttatgagacgttttgactttggtcaaaatcaagctgttttaagcttgaccaagtttatagaaaaaaataataataacattttcaacccaaaacaaatttattataaaaataaattattattgatttgatgaaaataatttagtattataaatattactatattggtttacaaacttagtcaaacttagagcagtttgacttttaaagtcaaaacatcttataacctgaaacggagagagtatttaattaattcccgtattacgtaggacactatcatactatgtccatcgtattaattcatacaatatgtataaaacactacatgtagagttctgacttggaacgatggattctacaacggcgaggtaaagacgaggaagatatccaacttagaggacctcaccgctgaccagctcgtcctgcggagaagcgagcaactgagcgagctctactactctctcctgtccggcgagtgcgaccaccgggcaaggaagcccgtcgccgcactgtcgccggaagatatcgcggacacagaatggtactacgttgtctgcatgacctacgcctttcgacccggccaagggtgcgtatctcatctgctaattgctgccagccaacgcacacatgcatgatgagatgatccgttgatctgccctacacatatgactgatcacttgtcggttgatctgctagcaactccaataatacgtttataaaaaaaaaactccaataatactccgtaggagagaacacaaagcttatagctgggtataagctcagtgacgcagtcagaaagatttttaagcccgaacaaattttgatataactagtatttgctattaaaaattttatttactcattaatattgaaatttaatgtagttttcaccagtgagtccgggaagctgcccaggctagccgggcggtggcttcgccactgcagcctagcaatgttcataggcggatctaagggtggttccggtgatttcgggaccacccaaaaaaattcagcccaatgtatatatatacatatgtgaaaaataaacttttgaaaaaaaaactcatttcatcaatctatacttttaactttattgtatttaaggtattttaaaaaattatataaattagatcacctatataaagatacgtcacttcaccactggcaatgtctctcatgagtcccatgttgacaagaatttgctttaccgtgttgttgttattgatctgctggggtacattctgccaggttacccggcagaagctatgcaagcaatcgatctgtttggttgtgcaatgctcagtctgcagatagcaaaacctttctacgtgcgctcttagcgaaggtacatatatatttcccatgctgtgctagctgctcatggcatcgtcccttatgcctccaaagaatataatgttcagttcccgagaaaaaaaggataatgttcatgcattctccttgatctaatcatcatatttagttgttatttatctccctgtcatgtcatgatctaactcgcatgctctctctctctctctgtgtggtccaactccgtccactaataatatcgtatgcaaagagcgcgtctattcaggtatgtaggtacagttgtacatagtacggagtatttcagttttcaaattgatgtatactgtacgtgtacgtcgatatctctgactccatctgaaatatctatacattttacagacaattgtctgcatccccttcatgagtggcgtgcttgagctgggaaccactgatccggtaagttcattggatcactcagcacgaaaaactatggacctatatatatgtagctagctcaatcgcctagtgatgatcgaccaacataagagtatactagtatgttataacagagtatcacatgcttggtatatgttatagagagaacctattatatgtcactgagtttatcacaggtctacgatttgtcattgattttgtcacgttctataatatgctatcgattttgcttaacttttatgatttaccataaccgtcagtttaaccttcgtttgtattgtatttttttcaaaatatgataaaaattgtaaaatatctgtcggtgacatgggaccgggggtatcgtgactagaggcttgggcagccgcggtcacccacgtggcctgaccccctcgggggggtgggggggcgggcccgagggtgacgtggccacccctccctctgtctccccgaggggtcgggccgctcccgtttcggccccgagggttggggcgccccgaccccctgtggtattggtgccacgtgtgtgggttaggtgggcacaacggcgctcacctaaccgcatttatagcggattggacgagcgcgtcacgccgcatttaatgcggcgcagcgcacgtttatccggtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccaggcttcagcgcaagtatggcaaggaagtcgccggccattaaatgaagtttgaaatgggcgtcctccgggaaagctgacgagcggggcaggagacgtgcgctctgcttgtcaaaggtcacttccggctgtagactagccctcattgtaaaaagcatgtttcctttcttaggcagctagaggcccatgtggtgacccctgaccagataaaaaggaggcccaggcctaagagagaagggaggaagacggggggctagagcggaaactctgtctggctctccggcactctgtattccttcacacacagatccaccagaacacaggagtagggtgttacgcttctcagcggcccgaacctgtctacgtcgcccgtgtcttgtgcgcttcctttcacgctgacattcctcagatcgagggcgaagaa

SEQ ID NO: 5096 - DNA, 7836 bp, Oryza sativa
  unsure (1)..(7836): unsure at all n locations
nnnnnnnnnnnnnnnnnnnnnnnnnnnnnnnnnnnnnncgcaagtatggcaaggaagtcgccggccattaaatgaagtttgaaatgggcgtcctccgggaaagctgacgagcggggcaggagacgtgcgctctgcttgtcaaaggtcacttccggctgtagactagccctcattgtaaaaagcatgtttcctttcttaggcagctagaggcccatgtggtgacccctgaccagataaaaaggaggcccaggcctaagagagaagggaggaagacggggggctagagcggaaactctgtctggctctccggcactctgtattccttcacacacagatccaccagaacacaggagtagggtgttacgcttctcagcggcccgaacctgtctacgtcgcccgtgtcttgtgcgcttcctttctcgctgacattccttagatcgagggcgaagaatctcacttagcgcccccggccgaaccggcaaagggaggcctgcgcggtctcccggtgaggagccccacgctccgtcatctggcgcgccaggtagggggcgcgcgtgtctttctaagccctcgtcctctttcgtgtgcgccaagcttctcccgctcagcccaatggccgaacgggcagtggcgcatagcctctctccgaacgctagcggcgacgacggggagcagaacccacgccgtcgggctcgcaccccaccgtccccctctcgtcgaaatcttgggcggggggaggcgctcggggaggtcgaagaatccgcgacttcgccgcccgcgggcgacgggggaggacggcgagacggggcgcgtcgccgcctcgtctacggcgatggcggcacgccccagggcgcgctccaggctgcgggcgcgctcttgcgtcacccgcccgtcgtccccgatccagagactccagcccggcgttggctggatgacgtggccgacttggtcatgacggcgcagcagagcctaggcgccggcgggaggtcctccgccaccgaggcttctggcgctgccgccgccggctccacgtcgtcgaggcggagggcgcgacgagcggcggccgttacccgccgttcgtccgccattccctcatcaacgcctccgacccaagaagatgtgcgtggggggtcggatgcccgcctcgatatcgagcaccggcgcgacgctcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgagaggatctgtaccagcagttcaccacgaacttccagagcacatatccacgcccaggcgaagaagcggacttgcacgcggtacagcgaagggacgatgagtctcttcgctcgtacattcagcggttctgtcaagtccgcaacaccataccgtgcatccctgcacacgcggtgatctacgcgttcagggggggcgtgcggcacaaccgcatgctcgagaagattgccttcaaggagccccagaccaccgcgcagctttttgagctcgcggaccgtgtggctcgcagggaggaggcctggacctggaactcctccggttctggtgtggcagctccggccgtccccgggtccgccgctcggtcagggcggcgggacaggaggaggaagaaggggtcggcccgttccgacgacgagggtcatgtcctcgccatcgagggtgcttcgcgggccccccgaaaggggaggccagcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaaggccccggcggctcccgccggcaaccggcgaggtgagaccaagcagaaggccaccgccgaggacatcgacgatggtgacgatgacctggggttccaggagcccgaggccaccgtcgccaccgtcgatgggggagcgtgcgctcacgcttctcgccggagcctcaagtccatgaagcgcgagcttctggccgcggcccctacccatgaggcgacacggcgggcccggtggtcggaggttgccctcaccttcgaccaaaccgaccacccgccgtgcgttgcccggggaggacagatcgcgatggtggtttcccccaccgtttgcaatgtcaagttggggcgtgtcctcatagacgggggtgcagccctcaacatcctttcccccgcagcctttgacgccatcaaggccccgaggatggtgctccggctgtcccagccgatcatcggtgtgacgccggggcacacctggccgctgggtcatatcgacctcccggtcaccttcggtagttccgccaacttccgcacggatcgggtggacttcgatgtggtggacctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgtatggagcaacgcgcggaccacctcgccgcggcgtccaagcccgcgggtggcgacgagaggctcagcaccttcgtcccggccgccccaaggcagcggatggtcacgtgcgacgaggtcccggtcaaggaggttgccctgggcgacgtcccgtccaagaccacacgaatcggtggtcttctggacgacaaataggaagacgcgctcgtctccttcctgcgggcaaacgccgacgtcttggcctggagaccggcggacatgcccggggtccctagggaggtgattgagcaccgtctcgccgtgcggccgggcgcaaggccggtccggcagaaagtgcggcggcaggccccggaacgtcaagccttcatccgtgaggaggtggcgcgacttctggaggccggattcatccgtgaggtcatccatccggagtggctggcgaacccggtcgtcgttcccaaggcgaatggcaagcttcggatgtgcatcgactacaccgaccttaacaaggcatgtcctaaggacccttaccccctgccacgcatagatcagattgtcgactcccccgcggggtgcgaccttttgtgttttctagatgcatactctggttatcatcagattcgcatggctagggaggatgaggaaaaaactgcattcattacccccataggaacttattgttatacgacaatgcctttcgggctaaagaatgcaggtcctacttttcaacttactactcgaatttctttgggtagccagataggacgcaatgttgaggcctatgttgatgacttggttgtgaagacgtgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcaaggctgggagagaaggcagtacccctatttaagctcctcaaacgctccgggccgtttacctggacggaggaggctgagcggccctcactcagttgaaggcgtacctcagttctcccccagtcctggtcgccccggagccagatgagccgttgctactctacctggcggcaaccccgcaggtggtcagtgcggcgttggtcgtggagcgcgacgaggacaaccctcactccgcgcatgcctaccctgtgtcgactcgacccgggagagagcagggaggagaggcccccgagccgaacggtggcccaaggcccccgacggccggagttggccctccgcctgcttgtccgacggtgccaggcgcccccgacccccaggatggccccggggccactgcgggaaggccgcgcctgtcgccctccgaccccgaggtcgtcggcacagaagccgagtgcgccccgcgcggcctcttggaccaagagcgccatggagatgcggcccctggcgaagaggatcggccccgccgaaaggtgcagcggcccgtctacttcgttagcgaggctcttcgggacgccaagacccgataccctcaggcccagaagatgctttacgctattctgatggcttcgaggaagttgcgccattatttccaggcgcatcgggtcacggtggttacgtcgtaccccctcggccaaatcttgcataaccgagagggtactggacgggtggtgaaatgggcaatcgaactctctgaattcgatctgcgctttgaaccacgccacgcgatcaagagccaggccctcgccgactttgtagcggagtggaccccagctcccgagcccgtctccgcccccgaggccagctcgggcccctcgcagttgcctcacaccgccttctgggtgatgcagttcgacggctccctgtctcttcagggcgccggtgcgggggtcacgttgacctcgccgagcggagacgtcctcagatagctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccggtgctctgacccgcagatggacgcttacgtgcgccaggttcggcgtatggagcgccatttcgacgggatagagcttcggcacgtgcccagacgggataacgcggtcgccgacgaactctcaaggctcgcttcctcacgagcccagaccccaccgggcgcctttgaagaaaggcttgcccagccgtcggcgcgacccgaccccctaggggagacggacgcgcctgaacggcccctgaggcccgtcggagtctaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgctaggcaaacccatcagccggcccaggccctgcagaccatacctctttcgtggccgtttgctgtctgggggctcgatatccttggtccgttcaggcggaccccgggcggtttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgaactcttcggtgactactgcgaagacatgggcatcaagctctgtttcgcctcccccgcccaccccagaagcaacggccaagtggagcgcgccaacgcggaaatcctcaagggcctcaaaaccaagaccttcaacatcctcaagaagcacggctactcgtggatcgaggagctgccagcggtgctctaagcaaaccgaaccacgccaagccgagcaaccggggaaacgcctttcttccttgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctactcctagtgggggtcgggtgttatgtctcgggctcgggccaaccccgcgcctcccctgggcgtgcagggttggccgggggctaccacatgcatatacttatcttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgtggatctccccaggcactagccccgacccgcaccgtttgaggctgggacctgggcacgagcccttgttcaagctaagacacagaaggaccgtggcacagaccatcctcgtctcaaacacacaacaaacagaactgacgcagaaatttcctccttacttgattacagattaaatcagtctatacaagaagggggcccgaaggcctcggaagaagaaggaaaagttattaagattggcgggggcctgggggctcactccgacgcgcccgggtcgccggcctcgtcgtcgctgtcgtccgcaccgtcgtcaccaccctcctcgtcggagtcgagggcgaacgcgagccgaggggccgtaccctcgaagctgtggacgatgtgatcggcggcgtcccggacctgcgcgcgcgcgccgtcctcggttccgggagggaactcttacagcgctgcccacggagagaagtcagggtccctggcctggtagcttgccagtacgagctccaccgccccccgggcgaggtccctcgtggataacttgatcgtctcctcgagctcctcggggagccgctggagggtcccggccatctctgagaggcgctgggcgaggcccccctggttggcggcgtacttcgcggtccgcccgccctagaggcccgcctgccgcccggcgcggtctagacgggagacggcgtcccgaagcatgccgggtcctacctcgctcaccaaacggagggcctcgacctcctagcggacgagtccagtgcgccctgcagcccgacgatggtgtgttcggcggctgggaggcgggcgggtaggttgccgtcgcccgcggccgccccggcgttgtgcgctctnnnnnnnnnnnnnnnnnnnnnnnnnnnnnnnnnnnnnnn

SEQ ID NO: 5097 - DNA, 3574 bp, Oryza sativa
  unsure (1)..(3574): unsure at all n locations
nnnnnnnnnnnnnnnnnnnnnnnnnnnnnnnnnnnnnnnnnnnnnntacaagtatctgaagtctaacaaaggtgggcttttcggtgatagcatcaagtggaacttctccaaattcttggttgacaaggagggtcgcgtggtggatcgctatgcgcccaccacctcccctcttagtattgaggtaatgtcctgcacggcggcgtcccggacctgcgcgcgcgcgccgtcctcggttccgggagggaactcttacagcgctgcccacggagagaagtcagggtccctggcctggtagcttgccagtacgagctccaccgccccccgggcgaggtccctcgtggataacttgatcgtctcctcgagctcctcggggagccgctggagggtcccggccatctctgagaggcgctgggcgaggcccccctggttggcggcgtacttcgcggtccgcccgccctagaggcccgcctgccgcccggcgcggtctagacgggagacggcgtcccgaagcatgccgggtcctacctcgctcaccaaacggagggcctcgacctccctggcggacgagtccagtgcgccctgcagcccggcgatggtgtgttcggcggctgcgaggcgggcggctaggtcgccgtcgcccgcggccgccccgccgctgtgcgctctcgcgtccagctccttcgcccgcgcctcgagctcagcggcccgctgatccagtgcggccctctcggcatgggcgccttccagattgcggcgcgcctgctcctcccgcgctgcttcgcggaggaacaggctgtccgccagccactgcgccgcggcctcggcctcctcgagagctcgctcccgctcggtgagcgcgtcctcgcggaggcggagtgcggactcctcttcggcgcaggcggcctcgtgcgccgccagtgttgcctcccgggtggcgacggcggcctcgcggtccgccaggtctttctccttcgtgtccagggcgcgggcgcgcttctccagcgccgtggcgcgagcctcaagggcctcttcgcgctgccgggacgccgcctcgatctccgccgcccgccgttcccgggcagcggcggcgtcaaggactccccgggcggcgtcgagcttcttctctagctccgccgcccggctcccgtattggaggcggaggtcgtcccgcacctcgtcgagcacggcgatggcgatgagggcagtctcccgctcctcctccacctccctggcgatctccgccaggtccctacgacgggccttgagctcggaggcgtgccggcggtgtgccttgcggcccgcctccaccatggcctccaccgagcgccgcccctcctcgacgcgcgcccacgccgcgtcgagctccgcccgctctgcctgcagggcctccatctgggcacttaacccgtccagcaccgtggtgttcgcggcggctaaggcctgcaggaggggctccgcactcagtggggcaacggaaggcagaggggagagccgcctcggtgtgggtgccgcgcggctcggcccgccgatcgacgtgccggacccaggggtgtcccccgaagctggctcgtcccaagcatcgcccgaggggtcgggcccgagcggcgcgtccgcggcctcgtcgtgggtggcctcggaagtcgtcgtcgcctcgggcggagtcgggtcgggggcttggcaggccgcctggcgtgcacgcgccgtctcctcctcccggacggactccccggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcgatcgccgtctcctcggcctcggaccggccggacttggaatggcgggggggggggggcgacgggatctcgctgaggcagaagaaaaaccagaagacaaaaagaaacgggtgagtgaaaactcgccttgggagatgggagaatgaacacggccgcggtgggcgcggggacgaacctgcggggaggtcggctaaacgaccacctcgggagcgagatgaggttcccccggcatggctcggtcccccccatcttgcggagccgtttcttctttcgctccccctcaggctgtggcgtcggcacggcaccctccgggcgcctgctgctggcacgcaccgcctcgccctctcggggaggagatgggggggtcgtgccctcctgcttcctcttcccccgggcgtcggcagggcggctgccccccgggcccccgtcgcggggcccagaagcatgaccccctcccagggtagattgtttccccctgcggctcccgcccacgccatcgtggcctcgggggggccgctcccccgacgccccgaccgcctgcatgatggtcaggatgttggcgcgatctggatcgctgcagagggggaggacaccttgggggataagggatgcctccacggagctgagattcagcacccgttggaccaccatcctgaagtcctcagggacccagtcccatttgcgcccctggtgggtcctcatgtagtcctcgggcccggtgtactcccaggcgccccgggcgcgccgctggagcggcgcgatctggcgacgaaggtagtcgccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttccagtcgtcccacttcttgcggaggacgcagggaatgtagcggtgcagcacctgcccccgcggctggaagtagcagccaccgactaccgtcggcggcgacaccagctgtacggtgaagaaccactggaacagccggagagatgggcgcaccccgataaacatctcgcacaggtgcgcgaagatggccaacgtcattattgcgttgggggtgaggtgcgccatctggagatcataaaactccagaacatccatgaagaaattagagaatggcgggaccagcccggccattgcgaaagagaggaagaagacggaccgccccgggtagtgtggcaccgggcgtccctcgcccagctcgaccacctcccggccggtggcagattccggcatgaatcggcgcggcaacccggcctgcctctcgctcacgatgcgggaaggcggcagcacgctaccgtcgagcggtgcggagccccgtgccatgacgccggcggaggaggagcttgagagcgagcaagtgcggcgagggtagggcacaggaaacgaagagttagagcgcaagtggcgaaggcaaggggaatagtggcgagaggaaggaaacgaatctcttcctcggcgtctttatacccttgccaacgctatgcccggctcctcgcttcccgcgcccactatctcgccccctcgtttctcgcgcccacgcctccactaatcccactcgcccctttcagcgcacgcgcagatgtgcggccgtggcgg

SEQ ID NO: 5098 - DNA, 2960 bp, Oryza sativa
cgagcgggcaagaaaacgtgcgctctgcttgtcaaaggtcactcccggctgtagactagccctcattgtaaaaagcatgtttcctttcttaggcagctagaggcccatgtggtgacccctgaccagataaaaaggaggcccaggcctaagagagaaggaagaaagacggggggctagagcggaaactctgtctggctctccggcactctgtattccttcacacacagatccaccagaacacaggagtagggtgttacgcttctcagcggcccgaacctgtctacgtcgcccgtgtcttgtgcgcttcctttctcgctgacattcctcagatcgagggcgaagaatctcacttagcgcccccggccgaaccggcaaagggaggcctgcgcggtctcccggtgaggagccccacgctccgtcaatatcatattataaacataagattggaaacatccaaaatttgaccaaaaatttaaaatctgatatttcagaatttttgcccaaattttggaagtttttgtttcaggggtagtcatttggacaaaattgtacattactaatgaaagctaatcggatggcaatggtaaatcatagaagttaagtaaaagttgatggtatattatagaacgttataaagtcagtggcaaatcgtagacatgtgacaaactcggtgccatataatggattctctctatgttataccatgtccggggcatttcgttgctatgctggcagggagctgctaggggcaagctagtatagtgcaatgttccgtagcatccaagattccctcattatttatagcgtgtatatcaaactactagtatatatagcatgtgccgcatccataatacgcatgtaagaaatcaagctacaattcaagtttatgtgcagctagctagaccactaatgttaccatcatatattttttctagaatcttttactgaaatatatgaatagaggcgcagccactgtggtgggatggggtctggccttccccaacagcccagtaacaaccagcccctcctttcctacaccccaatagtttacttttgcttttaaatactaccttttatcaacatataagtaaaaataaccatgtactattttctttttaaaatatatgacaccgttaacttttcgcataacgtttgatcattaatcttatttaacaatttagtataaatatgtaaaagtataagttaagattatattttatttgatgataaaacaagtcataataaaataaatgatatatatatataataaaacaaaatagtcaaacattatgtgaaaagtcaatagcatcatacatttttaaatggaatatattttttatatcattagttgtctaacacttcaaaggtataatttcacctctccaattaaatttcaatttttctaaaatattagttaatacttgcatgaagatgcgtatatagtttgtttctcattttactaaaatatagttttttttggattgcttgtcaatttatttggaattttagctcggatgatactatcaccgcttatgattgtctgcttaatactcataggctaaattgaaatgaataaatatattcggtatatcaacatacctaccttttttattatcatgtgctattttttagttgatacgatatattacgtacctttgggaaacattacgtatattttttacactatatttttaataatcataatcgctttgtgaagttcgtcttcctcgtatctaaatcctagcttcactacgttgcatgtacaaaatgaggggacgtacccttaactttaatgaacaaaacgacattttacgaactactgagctacgagcaaagacactccacgaaatcgaaatgttaacttatatattttttttttttgaaaactagagggtgcatgcagcggtcgaagatgtagtttttgctagtctcattatagtctcttacactcattatagtctcagttcttcacaatatatattgattactattgaattatattcccaggtttcggaggacccaaacttggtaaaccgaatcgttgcatatttgaaggagcttcagtttccgatatgcttagaggtaccgagttctactccttctccagacgaaacagaagatgccgacaccgtgttcgatggcctcattgaagaggaccagatggtcatactccagggagaagacgagctaggcgacgtcgtcgtcgctgagtgcgagaccaacggcgccaaccccgaaacgatcaccatggagaccgacgagttctacagcctctgcgaggagctggacctggacctcggttcttatcagctagtcccgacgtcggcacgggagacggtggctgcggcggcggcggcggctaacgatgtcgacggcgttgcatactctcacgcctcgtgtttcgtgtcatggaaaagagcgaacccggcggagaaggtggtggccgtgccgatgactgcaggcatagagtcacagaagttgctgaagaaagctgtaggcggcggcaccgcatggatgagtaatattgatgatcgtggtagcgtggcaataacgacgactccaggaagtaacatcaagagccatgtcatgtcagagagaaggcgccgagagaagctcaacgagatgttcctcattctgaagtcactactcccctccgtccgcaaggttagttaacttagcgttccatactgaaagttatataggagtagtattattcatcgagctgtggattgtccctgcaggttgacaaggcatccatacttgcagaaacgataacctacctcaaagtgttagagaaaagagtgaaagagctggagtccagcagcagggagccatcgcgttggcggccaaccgaaattggacaggggaaggcgccgtaagatcaccgggaaggaggtctatgagatcggtgtcagtggtggtacctcgtcggtacctcgtcaacaccgtacgtatatgat

SEQ ID NO: 5099 - DNA, 900 bp, Oryza sativa
  unsure (1)..(900): unsure at all n locations
caattaacattcttaatgaacggttaaacaataggtatatttatatatttttttataatttataatagtttatatttaattaatcatccattaataacttatctcattttacgtaccagtaataatcttcagttagaaaatgaattgaaccctaatcatccgttaataacttatctcgtttttcgttttatataatcgttttacccctactgctataacgacatacattttgtaggataggagtaagtacaataaatgcaagttggcaagtgcagcagtcgagcaacttgcctgccggcgctcgacctacaattggcaagtggtgatcagccagttgggcctttttttcgtggcacccaatttggacaacgacgcagaggcaagggtccgcagcaaggacggcgacgaccatgcagaaaattaaacgcggtgcggaccgtgcggtagattcttcgcgtttgctgcatgcgcgcgagggaggaagaaacaaaccacacggtgagaacggctatgtagtaatctctgggactctgccgactgccggacgatggcatcttcgcgtaacgtacgtaacgaagaaggaggccggtctggtccaagagcctcatcgcacgggagtagtactgtagtatccaatcagcctgatgtgcgatgtgcgacgccctggtcgtcgatccacagttccacacatgaatttgctgcaagtttaactaatgcaccaaaagtgcatatactattagtgaactaaaacatcacatgacaacagtgcattagtcgtagtacaatttaaacagtaagattccctggaaccaaccaacaacttctatgcctcgagaatcgagatacagagcacatgccaaaannnnnnnnnnnnnnnnnnnnnnnnnnnnnnnnnnnnnn

SEQ ID NO: 5100 - DNA, 576 bp, Oryza sativa
  unsure (1)..(576): unsure at all n locations
nnnnnnnnnnnnnnnnnnnnnnnnnnnnnnnnnnnnnnnnnnnnnnnnnnnnnnnnnnnttattaaatttacctagctatccacaggctgatcaatctggtcgtgcgggaagcaagcagcccgtaagaaacgcggcatgctttaaaaaaaatatatggaaaaatcggagcgacggagccttcgatactcaccgagacgaacgccgggtagaagacgacctgcgcgcggcccccgaggacgtcgacggcggcgtcgtggatgccctggagccgcttgacggccttctccaccgagcccgcgcacgcggcgcacgtcatcccggacacctcgaacaccgccaccttctcctcctcctccgcccccacggccgccgcctccagatcgccgtcgcctcctcctcctcctccttcccctccctctccggcgaccgcggcgtagcaatgtttgtgcaccaacatggctaagccacatcccacgtgcgtgggaggctgggcagctcagcacgactgcacgaggttggctcagcccgcactgtccacgcatagtgatgggtaccgagctcgaattcgccctata

SEQ ID NO: 5101 - DNA, 13805 bp, Oryza sativa
tttggagccacatccgtcacaccgtcctgtctcatcaatggcgacatgtctgtcggatcaagacgttggcctgcagcagagtagaccatacatatgtgtcgaccattcgcccggggtggcactgtcactagtcttcgccaagatttgtactttgtaattgaggaggaacatatagaacgctagctatatagttaggtccaacgaaatactttatatggactgacatcgatacaatacctaggtaccatacggatgttaacataaacctcacgtttcaattaattgcatactgtacatgttgcagtatttctatttgcaatcggctaaaaaacagtcaaagggttgctaatgaaattagagggagactacaaaaaggatcccgttagaacgggatattttaaatgactccttccctttctttctgttagcttccacatgtgtttctcctagcacctggtaccttggataccagctagtacctagtacctggtaaatttggtaccgaccgatacttggtacctggaaccttggtactggctggtacctaggtatcacaaactttggtacctaggtacctggtaccttggtatcggctggtacctaggtatcacagactttggtatctaggtatcaagcatgatacttgtgggtaacaggcttgatactgaggtatcgcgattaatacctgataaagatggccgtggcacggacacagaagatggtgaggtttggccataagtcggcggcgaccatctacaggaacatgcgcggcagcaacttcatcttgaagttgatggcgaaagagaggaggtagagattctagagtaggttatcgtcggcgttgcggcgacagaggcaccgggaccgccgacttcttcttcttcttctgcggcggaggaggagccacctgtgctcactagcaaggaggcggcgggagcagcgggcaaggacgatggtgctggtggctcgcgaggcaacggagaccttggcgaggagtgtgagggaggaggggagaggcctcgacgcctacagtgacggggagcgccagtggaagaagcggcgccgcagcaggcggaggacggcgtcgaggaggcacggcgagatcaccctcgacactgccccgacctcgccgacgccgggccgttgtcgtccacctcggccgccggagacgacgacggcgaccccttcctcctagctggcttcatttccgcgctcttggagagagagagagagagtttgtggaggggaagggaaggagataaggtagaggagaccttatcccgttgtgacgggatactattgtgtagattctctttttattaaacaagtggtcaattacccgtgcattgctacagaacaatatatatcaagaaaaatgtatgatttattttgctataatatttgaaacatttttaaacaaaatattagttgtgcataggttaagaatggtttctcagtaggactgtatactgctcatacgaccaaaacagcaccccggatctgtcaaaatttacgatttgtcacatctaaaatatacaaataataaaaaaacaaatgggccggcatactgtgaatattattacggcccaaatgaaaaacccaaattgaagcccactcataaaacaacttaaacatattaaaacaataataggcccatcatacaaagaattttgagcccaataaaaattgtccagattaaaaattcaaaaaatatttggatcaaggccaattcatccaagcccatatggaggccaattatataagaaaaagaaagatagtagcattttcttaacatgtgtgttgagttgttgatcgactaaacatgtgacgaaatacaatttaatattagaggtggtgaaggaggtacaccaaggatcatgcagggcacatcaagctgcacgggcggtagcatactagcaaccaagatatttcgccaatggctatactggccaatcctgctacatagctccgaagagcatatcacgcaattcgtaggtgccaaaaacatggtatatctcactccgtcccatagtacaacctttagctgatcttgccggtctggccgttcgcacactgggagctactccggatgtggattttcatccctcgaggggacatctcctcgttgtttgcatgtcatctaaatagttatcaaaaaattttaaaaaaattggcaacatagattaatacgaaatatatcactccacaaacatgcgagaccatattcaacttctataagttgcaacaaaaataacaaactaaactgaaaatagttatcgcacattcgcaactatatttgttatttttgttacaacttgtagaagttgaatttaaacttgcatgtttgtggagtgatatatttcatattaatctatgttgccaatttttttcatattttttgatgactatttaggtgacatgcacgaaacgaggggatatcccctcgagggatgatttcactttcccgagctactccctatgtttcacgatgtaagactttctagcattacttatatactatacatatagatgttaatgaatctaaatatatatatttatctagattcattaatatctatataaatgtggggaatactagaaagttttacattataaaacggaagaagtagatataattggtcctttcccaacgacaaagaatagctacaagttgcaatcaagtacttttgaaggtggattgaagcagaattcttggccaccatcacttcagccaccgtataatgatttgtgtggaagaaaaacattatatgtcgctttgcattggcgtattgaaataattcaccgcgaagggtctggctcataaactggaaacaggaaggcttaatataaaatagttattgccaacttaatatattgacattggatttatccttgttcagttgccagcttggttttctactatagtatatacgattaagagccttacctggtgaaggtaggtgggcctggctcaccacaaaacctttattctttctcatgacgtaaactagtggagtcctatcgatatcgatcttatgttgctatatacttagcatttgtgtctacgtaaaccaacataaaagaatgtaacaaataattaatgattgcttaccttggggaagatctttttagctcagatcttcttcgtatggtcacctgaaccactatttacatgtgcgatgcaataccagcttaagcataacgaaattctcagtaaactacgttgtaggattctatgtggcccgtatctaaattggttttcttaaaacacgatctactgtagtgccgtgatatagaataaaccatattgcctccgtttcataatgtaagtcattttagctttttttatatttatatattgatgttgataaatctagacatatatatgaatctaaattcattaatattaatatgaatattagaaaagctagaatgacttacatgtgaaatagcttacattgtgaaatagaggaagtatatagtaagcatgtaattcaattttccttcgcctcttttctttctgatgactggttgtctttccatgacgcaagccaccccacggagagctagtttgcacctaatttatctgtctataaattgtaatgtaaacaatgtcatatcaggcataaaccttctgcaccactaagcataaacgatgtcctggcttgctttaaatgtcttatccagcgaacactaacacacaaacgttgctccgaaagtctatcttatccgataacgattagcataaactaaccttaggccggtgtctaaatgactttaacatctcatgtgatttcttaagtgccgtcagcatataggcaataccaagtgattttagatggtttggacgtttggtagttttcaattttcatccagatacctctcttgacaattccatccacttgtctattcctgtcctgtgtggaaatgatcatgtctcgattctagataggcaaaatcaatagatatgcagttacagaagttaataggacgaaatggtaggtcctatataaggataacgttcaaaattatatataagcccctgcgtaccatgtcaaattatcaattgagactttgaaaaggaaagcacaggtctcaacatggcagatatggagtgaaggatcatcgtggcctcttcctttatttctgtgcatttttatgcttcgcttttcatatactcggacaggacattgctacggaagaatagaagatggtccctttagttttacactccatttttttctggtttgttggatgccactgctaacattaaactatgcaaacagaacgttcaccaaagaaattaaaaagaaaaccacactaacctccgcagatcgactctagctaatccatttttactagtatgatgttcaaaggccaatggtaaatatatggtgaaaatcccaatttaagtagaaactagtgtaaacccatcaataaaaaatggaaaccagatatttcaaactgtaattggaattccacctctaatattaaaaaaatgatagatcccttaatattcttgaaaaaccatggataactagtagcttgaaaattgtttacttgcccgttcgatagtaaacaattttttgctcaacttacagccttattatatcaaaatatatttcatctttctgtcaaaataatatatatttcatctgagatgttggtggcctgattgaacttatttctacaatttccacttgattttgattctaaaaaacgttaacttttctttttagaccaatactatactacgggttggtttggtttgtggcctaaatagaccttaccaaattttgtcaatgccaaatttaggcaagttttggcatgactaattttggtaatgcaaagttatgtttggattgaagccaaaatagcctaagttctctattgaaatggcctatttttttaggcatgctaaaatttggcttcaaaccaaatagacactaaacactattgaaattgctaaatattggtaagcctaatttaggcatcaaaccaaatcagccctacaaaatcatttaataacatacgcggattgacgtggatcacaaacacatagtgcaagacacctacatctctgagtttgcgtctttatcacaaacgtagttttttctccacatctgtggtatatacttttatagactggggagacctgtgtcactatatttgattgtagtcacatctatgacttgacttttccgagcaactcaaaaaaatgtcgtattttactagatatactaggtactccaagtattcatacacatgcgcaggtcacatgatctttctcgaacctcccagataggtggcttttcctatgactcaattttgaaatcaaaaataaatttgaacaccttgactcctttagcctcgcttttgtttgtaggagtcgtcatgcattcatactatagcaataacatagagactaaaacttgcactttgtcctcaataaacatgttaatcccttaattagtcgcattgttaacccaccaggggctagatgcacttctagcgagtagattgcattgagatctacaattttgatatataacatgtctctgtctaatataatttaaaatttttgtttttaaaaatagatttgagaacttgtaaggatactgagacaaaagtctataatgaaaagtacttagagacacaggtataacctgtgtccgtcatagatatcaggcacactttttatggaaccaagtttgtgatgataaacctcattcattgacacgttttctttatccacatctatgatttcttagcccatgtgttttatttcgacatgtatctgatagcttcacagacctacatctctatggtcatttcagagacacagcgtcaccaatttcgtattttgtggtagtggatgttaattgtcatgaaaataccataacaagttaacaacaaaatcctcagctgaaacccccacatagcatgaatgataacatccctctgctagaatgatggatatatcaatggggtcgtgacatcaaacaagagaaacagggaaggcattaaacactcttcatcctaattacatgggataattgaaaagatgatttgttaaaataaagtgtatccaacacattgcataacagaccgttgaaatataggcaactctaaccctagtttgttgcctccactactttcctctgtccttgccagcgtcaaaggggtgccctagaatctggctgccctcgaggaaggtggtggcggggtctcttccttttctggcgtgtgccctcttccggtggtatcgtcacgaagttatcttctttttaatcaaggccttcactctaacctacaaactagagtcatcttggtttcgattttcgatgtcgtttacgtcgatagcttagtgactcttcatatggaccgtacggattgtggaaatgtgtatattgccttcttcactttataatcatttgagtagcatatctaaagatgcttgtaactattgtgtttctgatcgatccaaattgtcctaagggttggagggggtggaggttatggctcgcagcgacgaggcaacaatattggggactttgattacataggtggcgctctttgggtaccgatttcttgagtctaaggttaaatctctaggtctgaccttcaaaatgatcgcttccttgttcaaggtaatgtctggagtcagtttttgtctccagcggtttagtattatttactaattgatcaatgggatcagcagcgcatatgcatcattccctttttgaaggcattgttttaggagagcatttttcatagtctaagttttgctttggtggtatttgagaatgagtatcaattgtggttgtattttgctctacggcatgacattctttccatgtcttccttttttttctttttaataattataggttatgtgcatcttaattatatagaggttatgagtgatttttagaatagttgtatcatcttgatgtaattgtttaatatcaatatagtttcttttattaaaaatattaaaagtatggctacataaaagagcttttcacgatgaatctagctatcaatataattttaatatttccaatgaacgatgctagtatatggtgaaaataatgttgtgaaaatataattgtctactatttggatggagtaccggttggcaagatatcaaactcgtatcgtaccaaatcgatttttttctgaaagcctcctgaactggtatgatgtcatgatgcagtgcatgtaaatattgatgttcaaggcatggcactttcttgctgatccaccaaggaagtgtcacctgtcaagcaggatatatagcttcttatgcactcaaagctgaattatcttggccatcggccttccaagctaaatgagcaatggatgtacagccactcattatgctacaactgactactgaggtaaacatccattgccatgcattatgctaaacgcactcgatcgctagaacaaaaaattggcagcacagccacatatcatcgagaaagtccctcttgggacgtatagtttactcactaattccccttttgactggatagtgttctcttcattcgtaattgattatcgtattatcaaaaaaaaatctgatttgatcatgacaacaacattgggagctagcgaaaatgtcctttttataacatgcatgtatgcatgactttaatgcggagattagttaaatcaccgatcgtctttaaccatatccaatgcgtgcatgaatttaatgcggagattagttagttaaatcaccgcttgtctttgctgaattaaagtaaaactatatttatttagggatggagggagtagttttcggtaataatccaatgtggtggttactccaattactcactccgtattcgtaaagaaagttgtttaggataatgttcaagtcaaaccttagaaatataaatcatgaataactctcaagctgttgagtttgaaaatataaaaattatatgaatagactttttttttgcaaaatactttcataaaaatatatcacttttaaataaatatttttataaaaacaagaagtcaaagttgtgttttggagaccgtgtcgctgtccaaaacgattttctttataagtacggagggagtatattagaaagatactacacggatagcaaagtgaaagtaggataaggctattcccaactcaatgactaggatgatgtccatattattaaataagctaccatctaagatgaaaaatgatgtggaagtgaatacgtgaggaaagagaaggaaaccatgacttgcatgagacatggtttctacacaacatataagacattatgtgagataagtagcattaaatttaagtatgtaatagtggtgtttgtattggaagagtagtgtctagtactagttttttgatgatgtagagtttatggaaactatgtctagttccttgggttgagaatggcctaattaactagttaggttttttttatggtataacctgttcactcaagttcaaacctcttcgacttaatatgggtagtcgtatttacggctaattattttttcaacggtagacaatatagccatctgtaatgaggtatatatggtgattttaccaatccctaaaagtactgaactaatctgttggaagtgtttataggagtatggtgaaatacgccctcagttttcaattgaataactattgccagaactactttaatggatcactcgtcttttataaaatgtacaaatatttctaattataaataacaatgatatcatattataaaaatgtattactaaggttttgcaagaccaaacaacgaatttattgcatccaaattaactcgatgatataaagtgaacgtagctcatatcagctagttaagtttcatacggtgaaactagctcatcaagtttttgtaaaatcaaaagtgtttttgattattattatgtgataaacaattggcatctgagattattggttttgaaatttggattattgtcgaagtggttttggagataattggatttacaggtgttaacaggtactgctgctgttttgatctggtcagactgggcaggtgctgccggtcggaccggcgtgtattgcgcggtcagactggctagcccgcggtctgatcggctaacattgtgtcggtttcggtttcagttgtttgtttggatatccgcgtttggttcatgtttatggattctagacggatactatgcatatgtaatactgttgtttgctaacaatgagtcaagttggagatagcttggttttggaatatggtttctttgtttgattcatgtgtaggtgacttgatgcctcgggagagtatatccggtgatggatcggaagtcgacttggggataaggcgatgtctgtgacgatcatatatcatacgggatacttaggctaaagttcaatgcacgtgattggtgaagattccatatggcatacgacggaggtattgtgtgcgtatgggatgtggagtcgaatttggaaggagtccaaatttggtatggttagagtttgtaaagtttgtttcttgtgcgggaaggttttctaggtggattaggacttctagaatgagtttggttcgtggctttaggctgcctacctcatgtataaatagagagggagcgtgaggcttcccggtatcgcttttgagagcattgagttgatagtttagttagggtttcgagtttagtcgagatttttgtaaggagtactgttgttgcactttgtaaacatagagaggagcaataaagttgtcatctactttgagagttcttcgatttgtgttttctcgggttcggcgctctaaccggtgaaacaccgtcggtctaaccggctgcattgcggcggtcagactggcggcattgcggcggttagaccggcgtcggcgtcaggaggctgaggcgacttcggagcagtcagatcgggcaatctacatcggtcagaccggcggcacaggcgcggtcagaccgacgggactactctagtcagactgatctatatcgattcgagggtaacttttaattccgctaaaaaattatgttttttggtataccaaccattcacccccctctggttgtcttagttcttgtgtttcgatcctacagttttaaatcctgtaattattacagatgctcatatttacggctaattattatttagtggtaagtaacgtcaccgctaacagtgagatactcatgcttatagagataaagcttacatgtatatatgtttatacaaatgagtataagtatgttacgagcgtctatgtatgtttaagggttgtttctaacgagaaaagaaagtgactcaaaagatgagctggttgtacgtactaaggtctatgactgggcacgacattaattgcgtccaagatgatcctcatgtgggtgtgtcacacatttaattttttttagatatgttgttcattggttattgttagctaattattaattttgaatctcataattaaattagttagatagtatattctttcaagaatataaaccactaagaaaataaatatttagcaaaatgagtgtaactcaactggttatgtttcttacggtgaaactagtaaacacctcggtttaaatccgagacttgacacgagtcctcgtatttttatactatttcaaatgttagtagttgtggtgttcgttctgccacaccatccctacccactaacatttggtccccataatctatactattacatcacccctcaatgacaattattcaataacaaaaatcataaaaatacaacttggactaaatatgtgcttaattgacttagttagctagaaactcaatttgttttccgctgcaatgcacgagctcttccatagtatttctaattattctttaagtgctaggcaacatatctatcaataacaagatatctgccgtgacttgtcaatctcaatatacgtcgagcatgtttgtactgtgtctctaaaaaagaagatcaacatttataactttagtttaaccattaaactaacaacatacattagaattcctagtaatggtggataaaaagtaattagtcaaatatgtggttttatcagtttaacatatgagtatttatagtaatggtggataaaaaaaaggtaatttggaaccatgccattataattttttaaagtttgagatatgccatcggtatcacaatgacatgtaggacctacatgagtcaatgacatgtgggtcaggatggcatatatcaaattttgcaaaattataatggcatagttacaattttccctaaaaaaataattagccaaatatgtggttttattgcaagggaaggcttcatcaatctcaatatgtatcagctgcgttcgtactatgttttaaagaaagaaaatcaacatttataactttagtttaacaattaaactaacaacatactccctctattcccaattgataatcacatatatttttaggttattgtcaaatgatcaccatattagtattcgttctctaagtctattcgcataggagtaattaatggatattggtgcatatatccatgcacacaaccatttataaccaacatgcaatgttttggtttgttattggcataaggtaaacaatatatggctgagtaaggggacccatcccacatgacattgtaaaagaatgcaacatttaatagaaatgcaggatatttgtaaattgggtacaatatgatcaattgtaatgcatgactttccttgctcttgcactgatgagaccacagcaacgtcttcaagaaaccgcggatcgacgaaacggccgaaatctacgcgacaaacagagcacacaagcaaaacacactataagactactgaaacaggaaacaaaaccatttttaatggattctagggatttttatgaatttactgagacttgaatggacttaaacggagctcggatgaattacttatgaattttagaagataaactatgtttttactaataaagaaaagccttaataacttttattgcgtaatattacccagggctgatgtcagccgggggggctcggcaggtgggccccgcatgtcagcggcacaaggggagagggagggggtgccggcacgtgggccccacgggcaatggctaaaagggggggtggtccatcggctggtgggccccaccggggcagcggcacaaggcgggggagggggtgccggctgctggctcggcacggctcaagctggccggccatggcgtggcggcgacggcgcacgaccgccggcaacgacaagcggcggcgcgggaggcggcgcggacggcgcgaaaggtggcggcgtcggctgaatgcgacggcgcacacgcggagggtggcggcgctcatgggagggaggaaaggaagaaggagaggggatccctcaccgaggcgatgacggcgatcggcgcgggaagagacgagcggcggcggcggttcggagaacggtggacaaggtcaggcacaacctgggaaaggcgatgaccgggttaggagaagggaaggatgaccacggcgactagaacggccggccagagttgggcggaaatggagagctcaccggcgtgcgagggaggcggcgctttggcgacgtttggcggcaagcgagcggcggccgaggtgtgccgtggggagagcggcggagtgcactgcggaggccctagcggcgacggcgtgtggccggagatgggcggcggcggcggagctcgggtgtgccgtggggagagcggcggagtgcacgggcaagcgcggcaagagcgaaaaaaggtcgaggggggctcgagggagtgatttataggtacaggagggggcggacgtggcctgggaggtggccgatttggccggcgacgtggggtggagagagagagtgcggggtgggattcaaaatgaatctcgcccatttttgggcgcgtgcgagggcgggaggagcgggggaggggcggcgacgtgggcgcagggcgcggagtgggcacggggaggcgggaaaggcggcggtgtgggcggttgccgccggggtgcggtcggctggaggaaggggacgaccccgacaggtggggtccacctgtcggcgtcccggagggagggggaaggggaaacgggccggtccaacaaggagaggccgagcgcggggtaaggcgaggtggactgggccgatggcccaagaagagggaagatgaggaaaataaaagggaaaaaaatgaattccctgggatttaaaattgcactttggtgatttttaattggtaaaaattatttccaaggctctgaaaattccactaaaaatcctgttaatatattgcaacatggggaactcaagaaaaattccaccacgccatttccgattattaattgcattgattaattagggattcaactctaggttaattaaacaatttcttcgagcaatttatttaactaattttttttagcaagaaaagggggaaacttcagggcgtgacaatgtcgctcccgccatcgctgtttggcgctaccgcgcgagcagccgcgcgaacttcgccgccgctcggccatgcgtcgccgacagctcctctcgacgttttccccactgtcgctctcccagagaccccttcaacccccctcctttggccgccccgcctctttcctctagccgccggcctcccatccccttctatcgccgccgctctgcttccgccgctgccgcgcacaaccgcgcgccgtcgtcggccattccccgtcgattcctctcgcctccgccctcttggagctcccgtggccctccccgaaccgccgccttgaccgccggccttccttctcgtgcccgcgccgtgccaccca

SEQ ID NO: 5102 - DNA, 2957 bp, Oryza sativa
  unsure (1)..(2957): unsure at all n locations
cgcgtcccgcgtgcgcccattcttccgtggaccgtctcaccgacaagcgggccccactcgggaccccgcgaagtgaacttggtccaccggaccgcctctctctccccacccgggctctaatgggccaatctcctttgggccacaccaatgccacccgaaacaagtctaatatatatccctccttgatttcctttccacccttgttccataaatcattttcctatattccaaaattccatgaatcattttccttggtcccgcatgtcaatgactgtcaataatattcttgagaatattatttctataaatttcaaaaatcaatttccccttgttccacaaaatatcttcccttgtccagaaattccaattaatcttccaaaattcatatctcgcgtaattccgattgactccgttccacttccagtttttctctaaaattgagatctatttaatggcactattaattaggctaaataggatctttcttttgggtcttgtgtaggtttttaattgtttgtgtatagttgcggttaccggattttcgtcaatcgtgggaattctcgaagatacgtgaagcttcgtgaagaccttgagcaaggcaagtcaccctttgaccaattgctcctataattggaaaatcattattattttgtttccaacttgcattattagaatcacacactcaacttgcttggcctcagtttgcgtgccaaaccgacggacctacccagtagtcgcacttattcctgtaggctgtactaccctgattccttgtcgccccacctttgtggtacctcggtatctgtgctctctgagcgcgtataccaaatatcccacatacaccgttgtttgtaaaaacttgggaaatgggtttgagaagcctttaaaacccgtcatgtggtgtcggcgtgtttgaaaataaaataaaatgtgaaaacttgcgatgcgggggttgtgcctatgtggcactgtcccatatttgcatataaggaccgattactgtgggaaattcatccgagcatataacaagtgcgaccacacgggtgcaatgggacacccctggctgagtaattagctaattaggggagccttgatgccaagagaagtggattctccagggtggtgtcgggtaggacccctgggcttcctggcacagtatggtctgggaccaaacctgttgttggtctgggacccctctcgtcggcatatggtaaacctgtgtcggctctcgaaatgccttgtcatgaaagccttaaggtctcccgacgtggctgatctcacggactgggtgatccgggttagtaatgtcgtgtgggtaaagtgtaccccctctgcagaggttaactaactgttcgaacagtcgtgcccacggtcatgggtggatgtgaggtgtttcctgtagcatagatttgtttgcctatgctttgtgaaaagttgttgtgctgtgggaatcgttaccagaatcagcctatgtggcagatggatgacctgagtggtcaagaaacgaatctgtgtgattcgggatgtctacgggcatcatagactaggcttcccgagtggaagcggattgttgtgctgctgggcagttggactctgggaatccgagaaaatgaaaaggctctgggagccgactaatcaagtgaaatggctctgggagccgagaagtaatgatctgacccgggaggtcggtacattaccaattgagttgttgaaaaacatctcttaaaagtcgaatcgagacgcaagtctcttttcggcccaaacttagaaagaagtaaaccacttagtgatttcaaaaatgatttcaaaacaaaagatttacaaaacaaccttgcctctcttccaagcttgcattaaacacctaaaattcccgtgacttgctgagtacgaaagtactcacccttgctctatataaatatatatagttcctccgccttaaagagaagatgaagtggagtgaagaatatggtttcgtcctggttcccagccgtcgcctgtggtgttgggtgttagtccgttggttccgctactgctgctgttgttggtgtttcctcgtccgtgtcgtcggttgcattctcgggctgttctgagctgcaacctaagttaaggtaaataagtcctctatttattttaaggattgcaatgattcatatttgtcaccgtgggtaccaacactatgtcctgggactggtactgtgatcgcggtttcgtaggaagcggttcgcgccgtttttcctacgacacgctcctgtcaggtgccgttgtacggcggtgccggattgggagtgacaagaacccaatacgagattaatcaaaattcaaaataaaaataaaataaaatccaaaatagaaaaaaaaaaggagagtccaagtataaatacaatttaaaaatatttaaaattcggaattaaaaataagcaatattgaaagaagtatacattaataacccaatacgagattaatcaaaattcgaaataaaataaaataaaatccaaaaaaatacaatttaaaaatagctgaaatttggagttaaaaataaggaatattaaaagaggagtccatataagaacccaatacgagattaattaaaatttagaataaaaataaaaataaaattcgaaattagcaaaacaaataaaagaagagttcaagtaggaatacaatttaaaattagctgaaattcgaaattaaaaataagcaatattgaaataagtatccatataagaacccaatacgagattaattaaaatttagaaaaaaaaataaaataatatccaaaattagaaaaattaaaagagagttcaagtaggaatataattcttaaacaactaaaattgaaaataaacaataaaaatattaaaagaacacaatacgatattaattaaatttgaaataaaaattnnnnnnnnnnnnnnnnnnnnnnnnnnnnnnnnnnnnnnnnnnnnnnnnnnnnnnnn

SEQ ID NO: 5103 - DNA, 8538 bp, Oryza sativa
tatagggtctattttttaaaggttcggaactcctaaaagtaaaaaaacaaatgataatcatgttcaattttaaaatctcaatgacaataaagaagggagccagcaggcgagccgtagagaagtgcaatggtaaagccgctgacggtttggcgggacttctagaatgtaaaaaatgaacccaaacgataattatattagatttttaaaatcgcaatgtcaataaagagaagagacagtggacgggtcatagaggaatataatgacaatgtttgacgggacatctagaaattataaaaacgaaacccaacataacgataaactataaaactttaagatccaatttttaaaggttacaagaagaatgaagagaaatagtggtagatcgaccaagtaaataaagaaggagatgacataaggggtagcaactggtgtgactttaaaaaactatataattagaaacacggggatgataagatttggtctttcgaagtcttaaagacaatgagatagctatttaataaattttaagtaaaaaaatcctaaaaatatatatgattttgtttggatgctagccgcacaattgcgcgggccacccagctagataacatctatatgaatgtgggtaatgctagaaagtcttataacctgaaacaaaggtagtatatgataaaatagtaaatttaaaattatgagggtggtccccgaaaaaaaatatatgaaggtggaataaatttatattaacgagccagctcgtaagctgagttaagctaggctttaactaattaagattaatgaaacgagtgttaaaaaaacgatctgaaacgtgttgagccttaacgagccgactggctcgttatccacccctaggtgaaatcagcaaccaccgacggagtatggtttacacggttaaagatataaggaagcgttaagcttcctagcttctagttgatggcaccacgagtccggttcctgtagcttcttctgaggcagtaggagtaggcagttagtcagttaggcaccaggccgtggcctcctctcgatgcagagtcagtacagctatcaattagctatgtactactcgtactccgtatgctccaaacctaggagtacaaccttaaggcactgctggacagcagaatagcacatgctagtaaatctgaaataacaaccaaaccgcaataactgccccctccatcccaataatattagactagggtgtgtttttcacatcaaaattaaaattttaattgaaatttgaatgatgtgatggaaaagttaaaagtttgtgtgtgtaggaatgttttgatatgatggaaaagttaaaaatttgaagaaaaattttgaaactaaactcagcctaacaaagaatgtgacataactagtataacaaatctaaagggagaattatctagatttatattgtactaggttgtgtcacattccctcatagattatttttttataggatagagggagtatattgaacttgagagttacatcttacggagtacattcttttcactactatgaaggtcattcgtaacgagttgtaacactcatttgtaataaatagacgtctgatcaaggatgggtgcctcgtcatgaatgagtcgtcagtgatgtgaaaatctcatatgggtcaggtcccattccgtcaccaattgtagataatgggtgaaaaaaagtttatacagtgacggcgatgtagattactcatcaaagatgagggatcatcagtgatgggtttgaccgtgagacccaatcttcaatggggatttttttttcatgtcatatcttagtgcctatgtaccaggtcgttagccgttgtcactgttgagccattcacgattcccggttctatatcagtgtgtatagcaacccaaaacccatcgatcaatccaaagctcccctatctaccttatgcaaattaatatttgttaaaatttaggtctgaaaggacgtaaagtggtggttaattggtgatcacataaaacaactgttgggatctctagatgaaattaggttgccatgtacaatacgggtactcggccgattgttgttccatcatcatggacgaccaccaccatctggcccgtctaccatgccgcctcgaacgcggagacactcggtagctggcaagcagaacgagtttgggcagcagagaggcggaaggggctaggtggagactggagtaaggggcagtggcgctgctcatcagagaaagggggtggcgctgcgagcgaattgtcggtctgctgccttgaatcgtaagggttcaagtttttatggttgaaaatgcccctggctaatggggaattggatattactctgttggagaatggccaacgtatatatccctaaatgaaacccaattttaaaattagggtttcttttgtgaaaaacttgctccaacagtttctctaaaattgtatctaaaaattagaattcccttatcctcctttcttgctcttcacaagttgggagacgctttctcgctcccaatttctagaaggcgatacgtgaggagagctcacgcatggggagggatggggtaaaacaatttatgttcatgtatcagttggtagttacggccagtgggtccaccttttattattggaagttgatttaaagtatctcttgaagacaaaaatttatttacaccttaaattttaattaggaatttcaaaaacataattttagaatagatttttgggtatttgttggcatgctcttagtccacttttatcccaccattgatgcgctttaatttctgtgcaggtttctattcgatgagcattgaagcacttccctttatagaactatttcaacatgatactacatagggttatgtatcacgtgctaaaagccctgtaattttatataattaacttggaccatagtacatgtggttttataaaatttactcttaaaaatactttcatatgagtagttgctaataatatagtacaaaagaaattaatacttaaagtatacgttaaagagagtgttaaaataaaatgcagcttaaattttgggatagagagaatactgattagaatgagtgtctagaacggtaaaacattctttaaaaaacataaaaacttatatttgttaatttaaaaaattagaactattagaacacgcataaggtgttgtatacagtcaataacgcctcagtatgatggggtgggggtggaaggatttttacaccgtgtgttgtgttgtgtactcgtgggaaaaagattactttttgcatgaattaacgcacgtactgttctaaaatttaaaattataaaattaataatgctgtaaatctaaaaatataaaactaaaaataaaaaaaatacttattaccctaatacaactttttgttaattacgaatgcatgtgttaccaacaagtaatgcgtagtacggtaacgaattcgtagtgtatatatatgattctatccaccaaagatttacagtaaattttagtgcacataagcatatacatggtgcactgtcaatatatgattttagtgcatcccttctctataggtgtacatattcaggggtgcatgtagtggcttgtgcatatatgcgtacgccctcctccgtgtgtgatcgcaaaagagaaaagaaaaaggaactattatatataaacagcatatatataaactatatatttcgattatatatagctcctccctctggaagaacggcgggttgcagaagagtgaacttggatagttggcagctagagcagccagctagctagctggagtccttcttgcattggtgggcagactggaaagagtaagctagcgttaattttccctttgtttttctccgtctatatgcatgggttatcttaaattgcaggttatttctttaatttgtccattccagtaccttcagcagcttgttcttgttcttcgtgatcaacaagagatcgaacagcaagctagcatagcagtctaccagctaacttacaggctatctcgcggtctcgccatgttttgtagatcagctttagtgcaaaactacagattataaggtacttgattaattaattacatgtagagcttaccgctagcctaagctagctagctagctatacgaaacaattagggataaccatatactacgcttgatatatatgactgtaacttgtgaattaattcgtaacctccttcattctacgcttcttttgcttgtacgtactgacagtggcagagccaaaatttactgaaggttagagctaaactatatctcaattgatgggttgttagattttatctaaaatttacattatgatttaaagagatataaacttaattttagagataagactactttagacctgcataagcccctgcgtacatgacagtatcatcaccatatgtttgtcatcttctttccttattttgcacatacatacgcccatctcacaaacgaaaaataatttgtgaataaatttttatatacgtattcttagcctaaaagcaaaggctgaaaaataaacttcgatatgaaaaatcctgaaattaactctaaatttaaggttgaaaattcaaattttaattgataagtatatgtataaacacttattttgggacagatgcattatatacaggacattaaacagctactataagtttctacttctagtgtggtgatggctgtgccctaggcctgcattcgcccctccgtactgatgacagtgtcattaccatatgcttgtcagctttatctgcttgtctgattctttccttgattttgcgcacacctatgcaggaaattaaacagctagataggtttctagacttgtgtggtgatggcatctgctcctccagttcaggaagaacccctacagccagggacgaaccacttcaggagcctgcttgctgctgctgtgaggagcatcagttggagttatgcgatcttttggtccatttcaaccagttgcccagggtaataattagttcaatacgaatgcagttgcttggtgatattgttcacaaatataaaagattatggtattttaatttatccataaatataaaagatttgttatcctgagacataattttgtactattttatttcatacctatcaacttttgtactaatttgttcctcacctaccatagtttatatgtactccctcaatcccaatttaatcattccctaagcaaaaagcaccaaaactaaggacatcaaaatatgcatcattctcaaattaatcattacagttaattacagttaaggtgtttcatcgcttcatgtcccgtggattcccatgttttaaatattacatgtcattgcaccaatataaattaatcttggttggttgcatacaacacatttaatgatgtgcatttactgtttgcataagttcatttcataaaaaactatttgcataaataaacgaaaagacacttgttagatgatgatcattttgggaagacctcaaaaattttaagctgggatggaaggagtactactttattctcccgtataccactatgacgtgacattttgttatttccttaattctttacttaaaaatattataatcccttatatttatgaaggaaggtagtaactagttgtagaccagtggcgcaggtaaggagaaaaaaagtacggaccatagacaagtgctagagtgattactcaagaagaacaaagagaaaaacaacatattctcaattgcatgatattattggaacacaagaaggtcaaaattcgacagggcaacaaccacgattcattggcaaaagcacataaaagtacgaatgaaaaaataattcaacaaaacaggaagcaatgacgaatgttgatcaattattcaatttgatgctaaatcgacaaaattcccaatgtccttgagcctttccctttcctcttctatcagcttctcagttatcaaatctcgaaataaaaaacggcaaaggatcacaaattcacaattacaaatgagagaagtgtaggatcgaatcacaacaactaagccaaccagaggggggtgaatgattggtatacccaaaaaccgaaaaccgatcggtctgaccggagtagactagccagtctgaccgaagcgtagccgccggtctgaccagtgttgatattccggtctaaccgccaaaacttgtcgctgcctcctgttgccgacgctggtttgaccgtcgtgtgcccaccggtatgaccgccgcgatgccgccgatctgaccgccgtgtttttgattttacaagaagcacccaaccttcaactgaagtccgcctgcctccgatggtccaatctacaacctgcatgccttgtcagcactttgcctccctggctggcactgcccaacaggggaccctaatcggtgactaggcatgcgcccctccccttgcgtgacgctcccccctctagtccattactgttccttcatttgtttactgctagctaaatggccaaatgttccttgtaataaatgggtggtgctagagccttaacacccagagccttgcatgctaatgtatggaagtggatgctcattctaaagcaacataacaacaataccttatcataggcatctgtcttcacaatggactcatgaaagaaatctggcaatcctagaattggtgcttgtaccaaagccaacttaacgtaattaaaagtttgttgcaatgattcaatccatttatacttaacatcttttttgaccaactctgtcaagggtttgatgaccactccgtagtttttcatgaactttatgtagtaagcaaccaacccttagaatccacttagttgtttgaggttgttggcactgacgaattttgcacaaccttgattttctatggatctatagccactgcattgacaccaattatatgccttgttaaacagtttgtactgctataagatagcaaaaacttcctttaggtgttgcacgtgctcctcaaggttttcgctgtaattgaatatgtcatccacaaatagatagaagcacacattttcctattagggtagtaaagatagtattcatgaggccctgcaaagtggttgaagcattagtcaggccaaatggcttcaccctaaattcataaaggccttggcgtcttttaaaagttgttttgtgctcatcttggtttaacaacctgatctggtgataaccatacctgggatcaagcttagtaaaccattgtgcactagccagctcatccatgacttaatctattacctatatggggaaatatccaatgaaaaccatcaaataaataaaaaccgataaaaactggacctatgagctttctaaattcatctaaaaaaatagagacggatgtaggcatgaactatattaattgccactgaatttttaagtaatttgttttatgaatttagaaaacttttaatccgatttttacccttttttcacttatttgattttatttacctgatattcccttacttacataatatacgttccgttagatattatctcccagtatttatatactaaattatataatacctaaaaaatattacctgtagagttttgacttggaatgatgggttctacaacggcgtggtaaagacgaggaagatatccaactcagcagacctcacggctggtcagctcgtcgtgcagagaagcgagcaactgagggagctttactactctctcctgtccggcgagtgcgaccaccgggcgaggaggcccattgccgcgctatcgccggaagatctcgcagacacagaatggtactacgtcgtctgcatgacctactccttccaacccggccaagggtgagtatttcatctgctagcttgatgccaatacacacatacgagatgatctgttgatcgatctgtgcctatacacatgactgatcaaacttgtcggttgatctgctagcttgatagcaactccaataataggagaaaacaaaagctgggtaaaccagcctggaaatgtctctcatgacatcttaataacaagatatacattgctgtactgtagtgttgttattgatctgctggggtacattctgtctgcaggctgccaggcaaaagctatgcaagcaatgcatctgtttggctgcgcaatgctcagtctgcagatagcaaaacatttctacgctcgctattagctaaggtacctatatatttccatgctgtgctgctcgatcatggcatgtcaaccatgatgccttcaaacaaagataatgttcatgcattatatatcctccatataatcatcatatttaattatttactccatatataatgtcatgatctgactcgatcgcacgctctccatgcatgcaccaatataatgtcgtcgaatgctgcagagcgcgtctattcaggtatatatgtaggtagagttgtacatagtactccctccttccaaaagtctaagtcatatttcattctttggttttttttaaaagtctaagttctatttgtagtcactatgtgctatattaatttttttatcgaaacccaaaaaatcattttagtacttattggttgcatatttattagttttatcacatagtgaaag

SEQ ID NO: 5104 - DNA, 8366 bp, Oryza sativa
  unsure (1)..(8366): unsure at all n locations
nnnnnnnnnnnnnnnnnnnnnnnnnnnnnnnnnnnnnnnnnnnnnnnnnnnnnnncccaaaaaatcattttagtacgtattggttgtatatttattagttttatcacatagtgaaagagttaactatacattagtcttaatgaaaaagaaataggatttaaacttttagaaggaggaagtattttagctttcaaattgatatgtacgtgtacgtcgatcgatatctctgattccttttaaatattattccttttaccaaccattattttgcttccctttaacgagggcgtgcttgagctggggaccactgatccggtaagctcatcgattggtcaacacgaacaactatgcatggagctatagctagctcaatcgtccagtgatatagaacaacataattcctccatctaaaaaacacttttgagaatgaatcttaacacattttaaaaatatatataatatatatatcttaacaaacacttatccatattcatccttagaattcatccttagaagggcattttttctggaatgcgtttacgatattttttctaggatagaggaagtatgtattactccatttgattattcatcttataaaaaaattatataacgattatttatttttgctataacatgtttaatcattaaagaatttttaagtatgatatatactttaagcatatttacattaatcttttaaataagataaatgatcaaatattattttaaaaatcaacaatatcctatatattaataaactaaggtgtatatatgagagaatatcacgtgctcaatatgttatagcatgtccggggttcgttttgctcaactggcaaggagcgacaaagccattgggcggcagggtgtgattcttcgtactcaccaagtcaccatttcctaaaattataaatatgatatagttgcgtctttcctaaatattattgatgctaagcttctttttatatcccacattctttttatgttattaccatctcacattttgagtctagcacagtaaagcactattccgtaacacccgagattccatggaaaatgcttcaaatcagccgtccgggcggaaggcaaaaatcggacgttcacatcacttgggataggtgcatacagtcagatttaggaaaactattcataatgattgagaattcaaacgttttttttcctccaactatttatccaaactatgaataaattatataatttgattcattataattaaatcttcggaacaagatctcacatcattgtattccgatgactttttttctgactctttttagtgttgcacagtgttaatggaatgtttcaataaatattggttgatgtttcacatagttatttgtaatgttgcacttggtgtttttccatgttctagcaagatcactgtaataagatctcatatgattatatttctaatgaaaaaatatatatgtgtgtttttcattaggtgtaaatggatttttcatgtgtgagaaatagtgtttcaactggaatttcactttgtaataaattttaagtttactgttgcaacaaaatgttgctcatagtattatttagatgttttaatagatattttcttatgtttactatttctttatgacagttgcacataataatatacttgatgaaacattcaaataatatgatgtgcaacattcacaaataagtaatgaaacatcataatatatttattgatcccgtgtacaacggtaaaacatcattcggataaaaagcttaaaatgtgcaacataatcaaattatatatgaaacatttatttctaacacgtgaaacattaaatcttaatgattgaaacatatataatttttcaatcaaaatataaccgtatgagatcttgttgtaaaggtttaattataaggaatacaaccatatgatcaaaatgacaataagataaatggtttggaaaataaatcatctcaaaggttactaatatatgttaatcaatacatgcatatagtatcatcaggtagcagttatgtggtcagcttgctgatatagtactctgatagcgtccgatattttgcgttgcatcggacgtccgagcggtagtctctcggtatgttacatcatgttttagactttcattatagcatatgcctgccacaacatggaacaggtaggaaagacaatttataatgcaagtgcatatacagatatacccttattatcatatttgtttttcacaatttgtttataactatttcaataacatgtaagaaagcgcagctattagggctgaaggggtcctggcctttctcaatgaatgattttacaatttttaaaaaggtactggaggtccatattttgtagtgtaaaatttggtactctcagtattaggaggtatgaaaatttgcactagaattttttagccttttaaggactgtaaaatttctcttttccaatagcccaataacaacaaaccacccccccccctcccccgcgttctctccctgaaatgttacaattaggtaggtagctaacataatttacctctccattttaatttatattcctaaaatattagctaattaatacttgcagaagataatagtttgttgcttattttgctaagatataggtttttttcccgtattgtttgcctggtaatttacagttttagctctatgatattaccaccgcttatgatgcctttctttttctactatatgtgattttttaagttcatacgataaattacctgtgggaaatgttgaaatttgtgtatatttgttacactgtattttttatgattgacatcacttgtcaggttggtctccataataattagatacttgctttaccactacatgtaagacaagagaacatacctttaatgaacagaataacattttgcaaactattgagctacaggaggggattctaaattctcgaggggacatcctcttgttatttgcatgtcatcaaaatggttatgagatttttttaaaaaaaacaacaagatatattaatatgtcatagatcactccataaacatgtaaactaattcaatttctgtgagttgcaaaaagaacaaattaaactatggctagttaacgtatattcactgttaaatttgtttttctcattgcaacatgtagaagttgtatttaacattacatgtttatgaagtgatttatcacatattaatctatttttaaaatttttaattttttctataaccattttaataatatgaaaataatgagaggatgtcccctcgatagtttagaatagtttctcatttgagctacaagcaaaggtagacatattccactaaatgttatgtttatgaaaactagagggtgcaacattcgaagatgtagtttttgctgttccactcagtataagtcagctcttcacaactaattatatgtggagtgctattgaattcccaggttttggaggacccaaagttggtaaaccgaatcgttgcatatttccaggagcttcagtttccgatatgcttagaggtactaatgagcactagcccttctccgaacgaaacggaagatgccgacatcgtgtccgaaggcctcatcactcacaacgccatcgaagaggggcagatggttgtctctgatgagtgcgtgtccaacgccaaccgcgatccaatcaccatggagatcgacgagctctacagcatctacgaggacctggacctggacatggacctggacctggacaccgtgcgctttctcgaggataatggctggcctgtgaaccccagctcttttcaactggtcccggcgtcgtcaacggaggcggtggcggcggcggcggcggctaatgatgtcgacggtgttgcgaattctcaagtgtcgtgcttcatggcttggaagagcgcgaagtcaaacgagatggctgtgccggtcgtcaccggtatagagtcacagaagttgctgaagaaagttgtggactgtggtgcacggatgagcactggtcgtggtagtagagcagcgctaactcaagagagtggcatcaagaaccatgtcatatcagagagaaggcgccgagagaagctcaatgagatgttcctgattctgaagtcaatagtcccctccatccacaaggttaattaattaatctagtgttccaacggttctatattatactgaaagttatatgaattattcatcgagatgatttgtcactacaggtggacaaagcatccatccttgaagaaacgattgcctacctcaaagtgttggagaaaagggtgaaagagttggagtccagcagcgagccatcacatcagcgcgcaaccgaaacaggacagcaaaggcgctgtgagatcaccgggaaggagctggtctctgagatcggtgtcagcggcggcggcgatgcagggagagaacaccaccacgtgaatgtcaccgtcacggacaaggtggttctcctggaggtgcagtgccgatggaaggagttggtgatgacacgagtgttcgacgcgatcaagagcctctgtcttgacgttctctccgtgcaggcgtcggcaccggatggtcttcttggactgaagatacaagctaaggtaaggtctatcgcgccgtagaattgcagtactgaacgatgcttatatgtttttttgccgtatggagttatggtgatctgttcgtatgttgttgcagtttgcttgttctggttcagtggcacctgggatgatcagcgaagctctccagaaagctatcggtggctagcgtcgagagcggcacacgtacgttagatgaatttgaaatgcaagaagcagaagcagaagtgcagaactacaatacgatcctcgtgaaattttatttattatatgctcgctggtccagaaaaatatttgtttcggaagatagcttcaatcacatcctcatgttcatgcatactactccctccgtattttaatgtatgacgccgttgacttttcgaccaacgtttgaccattcgttttattcaaattttttatacaaatataaaaatatttatgtcatgcttaaagaacatttgacgataaatcaagttacagtaaaataaataataattacataaattttttgaataagacgaagggtcaaatgttggaaaaaagtcaacggtgttatacattaaaatatgaaggtgttagttcttagtatactgtacggtgttgatgaggtaccgtacgtatgatatctgtatcgctttcatttggatcaggatattgtgcagtggttgttatatattagaactgcaacttaagcagttatatatgtgcatcttgatctagaataaaataaaggctagggtacatagcggtattataacaaaaatactgtaacagagatttactattatattggtactgtagcactcactctaactgttggataaaaaacagatagcctaaacttatgtgcagttgctattagacagttacaatagcaaactgcatttgattttaatccttttcattaccactatgtggtctaactgtattgaagacgtatataatggcatggttaaaattttacataatctatatataaaccgtccacacgcacctgtacacccggggcagcgcactgcagtgcacacgtccctcggccatcgcgtttgtggccgcgcgctcacgcagccgtgcttgacgacggcttgacgcgctcgcagtcgttggcacacgtacgtctctactacttatataataaaaaataaaaataagagatgatggtccatcgtccgtaaaaaaaccgtgggaaaaaaaccgtgcaaaaaaaactatgtccgataaaaaaacggacggaaaaaaaaatccgcggacgaaaaaaaccgtgtaaaaaaaaacaaagtccgatcaaacgggcgaaaaaaggggaaaaaaacaggaaaaaaagaaaaaaataagtccgatccaaaaaagtaggggcgaaataaagaaaaaaaagaaactaatctgactcggtctacacggtaaaaaagggcgaaaaaaggaaaaaaaattaaacgaatccgactctgtcgacgcggtaaagaaaagggcaaaaagaaaaaaagtatatgtccgattccaaagaaaatcgaatcctattatatgtgacacggcgtggtaaaaaaaaacaaatcgaatccgattccatcgacgcggtaaaaaacaagcgtaaaatttttttctgtccgattccaaaaaaaaaaagttgcgaaaaaagttttccgtttctctttctctatctctatctctatgtctactacttaaaaattaaaaagtgtttccgtcgtccatccgcaaaaaaaagcgtaaaaaagaaatcggcgaaaaaaatcgaatctgattatatgtgacgtggtaaaaaaaattaaagatgtttctgacatccgtagtaatgaaaaaatggcgaaaaaaagaaaaaaaaggaaagtccgattcaatatctatatatacctaattaagaaaatttgtatggcttatgggttatagaaatgccatcgcacgtgcgatcgatcccgctttaatacccctccgatggcaaaagataaaaaaagaaaggaaagaaaaaaaatgagagaccgcatcaaatttggacctaaattctaaagaaaacactactacaagaatactagataagattcaagaacactaagaaaacgccgacgccggaaggggagggtgtcgccgtcgcttctgaaccgccaccgccgtcgcagggatgtcggtatgtcgggccgctgccacattgttttgagagagaggggaggaggggaaatgattttagggttagggtttgggctgttgaacttttatataagtcggaatgaccgtctatcagatcggacggctctggcttctcccgcgtcaggccgaacgccatttccaggccgcccacacggaataagttcactttaggtcgcttaagttgttcctccccgattctattcctaggccgcccacgctattgggccgccttattgaccatgtgtaccctccgtacggaacaagttcactttatgtcacttcagctgaacttttttatttcattataaatatattttcttaaagagctcataacatgtaaaactaaaccttaatcatataatatttttatatttgttataattttaattacccgtcgcaacgcacgggtattttttctatgtcaaaaaaagaccacgacatataagtgagagatatataccccacacacacccacaggctcatgtttaactgaactgacaacagattttcaattacaggtctaattgttttatttaggtgattaaatttgttttcatttatataattagtttgctctatttaagctttttgaaaattgctaaaatttgagaataactttcctacttcgtattatattatttttagctaatggaattaatggaaaattaattatatatttttatctttttgattgaccaaaggtcactgcaattttatttcattattattattattattattattattattattattattattattattattattattattattattattattattattattattattattattattattattattattattcctttatatttttttcccaccagtatacatgattaaaactacctttactcgttgcaacgcatggacatcattgctagtagagaaaaaaattgaaaatatacaatttttttaccgaaattgcaagaatatactaaataggggaagatttgcgaaaatataccgtcgtcgcactttgattaagcgagagcgcgatatcgcatcatggattagcgaaggcgccaacgctattgctaattgaaaccgcgggagcgctaatgcatcagtctcgcattccaaaagctcgagaacgactcggtctcgcacgatcgtagagcaatttcgcggccgtctgacgcgaacccagaccggcagggccccaagcagtctctttgacagcgcgagagcgcgtcccacctgctaatggaatgcatgagccatacacgtactggcatatgtccaggcgaaacgaaccggctcgtcccgattcgcgcgctgctcgagtaatgtagcggtcttgaagagaccgctcattattgtcggtcggtttttcccttgccgatgcgcgcgatttgcgaccgctgggtttctgcccgcctgtagagaccggccccgcctgtcaccaggcctaaggagtggcgtcacgcccgagcgcttccctcgaggggggtgatcgccctggcgtaacgccggcggctactgtcggtgatatgggaccgggggtatcgtgactagaggcttgggcaggcgcggtcacccacgtggcctgaccccctcggggggtgggcgggcccgagggtgacgtggccacccctccctctgtcttcccgaggg

SEQ ID NO: 5105 - DNA, 1374 bp, Oryza sativa
gagcaatttcggggccgtctgacgcgaacccagaccggcagggccccaagcagtctctttgacagcgcgagagcgcgtcccacctgctaatggaatgcatgagccatacacgtactggcatatgtccatctatatgtgtgttcagccatatatacatgcatgcttggctaatgtatatgcgtatacatgcatgagccaacaagaagatgatctttgagggctatatatatgtgtatgcatattcgtatatacggcatgttcacttgtggcctgcatggacacgattcagcggccgtattcactaacgatatgcacgtattcgccggtatagccggtatcgatttttgattgagcgataacaaagcgctctctcgctttgctagagcgataccgcgtgtcggtctcgtgcattgggacagcgagaccgatatctttgcgtgtgcgagaccggcggtccactcgtgcccggtcgtttcgccaatgtgggtcccacgacgtgctcggtctcgcgcgttgggattacgagaccgatttcgctctcgcgcttgcacaccacgataccgacgcaacaacgggtcggttccttcatgtggcggtctcgttgtttctacaagtgacaccgccagctcaaatgcaccctcacgagttgatagtggcggtatcgcatttgttgtcgcgaaactcggtatcgctctttcaagccacgatactgatagtatatttgtgcaaatcattcttcatccggtatatttttacaaaacaaatccacaaacagtatatttttgtaaatccggctagttgtgtgtggttttgcctggttggctccgtcgccgccggttgtcccgcttgcggcgcggagaggagacacggggtggttcatccgtttatttgttggtttcctccagcgcagaagctggagggtgtgaccgtgaccgatccccgatcaccgattccccgacccttcgttggttgactaccgcagtggattgctatcagtttttttttttagccacatccgtgtcagcgataaattgaagcctctctgatcagtggcgataaatggcgacgacattgacatgcttctgtgtaactctgtcagatcacggcagtgtctagttcccttccaactttcaaaaattccgtcatatctacatacatacgtagagtattaaatgtggacaaaaaaaaaccaattatacagtttgtatgtgaattacgagacaaatcttttaaacctaattacatcatgatttgacaatatggtgctacagcaaacatttgttaatgatgaattaattagacttaatagattcgtcttgtagtttacaggcaaaatctataatttgttttgttagcaaaattggttatatagca

SEQ ID NO: 5106 - DNA, 791 bp, Oryza sativa
  unsure (1)..(791): unsure at all n locations
aagatctgacatgaacatggacatggagattgtgatcgagaagtgattttcctatatgtatggtgtgctaatattgccctatgtatatagctccaattgcaacctaggtaatgcattacattttgttaacagatcaagctgattaacattggccgttagcttgttaactgcttggtttcttgtaatgcagaaatggaacttttgtagcctagatgctttcgatctctagaagaattgaagctaagaaaaactcccaatctgtatctcttttaccaatgtaatatataatttatatagattattatgccttgtattttgttccactccaacttttgtgcagaaatgaatggagaagatctaagagcaatactggtaagctctaaataattttctatctaaaaaaactctagataactgaaaagagttcagctgttgtatttgcgacttcaatgtttccttagaataaaaacaataatttctaattctgtaaaactagtctttgcaggatcacaaaacattaggtcaccattcattgttgtgcaggattatcttaagcaaagttacatgtggtattcctctattttcttccttcccaccagcatctataattctgagtttctataacgtttatttttccttagcaatcaggttgagcaaaactcaacaaacttcagaacatgctgagcttactaatataatgtttatttttaacacacatcatccatgatcaactttactcacatttacgccaannnnnnnnnnnnnnnnnnnnnnnnnnnnnnnnnnnnnnn

SEQ ID NO: 5107 - DNA, 516 bp, Oryza sativa
  unsure (1)..(516): unsure at all n locations
actatagggcgaattcgagctcggtaccccccgataccctcaggcccagaagatgctttacgctattctgatggcttcgaggaagttgcgccattatttccaggcgcatcgggtcacggtggttacgtcgtaccccctcggccaaatcttgcataaccgagagggtactggacgggtggtgaaatgggcaatcgaactctctgaattcgatctgcgctttgaaccacgccacgcgatcaagagccaggccctcgccgactttgtagcggagtggaccccagctcccgagcccgtctccgcccccgaggccagctcgggcccctcgcagttgcctcacaccgccttctgggtgatgcagttcgacggctccctgtctcttcagggcgccggtgcgggggtcacgttgacctcgccgagcggagacgtcctcagatagctggtccgcctcgactttcggnnnnnnnnnnnnnnnnnnnnnnnnnnnnnnnnnnnnnnnnnnnnnnnnnnnnnnnnnnn

SEQ ID NO: 5108 - DNA, 1792 bp, Oryza sativa
acataaataaccaacattacagatctacttcccattatttcaacatgtgcacatgaaacttaagcaattgctatcgtatacacttgctaatacatatttttttttcgttttacataatatactatgtattatctataaaaaaaattcaagcatgcaatttctctcttatatatgtgaatgatgaggggtataagtatcatttatgaagagagttgttggttaaggataagtttgaactaaaatgaaaacttgaaggactaatatggatagattgaaatatcaaggactaaactgagcctcagatgaaatttggaggaccactttgcctattcacccaataaaaaatattagaatctaaacagggcaagagttggagtataagagccccatcggtagaactaaaaatcaataagcaaaagtcaaaatttaaattttcaaacttaatttttaagtagcatattcttataccagatgtgacatattcttgtatcacaaatatgaatatatgtatgtatatattcgtagtgttagaatgtgtcatatctaacattatagtttggttttttatgctactgagggagtacaacagtagccgttctcagttctcaccgtggtttctttctccctgcgcgcatgaatggtgcaaaggcgaagagtcaccacgccgcgtttaactttctcattctcaccgtggtttcttcctccctgcgtgcatgaaccgcgaaaggcgaagagtcaccacgccgcgtttaactttctgcatggtcgccggacccttggctctgcgtcgttctccaaatcgggtgccacgaaagagaggctgagtggctggatcttgtagtattggctgactgttgctcgctggtttaatttgggagtttaggacggtagcggctggatgagatggagatagccggacagggaggtgataccggccggatatatgacactgccgggagatttcgacatttattttgtagaccttgcagttgtggataaacggaagtagcttgctgcaggctgcaccgtttgattgattggaagagtgtggcattcaccccatctcaatcgatccacaactgctatttattggctggagttacgtttctgatggagagatttaaataaatgtatcaattatgtcctgcacatcagcatcattgggtccatagctcagtggtagagcatttgactgcagatcaagaggtcaccggttcgaacccggttgggccctatttaacaatttcacatttttacttttgacggtgaagtttttttttttccacagtgattttgttgctgccctggcctatgtttgacggtgaagttttttttttccacagtgattttgttgctgccctggcctatttgagctccaaaaggagagatccatggagttttttttccacagtgattttgttgctgccctggcctatttgagctccaaaaggagatatccatggaattttccctacaatctctttgttgatgttctgatgaagccgcaaacgatttacatttgacggtgaagcttttttttttccacataagcccagttagggaggtgattttgttgctgccctggcctatttgagctgcaaaaggagagctccatggaattttaccaacaatctctttgctgatgttctgatgaagcggcaaacattttttcctacatttttgtcccgatgatgctacaaacaattgaataatagcccactagagaaactatattttctaaactttattttcattgtggctaaatttgtttcccattccagaaggagccaca

SEQ ID NO: 5109 - DNA, 8293 bp, Oryza sativa
  unsure (1)..(8293): unsure at all n locations
agagatccatggagttttttttccacagtgattttgttgctgccctggcctatttgagctccaaaaggagatatccatggaattttccctacaatctctttgttgatgttctgatgaagccgcaaacgatttacatttgacggtgaagcttttttttttccacataagcccagttagggaggtgattttgttgctgccctggcctatttgagctgcaaaaggagagctccatggaattttaccaacaatctctttgctgatgttctgatgaagcggcaaacattttttcctacatttttgtcccgatgatgctacaaacaattgaataatagcccactagagaaactatattttctaaactttattttcattgtggctaaatttgtttcccattccagaaggagccacaaaagactaaataatagtccactagaaaagttatcttttatacaccttattccctcgtggagctacggacgttgaataattttctttcctgatggagccacaaacgtttgaataatataagtgaaagtgatcattgaaaattattattattttcttcttcttcttctgagaagatcgctgcaatttttccgcacgtggtgcttttggcctgtaggggatcactaaaattgcttgtgcatggtttcgtacatcttttttttttaaggaatcaacatgagattgtactatttcattatttcattagatatagacgtaaaaaaaaacttcccctagaagtaaaaaagagctgtacaaaattacataagcgccgtagttaagttgggatgaattcttcaagtcgccttgcgcttaccattatccaggttcttgcctcttcctttatttttgccataaggttggagactgccgttttcttttgctcgaagatcttttgattcctttctttctagatttctcaggctatgagtaggattaaggatcataactctttcttggacactttttttttttgatagtaacctccaaaacagttctgaggaatgttgtgcacagtagcacggcaggtaataggaaccccaccctgagcatagtgccgtggtggcgccgtgcaaacaaagcttaaggcctattcgtttttgaagaatttcaaatgattcagattcttgaggattaattcctctgaacgctatttagttcataggaatgtagctatagaaaaaacaaagaaattttcctttcctacaagttgtaaagagaaggtatagtgaatttttcatccactcagaactcatggaaaagttcatatggatagaaatgtgtatgcattcatattccttcatttttcttttttctatgtgtcataattccttcaaaacagatctacccttaagggtccataatgtgatgaaaaactaggtattaagcattgaatgcactcttgctaccaggtggcaaccattgtaaaagtcataagcaactaataccttatcatagagctactaccggtacataagaaataaatatcatcatttgtacagtaaatgagtagtagaagtaaatctggcacatgcaagtaaaatattagtagaagaaaccatggagtcattgtttcgcaccgttcacaggaatcaacttttaagtggatcctaccagtagcgcaggtaaggggagtgccaaagggtgccaacacccccctatccaaacactaccaccactatacccctatgtttttactctatattaagttagctaagataagtatctatctagtttattttgtgtagcttgaaagtattatcagtttagttagttagcaagtctaaaaatattagcaagaaacatgatttacaaaactagtttgtgatttctcatatttttcaaagtaaaatagatgatacttatttgtgagattattttatagtttacattaaaagaatttagcaataaagactagttttaaacttccaatgatattattaaagagctaaaattcaagtttttcttaaagaactagtttacatattgcttgttattgacggtgactatttgatctcctttactatcaatattagttatttggtctcacggtttatctttatcccacaccccctaatctcaaatcctggcttcgcccctgatcctaccttacttctcactcacacaaataagcattgtgggtaacttcatatactactatcacctgtatcttgggcccacgttactactgagtctggcaagatacgttgctcatgccctaaaagaaacatatcgctgcaacaaagtgacagatgtaggatctggctagaaaaaacatcacaaccagttcagacatgagtaacatagaaaagttaagcccggccatcgtggccgccgcagccgccgccgccgtcgtggtggtggcaaccattgttatccttgaagtcaccatcgagcaccgccgccactggatccgtccccttcaccatcaccgccgccgcagcctccacctcctttgccaaagagatggaatatataagctagtatatcatattcttgcaaaaaaaaaagcattatcacaaattccaagaaagatataccatcccaacttcaattttagcaacaactaaaggcatgttcaaatcactgccaaaatgaataatgatatggtttagaaacatccatatatttattaattttatcaataatggtatgctttaaattggcatctatgtgaacggggccctaaatcactcggtccgtggagcgaccggtgagtcacgtgactcacgttgacgatcgttgccttctgcggacgcgctcccatccggcgccaccttcgtagttgccacctccgcggaacgcttctcgccatcatcgttgcaccgtactgcgtcggagcacggctgctgcggcgcctgcgccggcggcgtcatcatcagccgttcttgctcagctgcagcagcggcttgagcctgatcgatacgtcgttggcggaagagctccttcacgagctgccaaagcacacgcctcgcgtgcatctcgggcgtctcctgcgcgggccgtggctgaacgacggacggcgacggcggtcgtcgcatcaccagtgtccgatcaaaggagttgccggagttagtaggcgctgccgttgccgggcgagaacgcaatggcgtcggagggacggtgttgaatggccgcgcctgcggccgctgcacatgcgccgggcagttgcatgccgccggcgcccgttgcgccgacgacttcgtctctccgttttgttccacctccgccccctgcgctggcatcatcgcttgcggctgttgtgccgacgtcgtgtgtgccaccacctctctcccctgtagatgctgcgcctggaggttgtacgccattgccgcctgctgctgctgctgctgttgcagaagcatctggtgatactggtagttgttgtacgccgctgccattgccgcccgctgtcgttgtaccggcgacatctgtccgttgcttgccacctgcgatccctgaacaacaagcgcctgctggccgttgcacgccggcggcggccgttgcgaggacgaggcctgcccgttgtctgccaccaccatcccctgctggccattgcgtgccgccagctgttgcagaaacatcatttgccgtctgttgtttgcggccgtcgccatttgccgtcgcatcatcatctggtcgccgtataccacctgcccgttcggcattcgcatcgggccattgaccgtcgcgtgctgccgaggaggaggcgccgttgcgtggccggccggacgtgccatcgggtgcccggctcgattgtcgtgcacggccgttctcagcggcatttgcatgccgccggcgccgccgatgtacgacgcgggcggtggcggcggcgctcctcccatggtcagcttccgctgctgatgcggcctctgcgccacggcggcgtgctcctccgcaggcctcttattgcccgacgcctcttcgctggttcccattgccggcccgggctgcggcgaggagaattctccatcggaagaggcgatgctggcgattgcttggggcccgggctgcggcgaggggtgctcgacgagctcctccttcggctcgaaccggaacccgagggggaccttctccttcttgtctcctctgccaccggtgcccctcttctcctctccttctgccatatcggctattcaacctgcccaatcgaggttgcctggataatggctcaaataaatttttataatcacccgacgttaagtttgcaatttgagatgaactcaaactctatggatggcaggagcagctggagtccggaacaagacgggtttgattccaattcaattccaattcaaatcggtaaggaaacggtaagaacatgagcatatctatatttatacctataattaaaaaaatacgcaaggtttccgtaattttttttatttttcaccttttttctttttctttatcatttcctttttttctccgtccttttttttctttctgtccgcttctttttttttcttttttatccgtcctttttttctttatttccgtccttctgaacctttttattttttttattttttttctgtttttttccatccattgtttttttcgtccgcctttttttcttcaccttttttctctttttttcatccacagtttttttacttttttctaggcctttttactgggttttttttcaaactttttttctttgtttatgttttttaagttgcattttttcgcatgcggtaaggatttttttacgtgccatattttttttgtcgcccggtgttaacagtgaaatttggtaagtccggagtagtcatcggctttgaagttctgagattagccgatgagagttgtcaagtcgtcagttgtcggattcttgctatattcggttaaggagattgatctactaaatgaagcttatccagaaaagaccgagttcaaagagaatgcggcatggcaagttatctattaattagaaataatttgttagtttccttttatctttaggaaagtttctttcttgtccggcaagaacttgtatcaacacatgggtataaatatgtacacccggggtctatgtaatctatcttcacgatcaatacaattcggcgcatcgccaccttttaccttttctactttattttatcgtccggcggaacttggcacctgacgcggggctgcatcggtgttcgatctccggctaaggggtaagtccaatgtttcgctggcccgggcaattgtatcatttacgtcggcgtcgttcaaggctgcatcagtacattcgacctctttgattgctctggtttggatgatatatttgcctacctatttatcatatgtctatgttaatctagtcttagcatatcaatttagctctatcgactgcttctctttttagggtttctgccggtatcggctaaatcgcgttgttagattagattagcttagacatctaccaccctccaccctgaaaactcagtcaacggcttgattgcctagatattatgtttcttttcatacttagtgctgcatcaattaagtttgatctactaagtcgtgtttagaaccataatctctaggctgcttcttgattgccaataagggtttcatcgaggtttcagccaatgagttatctggatgttgcatcagctcataaggattgtatatacatataagctggatttagccgatgacaacaaaggtttcactgtttaatctaatcttgtggatttcatgacatcagacctccagccgatgtgtgctctaaccttcggatcgatgcttatttatcatatcattatttgccgattggtttatactggattatattgttattttatttcatcatcatcagccgattgcctttatatcattatctacattggacatatagccgatcgcttaaaccctatcgctatcggctggtatcggcatcggctattatcggctatcggctggaactactccatcggcttgtcagccgattggctgtttgatctactgtttgcatatcttgtcagttgcaggatcaaactgactggcatggctgcatctcatcaagatttggacctgcacaggagctaagcagatctcccaggccggtgtgttcaattttttcgtcaacacccggctaaacactagcgccaccacctcgtcgatctgccttcccatgcgttccctcctccaattgattgccaaaaatcaattccccgctactccctaaccattttactatgatttccccttttaactccgctttaattcactgaatttaatctccatttaaaattcaccctttttatcccgagttttgtcgcttcgattttaataaaaacggaaagaggatatctcccgagttttgtagctccgattttaataaaaacgaggggattgagtgtatcaaaaaccctcaatcaattttggaagatcgagaaagattcaaccggatttgatggggaggatttgatcggatttgatggggaggatcggttttggcatgtacgaacacgacattgtcttacggaggttgaagacaacagtcggctctgcgagctggacctacaactccagttgacaaggaaggaatgaaatgaacttttggtacaaaatcaaagagtaaaatgtatagcgatccaaaaatatttctacccgttgcaacgcacggatatttttctagttatataatagtgggcattttttctagtttatataatagttttaagaacctcagcatatatgtacttttatggcattggatttactatggataataattaaagtttgattctgaatactatgccaagtcaaaccacgcgttataatttgagacatggcatagggagtactgtatcattatatatgcaggggtgaaaacggtagggataaatatcataaattccggccacagatcgcttccacattccaccagccaattcaatcagccatttcattaattgtctaaaacattgttgattactacaccggtgtatgaaaaaatgaatttaaacagggagaagcgacagttgactctggcatctttaggacctgactaacaaaacaaatcagctgcacctgcatgaggagaatttcatgtacaatattgtggtaccttgggcctagtttgaaattattttttccaaaacttgagttgaatcttgaaagcttgtaagcaatcccttatttagggtgatttctgttttcctgcaactgataatcgtctggaaggaccatacattggagttttcagcagcacacactgaagagcacttcggacgccgtccactgccagggtttgagcaagattgacaaatataagcgacaatatgaaatcagatacttccttgtaagttgccaaaaaaaaaacaaaaaacaaaggaaggaaaagtagtcggacacttctaacttgttaagcaagagcatacatcactatatcagcgttgccatgcgcttacattacttgatttttccatttctgaacagaaaaacatagcaagagcgcttggctcatacagtttactacaagaaaaacatgatatctagtggtgattgatcctgtagggagcgatcaaaagcattcaaaagttgctttctattgatactaccatgccttaccatgtcatatatatcattctgaggtgtcatccgctgctcaataatatcggatcggctaccagcaaataattgtgctattgtcccaggaatatctgaaagtacggtattagtttgactgcctttacttgttagattgctggggggtaggatcatggcatttcattttgcagattgacgtgccaaccactctgatctggttaaaccacagtaccttgtgctacttccaggccacataaggaaattccagccaatgggagatccaccgacaatataagatccttgcaaacattgtcctgatttctttgtagaatctgttacactcggtttggcatcatgcttaatgtccacaggattgagtggtaccttctcaccagaactatgcataaaggatgcagcctggtctgctggacgaacttgattcttctctccgggtgggattttccctgcaggcatatttctggcatctcttgatgtaggctcatccatcagttttacaggcccagctgcagttgggagatcaagtcgcatttccttggataattccatgagaacttttatctctgcatagtgtgaaccaagggaagattgcttaaacttatcatcaataaacacatccagatataacattaagctccaggtgctcaacagattttgtaggccaaannnnnnnnnnnnnnnnnnnnnnnnnnnnnnnnnnnnnnnnnnnnnnnnnnnnnnn

SEQ ID NO: 5110 - DNA, 2540 bp, Oryza sativa
tacttccaggccacataaggaaattccagccaatgggagatccaccgacaatataagatccttcaaacattgtcctgatttctttgtagaatctgttacactcggtttggcatcatgcttaatgtccacaggattgagtggtaccttctcaccagaactatgcataaaggatgcagcctggtctgctggacgaacttgattcttctctccgggtgggattttccctgcaggcatatttctggcatctcttgatgtaggctcatccatcagttttacaggcccagctgcagttgggagatcaagtcgcatttccttggataattccatgagaacttttatctctgcatagtgtgaaccaagggaagattgcttaaacttatcatcaataaacacatccagatataacattaagctccaggtgctcaacagattttgtaggccaaacaacagggatccactttggttgaccttttaactttacagataacatgtacattttcaaattgctaattatgattgggctaatgcaggatattatgaataagtacatcagtagccttttttacactaacagaatgaccgactaatgcactatatttcacttacttactaatgtagggtactaggcatcttattattggagtatgtaaccgatagttatgcttgcattaagaagcctaatacaatacatcatgtgacaatataagtaggaatttgtaaaagtgtataatgactataaacaacatgtttacaagttatagaaatgtaacaactgatgaaaaattgcaagtgtccaatcacaagggttttagatatcttaacagcacgaagtgactatggactacatctacagagaggcaatgactgtcaaatcacctgaggtaatcttagtgtgcaaaatatcaagagagaagtgtgcttttatgaaagaaggtgaaagtaaaattgttcgagtgatcaacataatctcctataccatactgatttctgtacttgcgagcatgatgataaaaaatagtcaaaaactcaaaatgtaatcaggacgttccgcatgtctgttcaaaaacaatataaattaggatttacctttcaggatctcaagagcggcatctttcttttgggtatcagtgcctttgcataacttcaaaacaacaaggaaaaagtaaacattttagagcggattcatgttcttcccagaacaaactgcatttacaattgtcaaaccaacagcaagcagggatatcaatttggtgtaagttatgatacaataatatgatttttctctggtccttgggaggtagagaggtatttttagtgttaatcgggaagtatagtctctactgagagcgaggtatacctcttgattaacaatatggggtaaaactctcaatacctcccaaagccacacatcagccatgaaaatgttcatttgcatagtaggacaatggtggcattaacaactcagttcagaatcatcacaccataaatttcagctagaaagagattacgcgcctaattgtattgagacttggcccaaaattcaacttcaactttaatttaaattctcccagagtttcaccagcaagcacagcacggagcaaatagcttcgagctctcgaactcgaaccattgatcacacttatccacgtcaagcaaaatcatcccatacacgttgcgctagaacacgggaacatgacctgttcagttgattgtgctgctgctgctgctgctgccatggcagagcagagaaatgccactcaacaaatatcttagggttcgaggtgggggagacctgaatgaagcggccgcggaggttggcgacggctgctctgatgttgtagtagggtgagtgatgaaaccccacctcctccagcttccgcttcttcggtgccgcggtcgaagacgtcggcggcggaggcgggggctttgggtcgctggtaggcgtggactctgacggcggcggcggaggaggaggcggggtggtggtcgtcggagcgaccatcgcggtagcggcggagcgtggggtttttctgcaaccttccctgcctactttggaacaaaggaatttttatcccctctatctcaagaggagtgtcagagcattagcggtatatagatatatagaacaccattaatattaaataaaatttaaataatatggataagaaaacatagagattcgtctgatgatttttatacaatatataggatgcatgtaactctatagagcccaagtccaataagtgttaaggtggatgtttgtaaaaaatatcaattttttatttgagatatcaggtctaagcaaagagcccatttgctccatttggtgcttaagatctacatttacaatatactgataagattcccttaggatatcccaataacatggttcatagataatataatattacatcagtcatacagtaacattgtacaataaatgaggggattttaacaatttaaaatttgatataaggtgattgaaacattagcatttgtttacctcagcttcccccaacccaagggggatcctctagagt

SEQ ID NO: 5111 - DNA, 3813 bp, Oryza sativa
gatttttatacaatatataggatgcatgtaactctatagagcccaagtccaataagtgttaaggtggatgtttgtaaaaaatatcaattttttatttgagatatcaggtctaagcaaagagcccatttgctccatttggtgcttaagatctacatttacaatatactgataagattcccttaggatatcccaataacatggttcatagataatataatattacatcagtcatacagtaacattgtacaataaatcaatacgaagaaaataatgaaagatatccattgggctattcggcaagcggacaacatcggctgtggctatgctaccgctgcgtgtgtgcggcattgttggtgcagctacagcgcaaccataaatctagtagccaaacaaaccctatatgcatatggactacccatataaaataaacaatactcctattatctatctctcctaatgttatctcgtgtatattactatatttaaagtccatgtatgtgagtcccatatatattaatcactttttgctatatacattgctgatgctgtgattactcttattcccacattgtagatactgctatactccctccgttccataatataaaggattatgaccttttacttgtactgtttgaccactcgtcttattaaaaaaaattatgcaaatataaaaaatgaaaagttgcgtttaaagtactttggataataaagccagtcacaaataaaataaataataattctaaattatttttgaataatataaaatcctaaaatataacactttttagttatgcatataaacaagcaatcacttattcatatttcttaccgcagaagcttatatttaaaatctgctttgaggctttttttggaacaacatattattgaaagaatttaagaggtttgcattcctctagaaattttccgtatagacttgtttgagacaaaggaaagatgttgaattaataaatgcatcaagaaaaaaaaaatctcacagctctttaactgtatggcgcaaaataatcgttggacagctgactatggcaaaataaccggaactggttcgacacaacttttcatgggcctctgggcgcaccgctcacacatgccgatacaacttcccatggcccatcgagaaccgcgagcgcctcaacttcccctgggcctccccgccgtttcgtttccgttctgctctcactgacaaagtggcccacaccgcagcaggccccacctgccattgtcgtgcggagaccgtgtccgggacgaactggagaggcagccgcccacacggccacacgtctgtcggcttatccgggtggggaagccatggccattggccaccaccacccaaggggagcgcaagcgcagaggacaagagcgcctcctcgtctggtctgcttcggccccccgctcgctcctcctgccgaagcactcactcttcggctgctcatcctcctcctcctcctcaggtcagcaagattcatccggtttcacttggattgtctgggatttggtagttgaagcatttggctattcttgttttgcgcatgctcctagttcgtctgcgtgggagaaaatactgaaaagggggtagttcgtgtgtgtgtgtgagcatgccccattgtttggcattttgttggagctgtatatatgtgtcattggctagaactttgcaatgtcactacctgcttaagctcagcaattgtgcttcagttcgtgcaaccttttgtactaagctgaacttttattttttcctctcctggtacctacaataaccttgtctcagatgcaaaaggatctctttagtaaaaggcactttgcttcatgtagtattattgctgtcagatgctggcaaacattattggggctcggcattcttttctttctcgaactcaaattagcagtttggaagagtgcgtcctacaagtagcaatcgtataccgcaatagtgtgaagtaagttgcaaatcaaatgcatatggcaatctagtatattgacaacttttgccgctatgcaagttttttgggagaacttaagctccccaaatataagttgcacgttttgcggaacttgcattgtccaggagaacccccaacctcccacaaaaactttgagtgacttaacttaagattgatgatttatagggccttctgttccctctaatatagttgcgcatttttgtacttgtactgatttctttgtttttaagacaggtcaagtttgattcttctcttgttctctttgttctttataggagcagaaccagacttgccacgaaggatttgataatctaggggttcgggacgagatgatattttcagtcagcttatttggtagttcccaccagtccattcacaaactttacaggaaatgctggtcaagtaactcacattctacactgaatgtgctttcacttgcaaaaactgtgggtcaaagtatgagaatgaagaggatacgtgtcaagcctcatgccactgacctgaagaatcgcccccaggcccatgaggataatgtgttctacaaattggtttataggctccctgaaaacctcagctggctgttggcgtcaccagaaatggctagaagaccaccctcaaagaagaaactaaagaaggaagaaatggtaagtagtaatcaatttggtgtgatcttggagtgggaaggagttgttgtggaagatgatgatccagatttggagcctcgagtttggtacgtgttatcacttgaagaggcaaagtcttttcctccagatgcagtgctgaaggaaattgaggggatgaggactgatcaggctattttagaagtcttacattggtcagaagatccacaagaagtacaaaggctggcagcacgcaaggaggtaatatataaaacattacgtggtagattctaccaactgcgaccaggtgttcttgatttcctgaacacccttgtggattttgacattccaatagcaatcacaactcctcgcccacggttgagcctagaagaagggataaaagctgttggtcttcaaggctactttgatgctatagtggcagcagaggatttctgccgagggaaacccgagggggagatgtttgaggtcacagcagggcaacttggtcttgagcctgatgtttgtcttgtgctgggtaactcaaattcgacaatagaatctgcgcatactgctgggatgaggtgtgttgcggttgcaagccgataccctgcctatgagctccaagcagcaaaccatgttgtaagatggcttgatcagctatctgtcgctgacctgcaaaggattgccaatggcgagattcttgggctcaggggcagaagatctgacatggacatggacatggagattgtgatcgaggagtgatttttctatatgtatggtgtgctaatattgccctatgtatatagctccaattgcaacctaggtaatgcattacattttgttaacagatcaagctgattaacattggccgttagcttgttaactgcttggtttcttgtaatgcagaaatggaacttttgtagcctagatgctttcgatctctagaagaattggaagctaagaaaaactcccaatctgtatctcttttaccaatgtaatatataatttatatagattattatgccttgtattttgttccactccaacttttgtgcagaaatgaatggagaagatctaagagcaatactggtaagctctaaataattttctatctaaaaaaactctagataactgaaaagagttcagctgttgtatttgcgacttcaatgtttccttagaataggggatcctctagagtcgacctgcaggca

SEQ ID NO: 5112 - DNA, 4063 bp, Oryza sativa
acattaccatcctcctcatctccatcccaatcctccaaattaaactccacttcttccccattctcatcgactcctttcttctccacctcaaattttaactcaaaataatgatccccaattaccacatcaagcaccttaggaatcaattttgggttaaggatagccacaaacaatatcccaaaaacattctttttagtagttttcatatcaaccaattatgttgcccctaaaagagagcctactgcccataaagttaaatattcccttagtttcttccttagtccaaaaaccttaacccataccttaggtagaagaaaaccctcttcttccacaaaccactcttcaaactccaccctcactcccatggctacccctccttccttcacatctgcacccccaaagttgatggcccattgcaattcgccctttgaagggaaaagaacaacaaaagcgtccttcccgtgcggcaccggctcccacttccatttagttggacacaacttgtggagaagagtgaccaacctttccaccgaaagagcaccaccaaccacacgcacaagagccttcttcgtgtttttcttgttcctttgaagcggttgatgtgggatgtgctgaaaccctaggccttcaaccgcatacccaaccgcctgcaccaccggctttggaagctttaggactggacatttgtggttgacatgctcgctacagtcgcagatatcgcaataaacatccaccttacaatcagcaacaccatgtcccttttgagtgcacctagagcaaactttcacccgtgcaccacccttttgatcatcccctttcttgtcgctaatcacccgcggctccttatcgaattccaacaaatcatcttcatcatcatcaaactcagaaacataattctttcctttcttgacttctgaatttaccgagacaaccacatcttctaccttgatctgacccggtttcttgcttcctcctccaccttttggctcctccttcgtctgcgtcatctcaccggtccccctggtggcgccgcccttcttcattagaaatcaacttatttgaattgaaattgacatcccaagatcatattacagcccttctggaaatccaatgttccagtggaggagtgatatctgggtgagcgtcaagtataaatcttttctatttaagtcgacaatcgttgatttaatcggggaaaagggctaattattttcttgagtttttgccgggtgggctagaagaatagctatggtgcagagccaaaacaaccatcctatttaaactagcgataatgatgactcaagcttcttttcctatggagaagaaggacctgggactgggagaggcagcggatgatgtcaagggagaggataggggtggggaaatagaagtggatagtgatgccaacagtgatgatcgggtcaagcaagagaagagccgagaaggaattgatcctggatgctaatgaaaacacatcttctccgtttatataacttgtttaaaaaacatttataaaacttgcccattaaaacattatacaggctggaccattgatatttcctaatggttggcctattacgctgctttgttgcgtttcttttctagtaccttatgaatatgggtaaagtgggtattattatctctatacccaaaacttaaatggatgattcatctttactcataacctcccaaaacaatatagatatgggcaacaaatacctagttgcagccacagcagaccactttgtgatgcagcaatgttctctctatgttactattcactcaatctcgttcgagagataattgaacttgtgtgcaatacacaagtcaatgagcgttagaaatgtatttcgactagggtttaggcccatgggccaagctaagcactaggattcccggttccatggctagtggtccctgagcatcttctaggaatattgggattattctttccttcgtgaagagcgttgtctaagttttagcttgaatttcctttggcaattgtatgctcttcgaattacttgagagcttcgcgcgctttatccctcaagtgtattattgaagagttttcgatcctttgaggactcgactttaggccatcgtatttgatatgcagaaatccaatggtcttcaataaaccaccaatatggtcccttgtatccttggtggctttctttagcggatggggtaattgatggggatctctactccaacacttattacttatcagctactataaaagaggagtttcatccgttcgcctttcctacctccatagcttgcatggcatatacttctcctctcctgtaacaaaactgaataacaagtaggggtgggcagaaataaaccgtggaccgaacaccgaatcgaatcgagccgaactagtggtttctccagttttcgggagaaggctcaatttttactttgcgctgcttcggtcctcggtttagagatcagttttatcacgcatgaaccgaactcccaataaaaccgaagtagtcgtcctcagcggctggagcgcgcactatatcccgtcccgtcgtgagttctgggaaatgttgctccatttgaaggatgcataagccctcataggcccattgtgtacataatgttcttgtggggtctgagcaaacaatggcccaaccagaccactagtacgactgcacctccatgggtagagacagagcgcttggttggcttgatcggtagaaaccgacaccgtacttgtcaacgagtgatactcgcggactggatgaatagagtattaaggtacgttggagcaggggtctacgtagtacgacatcaaaacagacaaaagacaagaattatactggttcaggccccttatcaagtaataaccctagtccagtttatatgtgattgatgatgatgagaacagattacaaagagagtaactgaaacaagtgataccgatgagatcgtagtcgagggattcgacgagatctcccggcgagttggttcccgtggactctggcttcgtaaactttggtgagtgtgttggtgatgagatgcgatgccctttgcctctccctaggggtcccttttataccgtggaataccttaacccccaagtaaaacttggagatatgtaaaccgacacgatatactagagattttaccctttccgagtaggacttcggaaattcctaaacttatagatatattttccataacttgagataaattcctaaagcgtatacggaaacaacccgtatacgtgaatgtataccttatcggtatattccataagtcatatgatagagggtatgccttatccgtaaccctgacagtaccgaagttattcgatttatctgggctcattttttaaaaaaattttctgatgaaatcggttggtatttttcaaaaaacgaacatccacaaaaccgtacaaaccgaactgggaaccccgaataaagcgaacgcccacccctaatgacaagctgaaaaaaaggccagaaccactcaaccaatcttatgtatagctaatataattttcaaaaaaaaataaaaaagataggaaaataaattatatgtttacttgatctattttgttgttccataatagtgcacgggtaataattaaccagttgtttaaataaatattatcatcaacgaccttctgactgtttttaaccgaattaaaaaaaaataaatactatagcacggtggatcgttggagcgaaaggtttatattaacatcaacatggtagtacatacatagcacataaagtatttcgttggaccattagtatagctagcgttgcggtcctcctgcgaaactagcttggcgaagacactagcgacagtgccaccccgtgccaaggcccaatggtcgacacatatagtatggtctacgactctactctactgcaggccaacgaagtgtttagttgtttacctaattttttttgacatatacggatacatatttaaagtattaaacgtagactaataacaaaacaaaagcaaaattggttatatagcatcgaaagttcacgtttttggttttatagcaccgaaagttaccggttcactttaatag

SEQ ID NO: 5113 - DNA, 441 bp, Oryza sativa
cgcttgtttctgagaaaaaaaaacttcaacagtataatttcagtttttttttccgcatttgccgtgatctgaggctctctcagctgtcaaaaacaccctgatcggtcagatctcaagcgcacgatatgatgcctgactcgtccgtcatgcgcgacgcggcgcgatgtgcccgctcgctcgtggtgcacataatgcaaaccgcgcgcgcgcgcgcgcccgcgcccgttcacgcgcacgtacctacctaccggctcacgcagcgcaccgggacgcgcgtgttttgactgcttgacgcgctcgcgcgcagtcgcacacgtacatccggcttgtgtgtggatttgcctgattggctccgtcgccgacggttgtcccgcttgccgtgcggagaggagacacggggtccgtcatccgactaattatttgatggtttcctccagcgca

SEQ ID NO: 5114 - DNA, 2611 bp, Oryza sativa
tgtgtttccaaggagtattctagggattctcttttgagacaagttcttcgtaatatgggaattcgatatgagcaagatgaatcagttccagagctccaaagaaagattaaatcacacattgcaaataaaagtttttttctggtgtcggatgatgtgtggaactctgaagcatggacagatttactaagcactccacttcatgcagccgccacaggagtaattctaataactactcgagatgacactattgctagagtaattggggtggaccacactcatagggttgatttgatgtcagccgatgtaggatgggagttactttggaggagcatgaacatcaaagaagagaaacaagtgaaaaatctacgggacacaggtatcgagattgtccgcaaatgtggtggcctacctcttgcaatcagggctattgccaaagtcttagcaagcctgcaagatcaaacagagaatgagtggagacagatattggggaaaaatgcctggtccatgagcaaacttcctgatgaattaaatggtgctttatatcccgggaaaccaacacttgacgagcatgtcaatacctattgatgagagatgttgtatgtactgctgtttaagctatagaacctattgatgttatacagatctgagtgcattttttttctttgataatgtcaggtgtgagctcatgaataattttgataactactcggcaagatattgtcgctagggaaataggggttgaggaagcacatcgtgttgacctaatgtcaccagctgttggttgggagctactttggaagagcatgaacattcaggacgagaaagaagtgcaaaatctgcgagacatagggattgagattgttcagaaatgtggtgggctacctcttgcaatcaaggttactgctcgagtattggcaagcaaagataaaacagagaacaaatggaaaaggattttagctaaaaacgtttggtccatggctaaactccctaaggaaataagtggtgcactatatctaagttatgatgatttaccactgcatttgaagcaatgttttctttattgtattgtatttcctgaagactggaccttgaaacgtgatgagcttatcatgatgtgggttgctgaaggctttgtagaagtgcacaaagatcaattactagaagatacagcagaagaatactactatgaactaataattaggaatctcctgcaaccagtttacacatattttgatcagagcagatgcaaaatgcatgatctcttaaggcaacttgcttgttatctatcaagggaagaatgtcatattggagatctaaaaccattagtagacaatactatatgtaaactacgacgcatgttagttgtcggagagaaagacacggtggtcatacctttcactggtaaggaggaaattaagttgagaacttttacaactgatcatcagctacagggagttgataacacatttttcatgagattaactcatcttcgtgttttggatctaagtgactcacttgtgcaaacaataccagattatattggaaatttaatccatttacgtatgtttgatcttgatggaaccaacatatcttgtctcccagagtccattggttcccttcaaaaccttctcatattgaacttgaagaggtgtaaatatctgcacttccttcctttggcaacaactcaactgtacaatttgaggcggcttggtcttgctgatacaccaataaaccaagtcccaaaagggataggaagattgaaatttctcaatgatttagaaggatttcctatcggtggtggaagtgacaatacaaaaatgcaagatggctggaatttggaagagttggctcatctttcacagttgaggtgtcttgatatgataaaattggagagagctactccttgcagcagtagagacccatttctactaacagagaaaaagcatctcaaagttctgaatctacactgcactgaacagacagatgaagcatattcagaggaaggcattagcaatgttgagaagatctttgagaagctagcacctccacacaacttagaagatcttgttattgggaatttctttggttgtagattccccacctggcttggtactaaccacttgccttctgtgaaatacgttgtcctcatagattgcaaatcttgtgtgcatcttcccccaatcggacagctaccaaacttgaaatacctaaaaattaatggagcaagtgcaatcaccaagattggacccgaatttgttggctgctgggagggtaatctcagatccacagaggcagttgctttccccaagcttgaagcgttggtcattgaggatatgcccaactgggaggagtggtgtcagaaccctgaaccagaaatggagaaacagagtagcgatttgtgaattttggtaggatttgggtggccgccgcaagactatctcctagggttctaagttagctactcctaagacaaatagaaattgtgattcttcttatcttcttcccacagcaaaagccagcttaagtaagtttacagcagctaaaattattacagtgaatgtaaagagcaaaacgacaagctttgatagctacagcggcttctcatgacgtt

SEQ ID NO: 5115 - DNA, 1942 bp, Oryza sativa
  unsure (1)..(1942): unsure at all n locations
nnnnnnnnnnnnnnnnnnnnnnnnnnnnnnnnnnnnnnatttgcagccgaaaaacgagtgctcaccatgtgacaccattgtggccaaggaatcaactgccaaggaatacctactcctctaaaccacttcattgctcttccctgcagatgtgcaattgccagattgacccattgatcatatggtgtcccagtaatctcgtagaatttctcacattgcttcaaccagtcaatgggatcttctcctgtgaacagtggtatttccaaccgaggtcccttgattacagcttcagcataatgttgattttctccttgataaaccataccaccaggtctgctatgatctaatatgtgaaccccttgttgcccagtgcctgagctagtggctgtcccttgtgtttgaaaatttgaattgggcactcttcccccaactgttgtttgagtttgaaaaggagctgagtttaagaaaggtaccctctggtttggaaatggggcaaatggtatgaatggtggaggttttgataatacagtagtcacctgccccaaatctgtctgaacactactgactcccccctgtggtctagcttcttgacccataggtgcagataggctcatagtatttggctcaatagagaactgaactcccaaactaggcgtggttacctgcacagatcgactgggtcctgcttctcccgtgctcttctcttttgctgcagcatctcccacaggattctcctgtccctcgttccccttctgtttgcacaactccagcagaaggcccttgatctccttcacctctgacctcaagcccttaagctctactacttccttcttcagagatgccacatctgagcgaaactcgttcatctcctccagtcccacaatctcatcgtttgagcgcatcttggtcaccatttcgcccctgcaggttaggttcagaattcaagattcctcccctattacccctgcagtcggatctacagccgccaacctcaaatcagaagcgccggagattttacaggtgcacaccacgaaagtggcaacccaacccttgctgtccgatctgaagcaccactcgcctccggattgaatccctcctagctcaggaattttacggtggatctcgccgccgccttccaccaaccttcaccagagagatccaagagccaaggattcgctcgtgctctgatacctctgtcagaaccctgaaccagaaatggagaaacagagtagcgatttgtgaattttggtaggatttgggtggccgccgcaagactatctcctagggttctaagttagctactcctaagacaaatagaaattgtgattcttcttatcttcttcccacagcaaaagccagcttaagtaagtttacagcagctaaaattattacagtgaatgtaaagagcaaaacgacaagctttgatagctacagcggcttctcatgacgttaacaccgtcggatccctctctcgaacacgtggctttgtctcatctcttagatcttcattacccaggatgaaacgttttctccctcctttgcatcttcagttaaccgaaactctgaactttctaaaatttcctccattcttcttacgagtctgacattactccccccttaagcccaaccttgtcctcaaggttgaaaatttggaaacactttctgaatataagaagcatcctcccaggttgcttcagccggagttaaattgctccacagaattagccattgagtgacagcaacattgttccttggaatcattctcctttgcagcactgctactggctctgttttgatttgaccatctggtcccactgccggtaaatttggcattggtacagcatgagtacccaggtgctttttaagttggctcacatggaagaccggatgtatagcagcttcttcaggtaactgcaatctataagctacagcacctaccttctct

SEQ ID NO: 5116 - DNA, 2970 bp, Oryza sativa
  unsure (1)..(2970): unsure at all n locations
ttataagatgcacaagttgcttgaagacggtggaggacctcccattcctctctggtttccttcaagttgaaggatgtgaaggcctggagaggatctccaaccttccccaagtgagagagctgtttgtaaatgaatgcctgaatttgaggcatgtcgaggagttgggtggtttggagtggctattgctggaaaaaggtatgcaggagatctctcagctgtggatccctgggcttccggagcaacaccgccagctccatggagatgagcatgagctggaggtcaacgagtggctctgagaggtcaatgatttgtgtgtttcttcttcttcttcttcttcttgtaggtgtgtaggtaactccgcctatgtcacttgaggtgtttaatgacatagccggtcccaagcccggaaaaggaggaggggataatcttgtatatatacttgtctagtgaaacgatgctgtgctgctaggtggatcattgaaaattttcttgaaatttgctgcattcttgtctattcaattattagaggcacatccactctgctgctcgcctgctctattggacaaatttgattctaaactattttagctcaacctcattacaatccagttttcaagtaaaagcaattgaacacatgcaccaattcattctcctcccagtcccctgtttgggagcacgcacaagccacaggatgggcgactgtcgggctgacaaagccgactttggtcgacaagaagatatcgggtagcgagcaggtggctggcgagcaagtggtgacggtagcggatggtgatatggttttgtcggcgcagcctgaaaaggagatgaccgcggcaatgcttcttaagtcttcgggacacgctggttcgcactatccagtgaccggcagcaatgaagcagtggctgtcgggcttgcgccgaacatgacaccaatacgccgcagtgatcgttccaactccgagacagccctcggcatcgcttcggccgatgatgactctctgttgaaagcgatgaagaggaaagcagccatcaatctggatgatcaatttgccccttatggggcaaggccggccttgttggcttcccctcaaggtacacctaatgagccttttacaagttcttgttccgcttctcaacttagtttttgttcgtctttaaaccgtattgaggtctctttgggaaataattcttctgaggttgatttttctattaaagcccttaagcacatcaatgttgacaaattgaaagtaatccctaaagcaaactcttcattttccctaaaccaatgccgccatggatgagcttggagttaaggggtggcagggatggcaaaggctgtgagagggaagggaagagcaaattgagtggcgggagatcatgttcagatatttaccgacgacggttgggtttaactgggggtgaagacgagcggcggtgagctggcgtcctcccgggctcgacgcgcggcggcggcaaggggtaaaatatccggctcggcggcgttcggttcgagttgagagagggaaagttagttacaccttttgtgtttaaatgagcggcggcgaatttggagggtttcatccccggtagaggcgaagtcagcttcgacgtcgacatcgggtgggcgcgcatggcggcagacggcggcgagctgtggcggtggccgtcccggatttgtcttgacaagatttgtgcgacgacggttggttgaggcgcactggacagatnnnnnnnnnnnnnnnnnnnnnnnnnnnnnnnnnnnnncgggcggtcgtggagcctacgcgcggcggctgcggcggcacgacgcgcagggcaccaaggcagcatggcagggggtggaaaggcaaagagaggccacagttttggatgggtgtggtcccccaaggatcaattctagactttgcaaatatttgggtggatgctgggctgctagggccgggctaggcatttcatcgagcagctcatgtgcaatgaacagtgaaattcagaaatttgacaaatttgcctaaggagaaaagaatttctctaggggtttttgaagggtttttgctagggttttgtaatataactaagtctaacaaatataagggtaatttaaagaaggtttctagattttaaattttgaaagaaatttgctaaactcactagagtttagggtaggggagtaattagaatatttttgggtacgatggtatagggtaggtttaaaggaattttaaaggggtaatacttgaaccaaaaatgaagattaaaaaggaaattttaaaaaggattttgattttgctaaattaagattaattcaagtcaaaagccagcatgatgcagtcaaattttagattaaaatttgaggatgttacattggagcaggcagcgcggttcacggaccccaccgaggtgaccgcgcccgctgccgtggggcagcacgggggtgccatttagaagctctggggcaatgccgacgaggtcgtgctcctcgccggcgccgccaccttccgcgcgcgctcgtccatgtcccacgcctcccgacatgggcgcgctcttcgactccatcaggggctccctctccctgcacattgaccaagccaaggtgtactacaagctgaagtggctcaagggcaagtacctgcacgcggcgcccggtgtgttcgtgggaccgcacgaacgctgcgtgcacaacctctgcacgagcgtgtggggcgtcgacctcgagccccttgttggcgacgatgaaggggccgccgccgtgtagcgcccgttccgtcgtggcgcctagcgggaaaattatctcttaaaaaccctaattgcgaaatatgtttctttgcttgttgtctagtgtccgtgccatctcaagatctcaaatccacccgtcgatctatcggatccccgagtccaattccgaatccaaatccttccaaatcaaatccctccgcaaaagtctattttgcctcccccagggtcgatgggccg

SEQ ID NO: 5117 - DNA, 1905 bp, Oryza sativa
tcccccccctccccccaccgctccgcccgcgcaccgcgcgcgcgtgcgcgagagccgcaccgagcgctccctcccccctccgctctgcccgcgcgcgtgcgcgtgagccgcccgcgccgagccgagtcctccctctccgctccctcgctgccacttcccgcgccgccgtgttcgcgtgcgcgcgcccgcgcggtcgccgcccttgccgcgcctgcgccgtctgtgccgcctggcccccactgccctaccgcgcagccgcccggccccgctagccagcgcgcgtgcccgagccgcgcctctcaaaccgccgcgccgcccgttgcttcccgcgcgcgcgtgtcgtggtggccgaccgcccggtcgccgccgccgtcaccctctgccgcgccagcccgcgcctgtcgcccgtgtcgtcgcgccgctccaaaccgtcccgccgtcatcgccgtcgtcatcgcctcggccccgcctccgcgcgcaagccaccaagggacggaggcagagcccctcctccctctgccgcgacgcccccgctcccctcctccttttccaaaagcggcaaggaggcaagcccctttttctctccctcttttcccctttttccgtcaccgctggcgtcatcctcctccctccgccctgtcgccgatttggacgcgagcgccgagcgccagctcgcgccttgaccgcccaaagtcggtttccaaaccgacattgccgcccttaaagccccgggcgccctccctctcttctccttccatcgcctccgcgccattgccgccgcccccgtgctctgttcgccatcgccgttcgtcgttgcgcgtgtcggaggagccggcacgagcaaggacgcggaaggggactccgggcgcgccctcttcttcctcttccccggcccgaggccggagagattactcccgcgccgtcggcctctcgtcacagcgcccctcctcatcgcggtagtgctccctccgttcttcctcctcgctccacctctccctcttagttttcggtagtagcacgagtagcctccccgtagctagccggcgccgccccggccgttgccgcctctcgccgggtgctcgccgccgtcgccgcccgagctcggaagcgccgctcgtcgccggcctcgctcggcgtagctccgcccaattcgacgctagcatcggattcccgtggccgcgtagatgctctcgccgccgggaatcggcccctcgtgacctcgtcgccgtttccccctttttccgccgccggatgccgccgccgcaattcgccgccgtcgggcatcctccggcgaatccgagccgttggctcgtctccccttgtcctgttcaaccatccggtgtgctcgctttcgcctgtatcgccgtggttcgctccgccgctcgccgctgtcgtccgccgtccgttccggccggcgtcgtcgtctacctcccgccggctcgcgtggcagccacgtaggcgccagctcagccaagaccgggtcgagccgaccccggtcagcccctcctcgtgcgcgcgttccaccgcgagccgtgaggctgcgcgtgggcccgccgcatccgcatccaccgtgaaccgcgcgcgtgcaccgcgtccctcccccaccctagcgccgcgccgcgtgctccctccgcacggtgagccgagccgctgacaagcgggtcccacccgggaccgggcgtggtgagcccggtccaccggctctctctctcctccctcccgcgcgcgcgcgtcttgggccgctctgggccgccttcttgggccggccggcccgttaagcccggccgagccgccctttctctcgggccacgccctagccgcccgagggaagtctattttccatccctcttttcttttcttttcttttctttttcaaaaaggatttaattaaatccttttccttta

SEQ ID NO: 5118 - DNA, 1605 bp, Oryza sativa
  unsure (1)..(1605): unsure at all n locations
aggtggaatggaacacccctggctgagtactagctttatcagggaagccttgatgccgagagacatgtggattcgccggggtggtgtcggggaggaccccttgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttatcaaactattcgaacagccgtgcccacggtcatgggcggatgtgaggtgattcctagcgtagttttgtttgactactgcttgtgaaattgctgttgtgaaaaaggggttcgatgtttgaaaaatctgtagctgaagggatcagctaggcccgggtggccgtttggaaaagttgttggcccgggtggccgtttgaaaagttgttggcccgagtggccgttgaaaagctgtcggccgggtgccaaccttgtttcaattctaaagactgatacatcgcacatactccgaccggacgagacgcactgtcttatccgtgtagtttgagaagcactcacttagtcgttcttagaaaagagttcaaataaaatcaattgcaaaaacaacagcctctccttgaagcctgcattaaacacctattttcccttggcttgctgagtactcccgtactcacccttgctctatataaataattccccccccagttgctgaagaagatgaagcggatcctgctgatgagaagttctttcaggagcaagccggctacaatgagttttagggtttcggcctagttcccaagtcgcgcctgtgttgtttggtccaagtcctgcttccgggatcctctagagtcgaccttcagtaatgcagttgtgagctcggggtctgtccgtagtccaacatgaccgtatctctactctataataaagagaccgctgttgctgtgatattctgtctccttgtgataccagcactgtttcctgggactggtatcgatcaacaggttaatttggagcgtcacgggctagttccagtcggtactagttcggggcgtgacacgccgcctccgccgaccaaccgcgcattgtcccagacgccgccgccatgctgcatgtgctgcatgccgcctctcagctccatcgccgcccctctgcgccgctcgctgccgctcgccattctcaagggagagagggagggagggatagagagaagaaggagagagaggatagagagaaaggggatagagagaaggggtagtgaggatgataggtggggtccacgtgggccccaccatttttttttattattgtgtgtgtgaaactgacatgtgggtcccataggttttattaatttttggatcgaattgccacgtaagcgcaacgtcaatgccacgtcagatgaagaccgagtcaaattagccacgtaggcgccacctcagccaaaaccgaggtcaaatactnnnnnnnnnnnnnnnnnnnnnnnnnnnnnnnnnnnnnnnnnnnnnnnnnnnnnnnnnnnnnnnnnnn

SEQ ID NO: 5119 - DNA, 1519 bp, Oryza sativa
tagacaatgaatggtgagcaattgatcttggtgaagctgaaccagataagttgacagcgttactgttagtggtgatcagcccagccatccgtaaatcctttcttgcattttgcccaatacaagtcagcaagtcaagatgttcttatcgtttcagactaagtggacactggaatctgttcttttcacatccacactgggacacatacagaaaagctaaatggacataccacctaacagcaatatctcttgtcttccactctttgtcactgcataagagccagcccatctggatgatccacgcaatcaccggggaacttgctcgtcatcttcctcgcaataggcgatcgatttgccggcttgccatggctgcacgcaccaaaggcctcgctctggggtgagtctttctttcaattcctcgcaacatagcatgtgcttgcttggttgttgggtctgatggaaatgtcgtcttgcgatgcagcagacgcgccccatgccgctgctgttcccattgatctaggatcactccggtctttcctttcatgctgagcaagttcgccttctgtacttgagtaaaacccctcaactttgttgccagatatttctttctggttgcccgtttacccaagaagctatagaaaaaggtaacctcattatttcattttttcagattcagtgatccagtatggtcttgtggcaaaacacatgcaaaataacatactagctagatatgtgctcctctcttacaaatatactctactttatgagtcaggctgtgtttagttcagtgcaaagtttggattttggttgaaattggagatgatgtgactgaaaagttgtgtgtgtatgacatgttgatgtgatgaaaaaggactgaagtttggatccaaactttggatctaaacacagcctcagtcagacagtaagacaaataattcagttcggtctctagctatgatggtccgtgcatgtcatcgaatgcatttatgcacactcataaagtttgagttgtcagtgttcatactccagtaactgaaaaacatcacagggcaagctataagtcattgcctacaagtacctactagtagtactggtagtaactgaaagctgtgcagctagccttcactggcaagctccaagcagcaacaatcccatatcgaattaagtggaaactcttatacaaagaatagatggataatatatttactgaacttcatcttgcattcatattttgtcagccttatctaacttttaaactatgttaacacaagtttggttacatgtcaggctgcattttttacattgatcaattatatatggtggattaccccttttgagtttgtcggatggcaacaatagtagacacattggttggatcatgcatcaataagttgcaagcgatcattacagacaagacaatactcattttaggggtaaaagatgagcttgaagaactgcgacgaagaacaaacgtcataagatcttctcttcaggatgctgaggcaaggaggatggaagattc

SEQ ID NO: 5120 - DNA, 690 bp, Oryza sativa
tggtggataataacatgtgtaaattgcgccgcattttagctatcaccgagaaagatatggtagtcatacctagcatgggtaaggaggagattaagttgagaacttttagaacccaaccaaatccactgggaattgagaaaacatttttcatgagattcacgtatcttcgtgttttggacttgactgacttacttgtggaagaaataccagattgtgttggatatttaattcatctacgtttacttgatcttagtggaaccaacatatcctgtcttccaaaatctattggtgctctaaaaaacctccagatgttacacttacagcggtgtgaatctttgtacagtttgcccagcatgatcactcggttatgcaatttaaggcggcttggtcttgatgattcaccaataaatcaggttccaagagggataggaagacttgaattcctcaatgatttagaaggatttcctgttggaggtggaagtgacaatactaaaatgcaagacggatggaacttgcaggagttagctcatctttcacagttacgccggcttgacttgaacaaattggaaagagcaactcctaggagcagtacagatgcattgttgctaactgacaaaaagcatcttaaaagtctacatctatgctgcactgaaccgactgatgaagcatgctcagaggaaggcattagca

SEQ ID NO: 5121 - DNA, 621 bp, Oryza sativa
  unsure (1)..(621): unsure at all n locations
ggcgtcgacggccgccgcgatcggctggccgcttcccgcgcacgccacgtcggtgcatcccggctggtgcgcggcccgcgcggcgtaccgggcgacgccctgcagcggcgttgtgtacctgcacggcttcccggcgtagttcccgatcatcgccaccgttgcctcggcgtgcgggcccacgacggcgacggcgcggcgcgccgtcgccggcgacagcggcagcgcccgcccgtcgttcttgaggaggacgatcccctgccgcgccgcctccaccgcgagctcctggtgcgccgccgtgcacacgtgctgcgggcccaggtgcccgaacggctgcgccgccgggtcgccgtcgaacatcccgagccgcatctgcaccgtgacggtgttcgtcaccgcggcatcaatgtcgccatcgccgaccttcccctgcgcgacggcgccctcggtgtactgcgccaagaacgggccgcagtcgaggtcgagccccgcccggagcgtcgccgcgacggcgtcctccctggtccgcgtgtagtgctggtcgctgtagaacacatcaaccgannnnnnnnnnnnnnnnnnnnnnnnnnnnnnnnnnnnnnnnnnnnnnnnnnnnnnnnnnnn

SEQ ID NO: 5122 - DNA, 4373 bp, Oryza sativa
gctaccgaacgccatgatgttggccagagacgacaggccatggatcatcccgaacttcttgttcatggccgccagcgttgggttcgtcctcgccacctccgcgttcttcgaaaacccgacctcgctgccgatgccgaggtctttctcgatcttgtgccgcctcatcatcatctgtagaaagaagcctaagtcaaaactcaaaactgtatattgataggtactacaaaagagcaccctgaagtgaagcaatgttggggctacaggatgtttgttttcagcaatcatcattcgctgcaacttgtcaagagcataacagaagacgaatgttgagcactgaatgatggctcacaaggtaggagcaatccaaactcaaattcaattgaagaataaaggtatatctcttactgttctgcagtaacaccctgcaaactgccggctcacacaaatgattcaagactatgcaaccgtaagaccaaaaacatggtgtttgactacattaagccagaaacttttctatgttagaactataaaggtttacttactttcccaattcccaaagctatattgctaagctgattggaaactaagataagagcaagtgcccctgtgtcaagcacttgcatagttgcatgttatttagccggtgctagtgcgtgctacctatggaaaccactaccaggttactacatatgttcattcctgaaaataaaatgcaacaaaaagtcatttattccttaggcctcactgtcgcacttcagtcggactttttaatcaacatgaattgatccacctatactttatcgccttcaaaaaaaaatctacattacattacattacatggacatttacttatcaagcttaaatttcatgcaatgcaagtagagttaggtgaaaagcaaaaatcgtaacataaagaaagcagaaaaatggtaaaaaagatttacctcagtggtcatgggcgtgaaaaccagaaggttggaaaggtcaaaaccaagggcggagatcaagaatccaagctgatagcgctcaatggtagatgccgtcttccaaggatgtagatacgcaaaagctgccactgatatagccgagcatactgatatcaacatgaagtaggctgggaacattttcccttgtagactcccaaactggtgccttggcaaataccttaaagaatacatcaaagcaatgtcagtagccttattctgaaatattttggagtaaacaacttgcacttggtggatcaataaccaaaatagatgctgcatttctggttttaggtgatattttttctgcaaaatcacaaagcagcatgtactatgtgggtataataatacaacactgaaggcgcatttgaacaactgaacagatgacagtgctttctgaaatgcacactacgtattactctgaaacatgcagcttacacaataatccaacttgcttgcaaaaggcaccatgaacattggtgaaaccatgaaagagttctgaaaagttctccaggccaaatgccaaaatggtgagctcaagcatgacagtcacagcaggtttaaagttttaataagagaatttaacatctcaaatctctccattatccaaataaccaaatatacagtaattccaagttagaaattagtgttccatcctataggttgtaaattgggattctgtgcttacaagcatataaacacgcaatctttactaaaatgaaatcctagaaccaaaagtaaaaaactggatgaacgtttgggcaaggatactattctagggtcaaacccaaactgctaggagcctaggaacaaccaaattagcattttgagcatggccaagacagcaagactatgcaagctctccgcttaaatttgacaaaatctgatactgtttacaacatagtaacacttacgaaaaatctaacagcaacaataatcgacgtgaaaacccaaaattccactaaaatggagctgatagatagggaagcgattagagagctctttacttgaacatgacgatgccgccgatgaaggtgacccagagcgcggcgccccaggcggtggcgaagcagaggacgtgcgccagcctcgccgccgcgaccccggcgccggagcggccggagccaccgaggagagcgtccggcgcgaagagcacgccggcggcgaggaaggacactgccgtgaggaaccgcgccgcccaccccatcgtgcccccaccctaccaggctagggttcggattccgagagattgaatggaggaagaagaagaagagagcaaatctgtgtgattggaaatgaaattgaactcaacttaagcacagagtgtgaaatgaaagactagtcaatggagtactagtgcttgcttgcaaggaaagttctggaagcttatctagaacgcattaagttataatatttcctcattaattttataggaagcaatttaagttaattgattgattctcataatccacacaaattaacaacaaagaaacagagctttacttgtacagtactatttctactcaatggcaattctctgaagtctgaagttccaagagaggagtcagcgtaggagaacttgtgttacatgtgacagaaggcttgacctttttaaactccttttagaaatgatgagttgaatgaacactgtattaggcaggaatttgctcagttgaacctcatttgtttgtctgttttgtcatgaccaaacaaacctatgggctatgggctttaggctgtgtttggatccaaacttcagtccttttccatcacatcaacatgtcatacacacacaacttttcagtcacatcatctccaatttcaaccaaaatccaaactttgcgctgaactagtcacttagaaaaatttctaccagaaacctgtgggcagttgggcctagaaaaaagagcaacacacggttttggaccaaacagaagaaatcaaagattcagaactgcacaagatttggagtacgacaagtataaacagtgaacagcactagcaaaagaactgaccctgttcgcagtagaacatgaggtcagacctgcagtactttggataacattacagatcacagtacttacaatgcaggtagtccatctgccaaaatcaactgtaaaaatggagtgtattttggacaacagaagaagaacaagtaatgaatgatcttatgtatttcttcagttcaattgtttgaacctgaatacttgatcaattccaaatttccaatagcaatgtgatgcctttccaattgctctctctacctttgtagagacagtggcagtggcaccaacaataacaatccacaaatcatcatcaacacccaaaagatacaattccaaatcttgttgaataatcctatgcttttaattgatgagagtggctttctttctatacccctagctgctcgagggcgatggtgacggtgtgcgtgagctcgccgatgatgaggcggtgctcgccgacggggatccttcggaccccgttccggtcggcgacgctgagcccgtcgcacacgtcgatgcccatctccaccctcgccgtcccgccggcgcccacgtgcaccttctcgaacgccaccagctgccgcaccggcgcgccgtggcccgccgccgcctccgccgcggacgacgccggcgccgcggcgtacacgagcaccgtgtgcgcgccgtcgcgttctcccacgttcctgacgtcgacgtgcaccggcatcctcagctcctcgcaccgcgcgtgcgcgacgcgcacggcggcggcgcggctgaggcgagccgtggcgttgagcgaggcggaggcggaggcggcggcgtggtgggcggagaggcggacggtgagctgcgacggcgcgtgggcgatggagtgggtgaaggaggtgtagctgaggccatggccgaaggggtggatggtcgggccggtgtagaagcggtaggtccggccggggtagcccttggccggattggcgcgcatcgccatgttcgtcatcggcaccttctgcaggtaatcttgcgggtaccatgtcaccggcagcttccctcctgcaggaacacacaacaaaccaaattccaaattaacttgattaagatacatatttttttctcgatttctattagtatgctttttaaattgctaaacgatgtattttgtacggaattttttatgctgatgttattttaaaatattatagaaacgtttagggcttctatcttcgcaggtggtggcctaaatgatctggtttgaagctaaccctttaattatttgatattagatcattccataatattcgcgtcttttgttttaaaatatcagacatatacattttttaagtttgtaataaataaaacttaagtaatcttggttaatgactttatcattttacgtaccatcattttt

SEQ ID NO: 5123 - DNA, 13892 bp, Oryza sativa
gcggcgtagcgggcggcgacggcggggtcctcgccgggggtctcctggccgcggccccaccgcgggtcgcggaagatgttcacgttggggctccagaacgtcagccccgcctgaccgccgttgtacatcgcgcgaccctcgtcggacaccgcctgtgcgcatacgtacacgtacatgaatacagatatacgtatacagctgaagaaatacatgaattaataactctaatataaaacacacacataaatacatacatggattaataacaaaaggaatttgctagatttcagacatctaagaatttatactattttttcttgtcacctgaagtaaacattttggtatttggttagcttaaaattgcaatgtactaacatgtgccgttgtatttcattttgcctgtaattttttttttcgaattacatattacaacgcacgcacacccatccctatgaacgcacgcacataaactatttacgtaaaccctatctctacgagcattttcgaagactgggttgcattatatagttttacttaatttttgtttaagcttaaataattgtatagttctattaaaaaaatactttgttatgaatattttttttgactgaattattttgaataattaatagtagaggggatgagaatgatgagaaacctgaaaaccagatagtcctgactagtaaaaaaatactcctaaaatataaaaagaagaatctttctatggattgttcatcatgggcaggatgacaacgagtcatggttttgatcacagtggagcacgaatcacgaggcaggatcaaatatataattgactctcctgcaatcacatggccgtgtaccctatcgtgtactcaaccaagttactatgcaacactgcattcgcacgtgaattctcaaccgtgtgcttgtgctcacattcacgctcgtgatcgaattcctctgcaaatttcagaagatttttttttttaaaaaaatgtctgcaggttctctatctctttggaaacaagacatgcagagatcagatcagacacaggtccagcaacttgccctgaaggtccaatttgtgaccactgtttgggccttgaaggcctcaactactcctaatacagtactcttgtcttgctaatcttgagagagccataaatgaggcatctgaagatcttgttctgcaagtatactaccaactgcagctctacaaacaagtcaacaacctatggatcacattgtactggagcactactgatcaattgatcatagatcctagatcgacaaatggtttcactgaattgttgaactgccatacctaccaatgggtaattaggagtaaaatggccattatatgaattcaccatgacacggggagggctagcccgccgctcggctcgccgacgaaaactccattaaatttttaatattgttgaataattaaattgatgatagaatttctatagcaaatgatagttataatgaagtttgtttgagctaaaaaaaagtttttctagcttcgccactgccatgatatgaatggaattcaatatatatgtaataacaaaaaggcaaaaggccaaaaaggtttgatctaaagctaaagttaaagcttagcactgattatggtaaacaaaattcagtgcaaacaactttgccagaattttagtgatgaagagagaaggacatgctaaaatgagagaataaaggtgggcaatatgctatgactacaataacaagagcaacatatcataactctatccttatggactcttctgatgtaaatagttgctagctgcctcctacacttcaccttggccgttggttgcatcttgcatggccacctttcagaatgggcatcacctttaattaaggtgtaccaactttacacatttacacattgaaaaatattttcttaattagctaagataagatatcagaatggggctcaaaagttttagatttggctaggctggcttgcacatggctgcacccctgtatcttgcacaccattggccagcacactatataggacactaggaattccattatgtccttcctttttggacttggacacactagcaaggtgtgcatcactcttgggtcctaaagttttgtccattgatgataatgaacttctaaactaaatttaagtgcatgttattgttttgatcaaatattaggacatagtctatttctcaccaccagtttttggttatgaaaggtgcatgatgcatgcatgcttttacagggctaacaatggtaaaataacacaatgattaaggtagaatgtcacatcacagttagcctaatacatgcatgagatctagatatattcttcagtgtagagcagagcatagcatgtgcattgcttgcttgtcattttgctaagacagaccatgtacaaacacggtgccttaactcacaattagtgcctaacattatgtctagacgcaagctctaatgtcttatctacaaaaagataagtactacacacatataccatttgtgtgaagctaaattaacaaaaaaaatagctagtaaatgcatgcagagcaaatcagttcaccactagtaccaaaaacgccagtaaaatcaaacaaaccagaaacaaagtacccttgaaaggttaaaagcagtcacttgcaaaaaggccaaaagggcatatggatcattagccttttcttctttgtaatcacacatgttgtaggctccacacaaaaataataatacaactccagtgctctatccattccaccaaccatgatccagcagatgctattgctgggccagtgtcacagtgaccctctttgctcatgcagatatttaggccaactcataactgaataaaaacttgttcatgtaaaatttccacaaacttttatcttgcaaacattatgtgcttgaagtttgagaactgccatgcatacaaaaaggttttgttcactacatcttacacttgttcaccaaaaaataacattttctgttataaagattgaaaattttgtggacacgcatcattattaagcaaagtggtggcaaggatgctagtgctctatccaagtattatggaccgtgagatatgtgctttaagattcgtacccaaaatcattggcactaccaagtaaaaaactactcattctattccaaaataaaaacatttctagaatagtgataagtcaaatatttttaattttaactattaatagcaaaaaatcaaaaagatcattcatctaaaattgatgttattagatttactattaaataaactatcataatatgtaacttttcatttaaaatattttattggttaaagtagtattttaaagattgcgtggaagatttatattttagaagagagagagagagtataaaccatagaaaaaaaatagagaaggacagaacctgagacaagcgcgacgcacagtagcgagtgacacagacaaggacgccatggcgcgcacagacatgacgaagagaggcatcacatgcacgcacaacaacaaaaccgcgacaaaagcaaaagcgccgcgcacgccgcacgcgcgccgcggcgtcccgtgtccgcgccgcgcgcgcgccacggcgccggcgacggcgacaatgccggcgacacagtgttaagtgtggaacgtacctgcccgatgagctcccagagggtggcgttgaacgacgcggcggtgccgatgacctgcgggaacgcggtggcgccggggaacgcgccgccgaacctcaccccgggccccgtgtcggacacgccgtggagcgcctccgaccaccactcgtacccggcgacgcccagccgcggcacgccggcggcgttgttcaccagcagccgcaccttctcggcgcgcgtcagccgcgccaccaggtcgcgcgcccgcgcccgcgccggcagcgaccgcctgcagaacggcagcgttaccgccgggccgcccgccgtgcacgcgaacgccgaccgcgccgggacggggacgacgcccccgccgaccgccgccccggcgagcaccaggagcgggaggagcaggaggcgccgcattgtggaagtgaactcctcctctgcaactgcaaggtgtttgtggaaatggagatggcgaaggcagcgtgcttatataaacccaaccgcacaatctcaggggctctgcaagttgcaaccaacccccagaggagaggagcaagaaaatggctaatttctttctctcttttttttatactttttgtttgcaaagaaaagtatatgcttttcaattaaaaatttacagcacgttttcagtattccataaattatttggtttgcagagaaaagattaattaaaattcaatcaatgtctcgggtgccatgagtttctttcttcaattttgatcgtctgttttatttaattgttttaaaaaaaataaaaaacataagtcatgtataaactatattcatgttttataatctaataacaataaaaacactagtagtaaaaaaattttaaataaaacggatgatcaaagttggcacggaaaatttatggctgcatttattttgggatggaagaagtagtaaattgcagtcactgctgctggctagtcctagagaaaacttaaaaaaaaatcggtggctgccagtttgtgtgctgcgtgctggtggtgttttcattctcttgtgcatgtgagcatgtaactgtgtgtttgtacaatgagagaagtaataaatcattttttccctttctttttagtaatggtgtttgtactgaatgaaagttggtggtgatggatatttgtgatttgtgcttcaaaagtcagataaagaagtaaagcggtttcaaggacagggcacggctactttggagcaggtattgacgtactaggctctgtactgtactggtgtaaagactgcttttagaatttacaaaggtaattactgctatgattaacatctgaacatatccattagctttaactcccaaaacaagtaccttcaaatctagtagagatgaaaatagaggaactttcccatatgaaaagcacctaacaactttccctatctcctttcttcctctatcccttttaacctgaattttttttgttggtttatcttggaccgtccaatcaaagagtctatgattttattctagaatagaaacaatgttgaaacagaagatttagttcattaccacactagacaacaaacaagaatctataagttccaattaaggcctataaatatctctcagtgatcaccatgtcatcttgatcttttatttgtaaatgagagcatgcttttaatcataatctgctttttagcctctgtttggttctgttttggatttatgagagcaaaagagagagggcctgcttgcctttagcatcacatttgtgtaaagatgcattcatgccttggaaggaccaccttgcagaatggaaggatatttctccacacatatgtcatcagactaatctgttcacagtactcatgcaacaactcttccataaaaacaacgtggcctcattagcacaaagctacatgtttcataagcagaagcacaagctcaaatcctacatcaatcaaagaatgcgtttcaaacaagcccaaaatgttactgaaagcatcttaacgatgtactttgccaagtttcatttcacacaatatatattgactcttgcactcaccgttaatcttgttgagcagttggtaatccaatcttttttatggtcagttttagtgagcaaccaacttggaacggcgtactacgtatttcgccggcaagcagttgttcagtacttcaacgtacagatcaaaatgtcatgatttcacctaacacctttatacaaaccacagtccagtgaattacaaatgtttttaaatgcaatttcatcaggttgtacaaaatgttgaagaagttcattctgtcattaattaatatatttaatggcggcgcctatcatgcacctgatttgatcgccagcaagaagaggattagaactgagaataacttcgcttgaagaaatcggactagtaggttgatttaacaagctttgctggaagaactaatgacgtgtcagaattacttaccgtttagaccaatgcaaaggatacgaaaagcttcatcaaaatggtttccttgtacggaggtattgtttggcaactttgctgacatggattgataaatgagagcgaaatgagtgtgtcactgtcaaatcggattagatgagtagttcagctgcaaaggttaaaagcaagaggataaatacgatttcagaattcagatagcaccaaaaagagtaaccaaagtttgagtgttaatagatcatctgtgcacaaaacttgacgtctcttgcaggtctgcttgtgcttatcccttttcactctgtttaaagcttcttttctttttgtgaattcttgaatgttgatgaatgaaaggtcgagcaaacacttattcttattcgcaactaaatgcttccaaagaagaagcatcactctattttccctaatccctagtgatttctccactacactgtgcaacctatttctgatggcaaaagtactactatatattctaatgacaggcagaaagacaacatgcttattagtccttattcttttccttttcactttcatgatgtgtgaccaattgatggtgaactgttagtggctttcaaaagcatagcatgttatacatcactctgacacaactaggagaagggagaaagtgtgatgtccagatgctaatgggacatgtaccatttcacttcaagtattggctcctgtaaatggtcccttctactatccattatcccttatgccaatgccactatggcaccaccatccactagtaaggacagaagttagctccaagagttagtggtacaatgtatttatggagtagtgttgtgatgtcaaagcaagaaaactaccagggtacccacttcagtaagtatatctgtatatgatcttcctcctgaaaatgctgagcaactatttgtctgcaacagtagaaaagctaggtaattagactcactgtgaatagatatttttatgggtttagtcatgtaaattctgcatatgtagctccccaaatctctgcagaaaatatggagatgattccacatttccacttcccaaggcttttagtggcgttgttgcctcatgtgcatccacaattctgcatcacttctgttcatggacatacgcacaaaggtcaacttgcaagcatgcatcacccaactggaaccgaactggatggcttcagctcatggaattcagcagctgttgatgtaggggttggtgctgaggcagtgaggctatgctgcagaacatgtggtactgactgcatgtaggacaggatactgcatatactcatacagttgaagaagtaatgggagcaggaatgagtgaatggatggatgataggagtaccagactgcagtgtatctgttgggcaaattgagagtcatgggctctattgagtctctctgattggatgcagcacatcttgactgaattttgcatcagcaatgattgtgtgcaaggctctttctcccccaccagatgctgcgaaatgcatgtatatcttcaggaacagaaaagaaaatctttccctccattatccacccttgttttttttattgaattcatcattctacaattaaacactgaacagaacagcttgtgagtcatcaggattggttcaagacagatgtaatgaccagtgccttagctttcctcattgctgtcccattaaattcttcaaatcacccgtgatcttgatgccttcatatgctctgcaggggatgttaaccagtgctcttcttcgatacttgaaccttcctaatttttcacgaggctttttacagtctttgagtgaaggaggcaccatatcctagccgtccattccactcaatctaatggcctaggatctcccgcaaaagcaggtaccgaatgttgttgatggtgggagggcaattttgtactttcgcttgcaggaatcaagttggagcggagcaccatctgtccgatgcagtcgtctactcatcgactcctcaaatcgaacagaaaccgtataggcgaacacgggcacacggcgacgagcctgagacaaccgatgcggtggtcttccgggcggcagtgacctcgggggaggtgggccgatagggaacaccggcgacttcgtggttccctcccgtcagtgctcccgcttcctccctcctcccggttcgatcctgacggcgccgcattctagtccctcctacccattccaccagagcgaggacgggcatcgcaattcgcaagggcgccggcagctgcaaggtcaaatcgcgccagggcgattggctgctacgggctacggcgaggccaccaggaaacttgaagcagacaaagcttttcactcgagaagctcatctagagaagccaatataaatccacgaatttcagaggcctcgtgccaaggagttagaagtcctgcaaaccaggcatttgtttgcaagccaattgcatcattatgcgctgaaccacaactaattacagaaaggtttacaaaagagccttttcaagaacaatactccaactaaaaaggaacaaggagcttgaagaacagtcatcatcagaaagttctgaatacatgtctgacataaattcctaacaaatcctatattccacaaacaagatctaaataaccactgcgtaccacaccaaagaaggttcagagttccacacttccacttcatttgagtttcagaaggttcagagttccaggaactgaacttggcacttccacaatactgaacactcatacttcatgcgagctttgaagcacggcatatatactagcacaagacaaaccactatgcatgctatggacacgacatgactgtcaaagtgtggagctctggtgctgtgtggagttgggcagggcacgatgatcaagagcaaggggggagatagccgacagatgaaggcaacggcgccctgtggctgcagcagaaaggacaaagaatcggagacggccatgggagggagcaggggcaccctgccgcggggaggatagagacgctagcagaagaagcggggaggctggctttatgaagcagcgacgtcgtggatcgatggtcggcggcgagatagatgggtggaggcggcgctatagatgggtggccaacggcatcctggaggaaaggagaggccgcgccatctagggacgtgcgccggtgccaaagcaagtgaaaacaaaggatgcggagcggaggggaagaggacgaagaagaagacggagaagagacgataccacacgcgcagacgtgctattccgatcgtatcctttgtgaacggacggatggattgagttggtacctcctcaaagataggaaaaatactcatttttcacactgtattatgttatactagcaatgccttccctgattcatagctcgagttgttgtctcaagggatgaaactggttcggatagtttccgtccgtccggaccatttttcgaattcggatagtttcggtcggaactatccggaaattctcggattcggaaacgaattcggattttttttctcagaaacgaaaacgaatacagtaagggtactatccgttggaatcggaaataagtcggaaactatccggaatttttttcagatatccgcagacattgagtaaattttagaaaaaaacacgtatatatgcataactttttcatacgaaatcatatgaagacaaactttatatcaacattgtaaagctcggtgagatctacaactttcttattgactattttattatttgaggtcatttaagggtctaaatattcattataatataccatattaatttttacaaaatctcatatctaccatccaaacgacatctgatggagatgtgttacatatcaaagttgtagagctcaactggatctaccactttgtagtttataacatttgtatttgaaagcatttaaagcataaaataaatattgcaagtttcgaagatgcgaagtaaaataaacaacatctccaatttatacaatggcaagtaagttatacatctagtagaaggtcttgagaatagaaactgataatcatatttgcatatgaatctcttagaggaacaaccataaaaatcgattttcacatacggttgtgagaccgtctataaaattgacgatataaatattggagatgttgaactaaaataataagtgatatctcttcctcgatcaagaaactcaatttgaggggccttttatataccggtaaatattcactaccgtattcgttccgtctcgtattcgctccgtatttgtattcgataatatttgatttcatttccgtatccgacttttcgattccgattccaattccgaaaaaaatttatgaaaacaaatatgataaagctaatttccgtccgttttcgatttattttcatcctctcatggacaattaaattggaatcgagcttagtgttcattcctgtactcttcacttattcagtatttcagttcagtgttcttagtttcatctcaaccatttcgattttcgggtacaaattattcttcccatgcatgaatgacgcacaaaacaatcaacggtgtttggcgaatttcatctaaccggagcgacgagaagggaaatggagcgctcgaccttgccctccgcgctccgccaccggtcttcagcgccatcgccgaggtgggggctcgctcgatggccggaccaggtgctccgtgctcgaggatttacctcactggctgactgactcatcggagcgctcgccatcaacctcgccgccagcgccaccgtcgccactcgccggagcgccgccgccgtcggcgacccacgcgcccttttcaacgataatacgagatagtttgagggcttactcgaaaataatcatcagatgcttacgtggctttaatctcagccggctgtgttagatcaaacgggtgtaaagatgcacatgtaccttttttggattcaaaaatggaaattctgatagctaaaggactcgttcaaaaaatcacctccaacaactggccaacgttaatatcgaccgctagtgttcgatcggacggtcagcagagatagaggcccatcgacaaggcccacaatctcgtcgtgaatatggggccgcacgttgcctccggcctatgttggctagaactcgccgcagtacagcctaggcccattaattgaggcccaaatcatccctcacggcccatacattatgggccacaatttgctcctggcatgtggtggcccacaaattaatcccaacagcttgatgggcccatacaatatgggcctcacgccggcagcagctcaccggcgcatcccgaccagccatgggccatggcgctccactccggcgacgacttggatcccgtcgtttcttcgactcttcggcgagcttccggtctttcagtttcatatttcagatcagacaagttgagcgggtacggaattcaaatttgcagagggatatcaactagaagcaggaatcctcgatagataaaggataatgaagtttgtcaggtatatgttgtctgtttgtcagtatcattcaagattcagatcaggtagctcgacaaggtaaatctgagttcccctcaatcggctgtgaccctttcatatttatagggtgggtggacagagcttagctcttgtacaagtcgaattcatgacaaattcgttaagaacacatactctcttttcggataccaaaacaggatcatccggtttagcaggacatattaattttaactgttactctctccattttaggttataaaacgttttgactttagtaaaagtcaaactactttaaatttaactaattctataaaaaaagtaataatatttacaacactaacatagattcattaaatctataattgaataaatttcataatatatttgtctcgggttaaaaatactaatactttcttttctataaaattagttaaactaggagtagtttgattttaaccaaagttaaaacgtcatgtaacctaaaatggagggagtaactccttgtagtgacaatcaatacttatgttaatggttggcatgggcaacgattgtgtccaagactcattctccacccatcagccactgcttaggtgggatggaacccatgtatatcttgaggaagagaaaagtaaatccagctttgtttattacattgaattcatcttatccatttaaacactgaaaacaacggtctgtccgctgtcatcaggattggttcaggaaaaagctacgagagtgccctaacttttctccttgttatcccattacattgtttaatgagagaatatattctatctccctaagtttactccaattcaaggatttgccatcgattgtcttcctctataatatgtcatcaactttgtcaactttttctacaatatgctattgaggtggatactttttcaaataaaaaaaaaactaaaatgtcactcaagacatggctgtttggttgccgccgtagtttgcctcagtagctgtggctcaccatgcttggcttgccacagttgcctaagctttttgtgtctgaatgtgcttgccacaacaacagcgccgcagatgaggcgatgattttcagcgccacaggtgtggcgtgtttttgtactgggagcagtagtggcagccacagctttcacgggaaccaaacaccagccgcactctcgatctggcgtggcgcatgttggcaggaaccaaacaccggccaagctctccatggctgccgcaggtgtggcgtgccgcgcggaggcgggcaaccaaacaaccaaaccgtcggtgtgccatctgcgcccacggtaaagatgttattttccaggccaggattgtcgatcacaaccaaagcgagtttttgttcagacttcatactctttggcatatagaaactactggaatctgaaagcccaaaagctttcgtcattgcagagaggccacagtgaggggtgaagaaagcatgacgtttcttcttcgtgtgaagggagtgtctatgatcattgttcgtctctactactagcatataaagtagtatgcacctctttggctctttcttttttcttttttaatcaaagtgcgctcctgctttaacatcatggaatataatctttatacttaaactaattataatcacatcactaggcgctagctaatcatttgatttacttggaaattttggtgcatcaccattaacgagtttctctatggcaaccatactagattctttaattggatcatgcgtaaacaagttgcaacggctcattactgaggaggcaatacaaattttacatgtaaaagaagaatttattaacaaaacaaattacatattctgccaggaaactgtgagacgaatttattaagcctaattaatccgtcattaacgaatgtttaatttattgtagcaccacattgtcaaatcatggcgcaattaggcttaaaagattcgtctcgcaatttcctggtgaactgtgtaattattttttttgttttttttgtctatatttaatactccatgcatgtgtctagacattcaatgttacagcgtgaaaaattttgtttgggaactaaacagcccctaaacagggcctcataagagcaggtacaatagcaggctataagccagctgcaaacatattttaagaagataaataaggagagagaaaaagcagcgggctacagatttgtagccagatgtagcacggactccaagacgcggtgtgtgtacgacaggtgggaccatatattaatagtgtagtatgcaactattgtatgaatgggctattagattggctatagatgaattggagctaatagttggctatactattaaacttcacaatttttgacaatttgaccctttgcaaaaactatttttacaaatgaaccgctgccaaaacttatt

SEQ ID NO: 5124 - DNA, 2478 bp, Oryza sativa
ggtcagatttaaaataagttttggcagtggttcatttgtaaaaatagtttttgcaaagggtcaaattgtcaaattttgtgattaaacttgctctaagaggacaggactatgatggtccatacatgccatcaaatgcacactcataaagtctgagttgtcagtgttcaaactgaaaaacatcacatggcaagctgtaagttattgcctacttcctactagtagtactggtagtaactgaaagctccaagcagcaacaatctcatatcgatcctctagctccctcgtcagattacaggggaaacgttcttgatcatcatctccctcgtcagcggctgcacgcaccaattaaggcctcactctgaggcgagtctttcttcctcacgcaccaaccctctgcttgcccacaagctctggttccttgcggtatgagctgattgaaacatcggattgctcagtggtcgtcatcttggcgtgcactgctgccattcccatcaatccagctccattcggcctcgcctttcatgtccagctagttcaccttgtatacatgaagagaacacctcatctgtgctggttacttcgtcttttcattgcccattgaccaaagaagctatcgaaaggtaaccccattaattcttacaattcttcagcttcagtatactaaattacttgctccaaagacattgcaaaatagcttgttagctagagatcgtgctcctgcgttacataaagatgaaactgagtaaacttctgatcatcttcagaccatgttattattgttaataacttggaaattttcttgcatcacctcccatcatcactttatacgttatatgcataactctcaaagacagaagaaaaactcaagaacatatacaaatgagaatttccaagatgatttctactgtaatattgaaaattataaagtaccatccattcttttcacgccagatgactactttataaggtagacttgcatgtaaggatgtacttcaaatctcttgttcttctagctgtgatcattttattgtttttttttcaggaggagaagggagggggggggggggtccataatgttagttactacagttaaatgcgctaacacaactcctaggctagcatgtgcgaagtagttatagaataaaataagatagatatcttaatgttacgccagcttttggaatcatttctggactgcattaatttttaactctcttctggtattttttgttgaattccctaaaacagtttgctggatggcaacaatagtggatactttggttggatcatgcatcaataagttgcaagcgatcattacagacaaggcaatactcattttaggggtaaaagatgagcttaagaactgcagcgaagaacagatctcataagatattctcttcaggatgctgaggcaaggaggatgaaagattctgcagttcaaaaatggcttgaccagctaagagatgttatgtatgatgttgatgatattattgatttggctagatttaaaggaagtgtcctactacctaactatcctatgtcatcgtcaaggaaatctactgcttgcagtggcctttcactttcatcctgcttttctaatattcgtatacgtcatgaagttgctgtaaaaattagaagcctgaacaaaaagatagataacatttcaaaggatgatgtatttttaaaactcagcctcacacaacataatggaagtggttcagcatggacacctatagaaagctccagcctagttgaacctaaccttgtgggcaaggaggtcgtacatgcttgcagagaagtggtggatttggtgcttgcacacaaggcaaagaatgtttacaagcttgctattgttggaacagggggagttggcaagacaacactagctcagaaaatattcaatgataaaaaattagaagggagatttgaccatcgtgcctgggtttgtgtctccaaggagtattctatggtttcccttttggcacaagttcttagtaatatgaaaattcattatgaaaaaaatgaatcagttgggaaccttcaaagcaaactcaaagcaggcattgcagacaagagttttttccttgtgttggatgatgtatggcactataaagcatgggaagatttactaagaactccactaaatgcggcagccacaggaataattctagtaactactcgagatgaaactattgctcgtgtaattggggtggaccgcactcatagagttgatttgatgtcagccgatataggatgggagttactttggaggagcatgaacatcaaagaagagaaacaagtgaaaaatctacgggacacaggtatcgagattgtccgcaaatgtggtggcctacctcttgcaatcagggctattgccaaagtcttagcaagcctgcaagatcaaacagagaatgagtggagacagatattggggaaaaatgcctggtccatgagcaaacttcctgatgaattaaatgg

SEQ ID NO: 5125 - DNA, 679 bp, Oryza sativa
atgtatggcactataaagcatgggaagatttattaagaactccactaaatgcggcagccacaggaataattctagtaactactcgagatgaaactattgctcgtgtaattggggtggaccgcactcatagagttgatttgatgtcagccgatataggatgggagttactttggaggagcatgaacatcaaagaagagaaacaagtgaaaaatctacgggacacaggtatcgagattgtccgcaaatgtggtggcctacctcttgcaatcagggctattgccaaagtcttagcaagcctgcaagatcaaacagagaatgagtggagacagatattggggaaaaatgcctggtccatgagcaaacttcctgatgaattaaatggtgctttatatctgagttatgaagtgctgccgcaccagctgaagcaatgttttctttattgtgcacttttccctgaagatgcaaccattttctgtggtgatcttactaggatgtgggtggctgaaggctttatagatgagcaagaaggccaattattagaagacacagcagagaggtattatcatgagttgatccatcggaacttgctccaaccagatggtttatattttgaccacagcaggtgcaagatgcatgatctcttaagtcaacttgcttcttatttgtcaagagaagaatg

SEQ ID NO: 5126 - DNA, 7484 bp, Oryza sativa
agggggaggaagccccgtctccaactccaaggtcgtcgtggctgctgccttgtttgacgaagttggatctcgtgggctgccccaagctgagggctctcccaccacagcttggacagcaggccaccaacttgaagaaactctttataagagacacaagatacttgaagacggtggaggacctcccgttcctctctggtggccttcaagttgaaggatgtgaaggactggagagggtctccaaccttccccaagtgagagagctgtttgtaaatgaatgcccgaatttgaggcatgtcgaggagttgggtggtttggagcagctatggctggatgaaggtatgcaggagatctcttcactgtgggtcccaaggcttcaggagcaacaccgccagctccatggagatgagcatgagctggaggtcaccgagtggctctgagacccaattaatttagatggtgcaaggtatgtacactaattgcttgggatttttcactggaataaactaatcattgggttgtacattcatgctgctcctctgctcttcacttgtatatatgcagctattttagcatttgatagtctccttagttgttcatgttgtgtgcattgactgattgtttaatgatttatatgatttagttttattttcatttgtgctacatgtaaccatttcattgtggtcaagattttcataaaatggtggatatcaatcgaaggacttgaggtagttaggaagaatcattttttcacttttggtacacaaactgcataagtaaaggagacatatgggccaagaaataaatatcatttagttcagatgcagaacagtttacttgcatttagccctcaatgacccaagtgtgttttgtatcgagattatgcatgtacataggagacattgaagggagcacatattatcttgtaaaaacaagtagagacgtcaatttttcatgaaatatttcaactgtgtaatatattaggcatatacaacggtcaatttagacttgcaagcgatacaacgcccaattctacagattttcggcctgcagcctgttggcagcaggacattgaacacaaaaggggcagcgcccaacatctgctcctaggccactaaggtttgtttggaaaataaaaagctgcctaaatgcctttgtatttgttccaattgattaatattttagttatatccctaacaaataaaataagcagggtacattgccctgcctacatgcttatgtgtagttcgtatgtggctttttcttagactattttttttcttgatgtctagtaggtttaactccagaaaacatgattgttgcaaaaactgatcacacttgtattttattttccttaactaagttattgaagtaccaaattgcttatatatagcgatgcttaatttgtgtgtgcttgtttattttgtaggttgctaatctcgaagatttgggcagtgcaggcactttcttatttatttgttatctttacctagttaccgatctatggaagatttaagaaatccaaaaaaaaagaaagaaaaagaaaaatccaaaaaaaggtaaaacttagcaaaaaaaaagaaaaaaaacaggggcatttgctttacctcatgaaatgtatttcatttttttttatgatttgtgtgtgtttcttcttcttcttcttcttcttcttcttcttcttcttcttcttcttgaagctgtgtaggtaactccgcctatgtcacttgaggtgtgattttaatgacatagccggtcccaagcccggaaaaggaggaggggataatcttgtatatatacttgtctagtgaaatgatgctgtgctgctaggtggatcattgaaaattttcttgaaatttgctgcattcttgtcaagttatttgtatattcaattattagaggcacatccactctgctgctcgcctgctctattggacaaatttgattctaaactattttagctcaacctcattacaatccagttttcaagtaaaagcaattgaacacatgcaccaattcattctcctcccagtcccctgtttgagagttgagaattgagctactgagatattttcattagtgatatctactgcactgtgcaacctcattacaatcacaggcagaaagatgatatgtctattagtactccttgttctttattttttcactttcatgatgtgtgaccaactgatggtgaaccaattccttctactttcacttttcacttagtggctttcaaaagcatagcccagatgctattgggacatgttacatgtaccgtttcacttcaattcttggttcctgtaaatggtcccttctcctatgccactatggcaccatccactagtaaggacagaagttagctccaagaaaactactagtggtactatgtatttatggagcagtgttgtaatgtcaaagcaagaaaactactagggtgccacttctgtaaatcagtatatgaacttccctactgaaaatgctgaacaactatttgtctgcaacagcgaaagacgcaaggtaggtacttgggtagtgttgtcctatgtcaatgcaagttaataattttatgcttaagaccgattcccccgcgtcgctctcgtgcgggcggctcggggggcgaaaaaaccctagccgccagcgcctccacttcctctccgttgcctcgccggagtcggagcttgccggcggcaagccggcagcaagcacggaaggcggcggcgaggctctccctcttcttggcgtatcccaccccggcgcgacgtggacggggcgcagccgacgaagaccctcaccgcggccagaggtgtgacggtgggatggtgtggggagacggccgccaaggctggatctggccaccccgcgcacggatctagcacggcggcgcgcggtggctgggagcggcggcggcacggcagcccgcagctcgggcacggcagcccgtgcaacggcagcgcgacagcccagggcggccgcatgcccgcatggcggccctgcaagtcctcgcttccggggtgccgccacggtgcccttcacgaccaggtgggcggcagggcgcggtagttggacaacggaggcgtcgacgggttgcgccagagccggagtagcagtagcgtcaccgtcgtcggtgcaagcccagatggctgtgtaaagggagctggcggcggtgggtcatcttcctcgttgccggtcggcaccctcgccctttctggagctcctccccttctttgcggggagtttctaggttggattgaggcggcagctcgtaagcgggggaagctcaggctgccgaagcaatgccacctagtcctgggttctccttcggccaaaactagcgaggcggccggtgggtagtggaacggaggcgtcctaggccagctctcaggggtggtggttcgatgaagtcggccgacggaggggcgtcggtgcggtgtggtggatgctgcgtgctgccatctgtctgtgtgggggttctgagttggtggacggcgatccgcagtcaagggtgtagggtatcaagcgaaagcctagtccggtggttcaccgggctggcagcggctatgtcttcgggcgttgtaacctccttggggcgttgtcgagggttaccctctcctttgctcgacgagcttctctgagtgaaaaccacatcttttttagatgggcgatggcggtatccttggatgtcgtgagcaccgtggtggcatcgttttcaaagcctcgtctgtgtggtgttgccgtaggcctagcggcgttcggccacgcttagcgggggtcgtttggtgctaggcttcaccctagcggtttgtgcttgggtggtagcgcgtggtgtatggcaatgcaccttggtgtattttgatgttttttcttgtaacttttactccttcttaatatacccggttggcctccttcagccttcccggtgaaatttttttttttatgcttcaatactgtaaattttgcacccaaactgcagaaaacatggagatgattccacaagtccacttccgaaggttcctagtagcagtgtgttgcctcatgtcatcatgtatgaatccaccgttctgcattacttctgtccatggccataagcacaaaaaggccacttgcaagcatgcaccactcaagtggaaccaaactggatggcttcagctcatggaattcagcagttgtagatgtaggtttgaagctgaggctacactgcacaacatgtggtactgactgcatgtagaacaggatactgtatatgctcaaacagttggtgaagtaatgggagcaggaatgaatggagggatgataggagtaccagactgacagtgtatctgttaggcaaattgagtcatggactatattgagtctctctgattgtatacagcacatcttgactgaattttgcatctgtaatgattgtctgcaaggctctttctcccccaccatgctgcgaaatgcatgtatatcttcagaaacagaaaacaaaatctttccctccgttatccacctttgtttttttattgaattcatcattctacatttaaacactgaacagaacaacttgtgagtcatcagaattggttcaggacagatgtgatgaccagtgccttagctttcctcatagctgtcccactaaattcttcaaattaaccgtaattttgatgccttcatatggtctgcaggggatgttaaccagtgctcttcttcgatacttgaaccttcctaatttttcacactgtattctgttctactagcaatgccttcccttccctgattcatagctcgagttgttgtctcaaactgatttctgtacagtgtacacataattctaggtaaaattataagggccatcagagattaatagcagttgagagtagctgatggaggtgtaatatggctcttgtattgtatctgaagagcagtgtggcttgtcagaagtactctaattgcacttccagtttcacacacttatctcttatcaacgtttcacctgatggcatttgatcactacagtatgttcatagacgttcaattctgacgcttaaaagttcactccccaaatcttcaacctctcatggactattaaattagaatctagcttagtgttcattcttgtactcttcacttattcagtatttcagttcactagttcagtgctctagtttcatctcaaccatttcgattttcgggtacaaattattcttcccatgcatgagtgacgcacaaaacaatcaacggtgtttggcgtttcatctaacctgagcgacgagaagggaaaggaacggcgacgacttggggtaggttcttcgagtcttctgcaggcttagggtctttccatctcctctttcagatcgaacaagttcagcgggtaccaagtgcgaatttgcagaggcatcccaatcgatagaggatgagttcgtcagtctgttccaatttgtttgtctgtagcattcacagattcagatcagataatatcatcaaggtaccacagtacctggtgcaaacctgagaaatttgcagagggattgtaaagtccaaactggaagaaaggtttccaagaagattgagttgttaaatgttcagtttgttcttgtttgtttgtctgtagaattcaaaaattcagattatgtcctgaccttgacttaaaatatacaaatgtactaaaattcagattagttctcctttgcaatggattgggctagcactatttggggattgagaagcactctaaaaatatgctttactgaacttgacgatcccatgtcagacgcttgccgatgttctgtaagctatgctgttctgcacacaacttatttattcagatgacagaattcagttttatactcgctccgtcccattttaagtgcagttgcggatttccatgtacaacgtttgaacatccgtcttatttgaaaaatttataaaaaaaattataaaatttataaatttggtggtacatctggacagccagaacatgaggagcagcggtgccgccccatgtaaagtttgtagctctaaacttgatttgaccttttcagaacgggtatataaggttatattcagtttaaaaactagctgggtggcccgcgcaattgcacggctagcatccaaacaaaatcatatattttttagtatgtttttacttaaaatttattaaatagctatctcattgttttaagactttaaaagaccaaaccttactatcctcgtgtttctgattatatagtttttaaaagtcacaccagttgctaccctttatgtcatctccttctttatttgcttgctcgatttaccactatttttattcattcttcttggaacctttataaattggattttatagttttagagtttattgtcacgttgggtttcgtttttataatttctagatgtcccatcaaatgttgccattatactcctctatggcccgtccagtgtttcttctctttattgtcattgagattttaaaagttgaacataattatcgtttgggttcatttttactttctagaagtcctaccaaatcatcagcggctttgccattgtactcctctacggcttgtccgctgcctcccttctttattgtcattgagattttaaaatcgaacctaattatcattgggtttttttactttttggaagttccaacctttaaaaattggacttgtaattttattttttttataatttttagaagttccatcaaacgatgccactatgcctctctacagttcgtccatcgcctactctttattgtcattataattctaaaaatcgaacataactattgttggaattcattttttattttctagaagtcccgtcaatcgtcagcggttctgcaactatactcttatacaccccgcccgctgcttctcctttttattgtcattgagattttaaaaatcgaatatgattatcaatagggtttttttttactttctagaagtcccagcatctgctttacttgtttgcttcacggcctgcctagcgtccctccttttaatcgtcattagaattctattttgtgttttattaacaatttttatatgtcatatcaaccgccaccactctactcctttataggtatgttacttaatttatctcgtcatgtgttttagatggtcttttctttcaatagcctttatttttatcacaaactttagttatttataaattgtattcctaattgaaatcttatttttctttttctaatttcagaatttattttttttaaaaaattagttaataccgtattgtgttcttttaatgtttttatttttttattttcaatttcagttgtttcaaaattgtattcctacttgaactctcttttaatttttctaattttgatattattttattttttattcgaaattttaattaatttgtattgggttcttatatggattcttctttcaatattgcttatttttaattccgaatttcagctaattttaaattgtattcctacttgaactcttcttttattttatttt

SEQ ID NO: 5127 - DNA, 7867 bp, Oryza sativa
tgttagtgaacggccatcttctgaagcagcacacaagattccaataatcagtctagggacaaggatgcaatagtgacgtatacgagtctacattaattttttatatctgcagctatcgtgtgaggacaataagccattgtctcgtcacaaccagaaagtaacataagcatacttatattcttatgctagaaaagaaacaagaggatcgaggcacatagtactatagtagcagcagaaactcatcgctgctgcaagcttttttttttttttgaacaaaccggcgagctgccaatttgaatagagaaggagcatcgctgctgcaagctcaattcatggcttcatacaaggtataataagttgctccctttgtctggtattgctactttacttctcagtgttgtgtaatttttgtttccgtaagttctccaccggcttccctcaatttaccactggtctcagtgctagctttgccctgatccatccatggcgggcttaccagcagaagcaactgcaacaaaggtagcgatgctcgctgtactcaggccagcgtctccaccaccttcagtctcatggaatatgttctgctgctaattcttacactccaattgttgctttgtttctgctacctgttttatgccaaactgcagtgaacaggtgaccagctacttttttctttctcccctttgctggcacttgataatttctcacatgtaaaatgaatgaaaaatttgagttcctcgccagtccagatatagacaccagtgccctcgacaagtgaccctgatcttatcatccacacgatgccctcgccaagtcaccatgatatcatcatccaagatgaataggaactttgcacaccaaccgaataggggtagagggatcactgcactatatgaaatttacagtggttagtatcgaatatgattttatgaaataattgccttcctccgttcattttagtatgttaattagtattgttttacagttgttagtattgtttgctgttaattagttagtcttattctcaccagtcctatatacaattatgtaattgtaaaagatgcaccattctttagttgtagtcccattttaagagtagatacactacactaaacagaaaaaaaaacatacttctatgaatacctcacatgataagaatgtagtaatagtttttagtgttggttatgtacctcatactgtgcatgatttgtccctagaactttagtttaagtatgataagctaattattgtattaatataaatgtcaattcagtagttatacccatggatgtctattttatcaatacaaaagttttagtgaacattatatatttttcagatcatgctaacagatatcgtgcattccttgccaacctacaatgctgtcactttctgaaacgttaaaagtggatctcccttgctgatttttcctatggcaaccatattagattctttggttggatcatgtgccaataagttgaaagagattattactgaagaggtgatacttattctagggatacaagaagagctcgcagagttgcagcggaagactgaactcatacattgttgtattagtgatggctgtgatgctgaggcaaggaggatggaagagtcagcagttgacaattggcttggtcagctaagagaagttctatatgatattatgatgttgatgatattattgacttggctagatttaaggggagcattctactaactgatcatccttcatcgtcatcaaggaagtcaattgcttgcactggcctgtcaatttccacttgcttttctaatgttcaagcacgtcatgaggttgctgtgaagattagaagtctcaacaggaagatagaaaacatttcgaaggacagagtatttttgacactcaagagtacggttcctactggaagcagttcagtattgagagtgagaaaaagttcccacctacttgagcccaacattgttggcaaggagatcatacatgcctgcagaaaaatggtagatttagtgcttgaacataagggaagaaaactttataagcttgcaattgttgggactgggggagttggtaagacaacattagctcagaaaatatacaatgatagaaaaataaaaggaagtttcaacaaaaaggcctgggtttgtgtttccaaagtgtactctaaagcttctcttttgagagaacttcttcgaattatggaagttcatcatgatcaagatgaatcaattggagagctccagagcaagcttgaaatagcaattaaggagacaagttttttccttgtgttggatgacatgtggcaatctgacgcatggacaaatttattaagaattccgttgcatgctgcagaaatgggagcaattctcataacaactagaaataatattgttgccttagaaatcggagtggaccatacttatcgagttgatttgatgtcaaccgacgtaggatgggagctactttgcaagagcatgaatatcagtgaaagcatagaattgcaaactctgcaggatgttgggattgagattgttcgcaaatgtggttgccttcctcttgcaatcaaggttattgctagagtgttagcgagtaaagaacaaacagagaacgaatggaaaaaaatattgagcaaaaatgcttggttcatgaacaaccttccaaatgatttgagaggtgctttatatctgagttacgatgagttaccacgtcatttgaagcaatgctttctttattgtagtgtatatcctgaagatgcaaacatttaccatgatgatcttacaaggatgtggatcgctgaaggctttatagaggaccatggaggtcaactactagaagaaacagcagacgagtattactatgagctgatccaccggaaccttcttcaaccagatggtttatattatgaccacagcagctgcaaaatgcatgatcttttaaggcagcttgcttgttatttgtcaagggaagaatgttttgttggaaacccagaatcattggtaggtaacactgtgtctaaacttcgacgtgtttcagtcgtcacagataagaacatggtaatgttacctagcatggacgaggtgcaatataaagtaaggacatggaaaacttcttatgagaaaacactcagagttgataattcatttttcaagagatttccttatcttcgtgttttagatttgactgattcatttgtaccaagcatcccaggttgcatcgggaatttgatccatctacgtttgcttgatcttgatggtaccaatgtatcttgtcttccagagtccattggcaacctgaaaaatcttcaaatattgaacttggagaggagtgttgctttgcacagtcttccttcagcgatcacccaactgtgcaatttaaggcgccttggcctcaattattcaccgatatatcaagttccaaaagggattggcaaattggaatttctcaatgatgtagaagggtttccagtctatggtggcagtagtaatactaaaatgcaagatggatggaacttggaagagttggcttatctttaccagctaaggcggcttcatatgattaaattggaaagagcagcttaccgcactacttacccattgttaacagacaaagggtttctgaaatttttgtatctatggtgtactgaacgtacagatgaaccatacacagaaaaagatttcagcaatattgagaagatctttgagcagctaattccgccgtgcaacctggaagatcttgctattgttaaattcttcggtcgccagtatcccttctggatagattctacccatttggcttatgtaaaatccttgcatctcttcaactgcaaattctgtatgcaccttccaccagttgggcagctacccaacttgaaatatctaaaaattgagggagcagctgcagttaccattattggacccgaatttgctggccacagggcgagtaatcttggacgaacagttgctttccccaagcttgaagagttgctcattagagatatgcccaactgggaagagtggttctttattgatgaagcaacgtcaactgctaaggaaagggttgatgatggagattctgcaataccaaaagagaaagcattacctccaaggatgcagatactgtcacggttgaggaggctggaactttctggctgcccaaagctgaaagctcttccacagcagcttgcacagattaacagtctgaaggagatagagctaagatgggcaagcagcctgaaggtggtggagaacttccccctcctctctgagatgcttttgattgcgacatgtcaagccctggagaaagtctctaaccttcctcaagtgcgagagctgcgcgtgcaagattgtccaaacttgagacttgttgaggatttgagcactttggagcagttgtggctttatgaggatatgcatgaggtctctacattgtgggtgcctgggcttcaacagcagtgccggcaacatcatggagaggatcttgaagtctacaattggacatagtaataatgtatggatgcccaaaattatttggacgcttcagttgtttgatgcaaggtatgtgattttatatactctggattcggattgcgcccattttttggcgtgctattgtgtacatagatatatattttttgctttaccagttctcggtcttgaggatgaaaggatctagtactttgtaatatcggatattacagatatgacaataatcccaaagatatggcagtataagaactaaaaaactgtacttctagtttgttctggtaatcctctattaggttctgcaacttccatgcagctcattatcagcacatcgaccttctactgagcaggaatgaatgaatggatcaacgggtagatggtaggagtaccagactgactgtgtgtatattcagcaaatttagtctccctgatgtttacagcctaccttaactgaatttcacatcagcaatgattgcgtgcaaggccctttttcctccaccagatgatgcttaaggaccacaaaatacatgtatatctcgatgaaccgaaaataaaagcattccctccattatccaacatcgttttttatcgagtccatccttctccatttaaacactgaacagaacagcttgttactctgtcatcaggagagatattatgaccaatacccccaggttttccccttgttattccgtattgttgaattaactgtagttttgatgcattcatgtgttatgcagggggatgctgatcagtgccccttttggatacttcaaccttcctaatgttccatgtaagctgttttcctaatttctcccattgtaatctgctctactagcaatggcttatctgctgcatctcctgtacaggattcagaactcaagttcttgccgcaaaatggtttctgtacacacaaaaatggctaaaatttcaaatgccaactgcgattaacagcagattgagttgctgatggaggtgaaaactcactatgctttagagttcgctcccaaatcatcaaccctcttatatggactccgaaatcagaatctgagttttgtgttcagttatttcagttcagtgatctagtttcatctcaactgttccgagtaattaacaactggagtagaaattatccttcccctgaactgaatcacaaatgcatcgcaaagcaatcaaagctgtggcgaaattcatctatctagcgacgagaagagaggaagggagggaggcgtcacgtacctgggttgaactcgaggaggaggaagaggccgcggcgtcgaccccgggcgccgtggcggcgaagggggcccatggagcgctccaacttctcctccgtcggatctctgtcgctccctgcggcccaccctccagctccgcctccgcctccgctccccgacgccatcgccgaggtggggggttggatggccgtaccaggcgctccacgatgtacctcactcactgactcatcggagaactcgcccgcagcaatggtagctcccttctccaccatcaacttcgccactcgtcggagcgccgccgtcgccgtcggcgaccaacgcgcccttttccaacgacaatacgagataatccgagggcttattcgaaaatgatcctccaatgctcaggcgcccttagatatcccggcccattaattagggcccacacgtcatccgcaaaccccttgatggcccataaaatatgggctccacgttgcatcccgcccatgttcacttgcagcacgttgggctgtgaaagggtccaaagtccaagtatcgccccagagacggcccgtacactttgggcctcacattgctcctgccctgcgctgacgggccgcatgtccgcgtagtatcgtcccggcccacaaattaaatggaatcgcttgctggcctacgcccattagtcggcccgaccgcaagagcgatagtctcctggatgatagaatccgccgccatggcagccgctcgccggagctccgccgactggccacggagctcctctccggcgaagatttgcatcacgtaggttcttcgagtcttccctttccataatgtgctttggctctttcatcttcctctctctgtctcacagatcagacaagtgcaaatgagagatgctgtactgctgagtaagcttcagatactgttgtgttaccaaaaattatctcgggaaaccaacacttgacgagcatgtcaatacctattgatgagagatgttgtatgtactgctgtttaagctatagaacctattgatgttatacagatctgagtgcattttttttctttgataatgtcaggtgtgagctcatgaaactgggattgtgttctgttcgtagcatcctcttctttcattctttgttgtgaatcaatggtcctgttgaagtcaccaattggatgctttgttctctatgttctgcttctgtagctggatgagtatcagtcactgtatctgaacacatacagagtgaactctatggtttcagagcaggtatgttccttctttgacatggtcatcaatctgaaagcatgtcctccactagcatgtgcagtagtatgattccatgatggaggaaacaaaacttaatcatgtgcacgtctttctttttcttttctaatcaaagtgcgcgcctgctttaacaccatggactataatattcacgtaaactaattataatcacatcaccacgtacgtccagtgcgcttcatgcagccacggggaagctgccttcttccaggtcaggattgtcgatcagagccaaaccaagcagtttgttcagagttcagaattacatagaaactactgaaatctgaatgctgaaaatgattttgttgttgcatgcaggcacagcgaggggaaaggaaggcatgacacttatcttcgtgtgctgcaaccccagctgcaatcacagatggagggagtgacatgtaaattaattgtaattaatgctactattatgctgcatgtaaaggcaatagagctttgcattatgccatgaattggtatatgtttactagtcaaatcgagggataagacgacaaacaatgagtatgagatgccattgagcccgtgacggaggaaacaaaactcaagcatgtgtatgctcacccctttgtaaaggcaataaagcacgcagctggtttcacatcatggaatcttggaagcaaactctaaattaatcacatcgaaataaactgtaaactaatcacatcgccagagcccaggcgccagctaatcgttgcaatatactattgcagctgttgatcagtgccctagaatatgtgagtgtagctaatagaagtacgaaaaggaaaacgcaaagttccctactaatctgtaaggtctattagtaggaattaagtactctctcaggagcctcaccatttgcattcta

SEQ ID NO: 5128 - DNA, 1010 bp, Oryza sativa
agctttgcattatgccatgaattggtatatgtttactagtcaaatcgagggataagacgacaaacaatgagtatgagatgccattgagcccgtgacggaggaaacaaaactcaagcatgtgtatgctcacccctttgtaaaggcaataaagcacgcagctggtttcacatcatggaatcttggaagcaaactctaaattaatcacatcgaaataaactgtaaactaatcacatcgccagagcccaggcgccagctaatcgttgcaatatactattgcagctgttgatcagtgccctagaatatgtgagtgtagctaatagaagtacgaaaaggaaaacgcaaagttccctactaatctgtaaggtctattagtaggaattaagtactctctcaggagcctcaccatttgcattctaacaaacctaacgttttgacaaagaccattgcgtttccatggtgttactagaacaattgcttcagcgctagtgtgcaggaaatcaattaccatttagtgatgattggggatatgaataagaaaaggagtagccatagctaactatacggttcatgaatatacacaaaatgttgggttgtgcagcatagacaagtggacaattacttaaaatttggtcagtgatagtaacatgggaaagataaaagaaaagaagagtggttcagcagttgtctagctagtctgaatgttcagctatacaatatatgtaaggccttaccaccttgcctaaatcactccctagcctcctgcagtactgttgctttgttccactgtgtcgcattcttacactgcatttctaccggctgtgggtaagctcaatacatatagctgaatttacttcctttatttccttaagttaatccgtaaatgctcatcttgactgcagggcacggattttcaacaggatcagttgcgtccatttctgtctgctttctgattgattgagatgagatctactaggaaggaaaaatctgcttcatctgagtaatcccatata

SEQ ID NO: 5129 - DNA, 817 bp, Oryza sativa
  unsure (1)..(817): unsure at all n locations
nnnnnnnnnnnnnnnnnnnnnnnnnnnnnnnnnnnnnntctgttagcagaaatgggtctacaccactgtgaggagtacctctttccaagtttatcataataagccgtctcaactttgaaagatcagccaactcttccaaattccatccatcttgcattttagcattgtcacttccaccactgacagggaatccttctaaatcattgagaaattttagtcttcctatcccttttgggacctgatttattggtgtctcaactatatcaagccgtcttaaattatataactgagtgattgcagtaggcaaactgtgcaaagatttacacctatgcaagtgtaacatttggagattttttagagcaccaatagactctggaagacaagatatgcaggttctatcaagatcaagtaaatgtagatgaattaaatgtccaatacaatctggtattttttccacaagtaagtcagataaatccaaaacacgaagatacataaatctcataaaaattgtgttctcaatgccaactggatgttgtcgggttctaaaagttctcaacttaatctcctccttacccatgctaggtatgacaaccatatctttctcggtaataactcccatgcgtcacagtttacacatgttattatccacacatgatgttggatctccaatatagcattgttctcttgatatataacaagcaagttgccttaagagatcatgcattttgcattgcctcttatcaaaagatgtgtaaactggttggaggagattcctacttattagctcatagtagtattcttctgctgtatctacaag

SEQ ID NO: 5130 - DNA, 1081 bp, Oryza sativa
  unsure (1)..(1081): unsure at all n locations
ctaaaatgcggcgcaatttacacatgttattattcaccaatgatgttggatctccaatataacattcttctcttgatagatggcaagcaagttgccttaagagatcatgcattttgcatttgctctgatcaaaagatgtgtcaaccggttggaggagattcctacttattagctcatagtagtattcttctgctgtatcttctagtagttgatctttgtgcacttctacaaagccttcggcaacccacaacctgataaggtaatcacggtgaatggtccagtcttcaggatatacaatacaataaagaaaacattgctttaaatgctgtggtaaatcatcgtagcttagatatagagcacctcttatttccttaggaagtttatacatggaccaaacgtaattagctaaaatctttttccattcgttctctgctttatctttgcttgccaaaactctagcaataaccttgattgcaagaggtagcccaccacatttctgaacaatctcaatccctatgtctcgcagattttgcacttctttctcgtcctcaatgttaatgctcttccagagtagctcccaaccaacagccggtgacatttggtcgatatgatgtggttcctcaaccccaatttctctagcgacagtatcttgcctagtagttatcaaaactattcccgaggttgcagcatacagtggagttcgtagtagattggtccacacatcagactgccatacatcatccaacacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5131 - DNA, 1325 bp, Oryza sativa
cttaccttccttggtgatagacagttccctctgtttgagatccaaagtaattggactatgccgaaaaatctagtctgcccccaagattacatcatatcccttcaaggtgatcaggctgaaagcattaacaaatttcaccccttgaattttatatgccacttctgggactacaagattagatttcaattctcctcctcctgctactatcaccttcttaatagtcgaggttgctataggacacttgcacttaactgcaaactcatgggtcatgaaagtcccagtactcccactatcaattagaccaactgcttgtttcccattgatcatgattaggactgaaaaagtatcatgccgagttgtgccaaaagctgcactaaatgacacactcattaactcctcatgtgctccctcctgcttaggtgcctctatttggtcagtggccagctcctcttgttccttctcttttgattcatcctcctcctcttcagtacaaggttcattctctaccagtaaagcattgatagcttgcttcaccttgcattggtgtctaggaaaccatggttccttacaaaaccagcattttctgtcttctttcttctcaccatcacccctttgtggtctattatttgcgttcctgccaagattgttgaaattggtgttctgatttctgtttctgctgaaattcagtgccaccttccttgcattagctgccttctcatagttctttgcataccaataggactccaacagaccttgtggtttttgcccacacacatcatgcttgatatcctctctaagcccaccgatgaagcagctattcagatactgttcctgtaagtaaggatggtccctcctgactagatccacatactcctcaaatttatctatatattgttccacagttgaaccatactgcttaacattctggaatagttccactgcctcatgctcatttgcagccgaaaaacgagtgctcaccatgtgacaccattgtggccaaggaatcaactgccaaggaatacctactcctctaaaccacttcattgctcttccctgcagatgtgcaattgccagattgacccattgatcatatggtgtcccagtaatctcgtagaatttctcacattgcttcaaccagtcaatgggatcttctcctgtgaacagtggtatttccaaccgaggtcccttgattacagcttcagcataatgttgattttctccttgataaaccataccaccaggtctgctatgatctaatatgtgaaccccttgttgcccagtgcctgagctagtggctgtcccttgtgtttaaaaatttgaattgg

SEQ ID NO: 5132 - DNA, 4102 bp, Oryza sativa
ccgggcttgggaccggctatatcatttagataaacttaagatgacataggcggagttacatacactcctacaataaaacaattaaaaagaaaagaaacacacacatctaagaaaacatgacaatgtattttacaagagttaaagaaaatataaccttttttttacattttcccattttttgatatatattttttaattttcatgtttttttatttttttaatatttcaaagaccagtagctaggtaaagataaaaatacagattacaggtgaccgcagcccggccaaatccttcaagattaacctacaacacaaataagcgcacacaaattaatcatggatgttccccgcaaaaaaaaaattaatcatggatgtatatacataagcaatttggtaattaaataacttaattaaggaaaagaaaatacaagtgacgttcgttttgcaacaatctattttctgcaattgaacttaccaaacatcagacgtgcattacaaaaagtataaggaaaagacacatacaaagacatttaggtggcttttgtttttcaccaaacaaaacttaattaggagccctacactaggaacagatgttgggcacaacccttccatcttcaatatcctgctcacaggctgcaaggaatctctgaatctgtaacattgggcctgacctattttttgtcaaatctaaaaaactactctataggcctaatgtcttgcgaaaattcatgtgtatttgtgtttttataagatagtgaatgctaaatgtgcacattgatatgacaagaacacacttgcagacttgaaggctaaatgcgcgtgagctggtcttcatcatagatagcacatttttacataatggattaaataaaacccggcctctgcatcccgaaggatgtacacagccaatcatagctagcacattcaagagctgaattaaggagtacttatctcttggtctaacgaagtccattatgtttggtcgtgcacttatgtagcctgtataccaaatgctaaaccatttatgttgggcaaaatttgctacaggacactcaaaaatcgagtaattggctaagggacactgtaaaacttggcattgccgatggacactacaaaagttgtgtaattggttgtaggacaccgaagacattattttataatttccatgccgaaagagggaagaaaattttcaaaatgacaggaatgcccctctcttctcgatgcagccgacatgtgggcccatgtacagtgtcgtcgtccttgcatcacacgagcaactttcccacggcctccggcgcggatgccactgcctctctcatcctctagtcgtctcccacggtgaactcgcgcgagcgtcgggatggcgcctggccggaccatctacgagcgagctgggcagcctcgcacctgcacggttgccgccatgcagcagattgccggcgtccttgaggacccataccagatctgggaacagctgcgatgagcgtgttcatgatggggcccagatcgccggctatgagggcatcgatgagaccttccttggtatcttcgtttaccccatccgcggacaagacggcagccaaggcatcgacggccatcctgacccacccgcgcttctccgtcccgtctttgtcccgtctctggtcaagtaagggacgagctccggcggtgagaccatggcggagcgccgccgctttttctgctgcacgccgagccgtcctggctcaggtcgtcgcgccggccgcgcgccgttcctctactctggcgcgtgcgtgaggaagaagaagaaggataggagagagatatgggccccacttatgattagcaaatagcaatcaccctactaattagaaaaaaattgtggacccccgtttttataacaggaatcaatcgtgtaaacagtaccatttccctggatcaagtagtctggtacacacgagtttatagctgaaataccatatgcacatacacgagagtctagtgcaaattattacatcataagcccgcaggcatagtcttaaatcatcgaaccgagcggtccggagtacatcccaaaaacagaggtagataaggcagcagagttaaggcagcggcacgccattgccacaggcaacgaccgtaactaagacctattgagcaccatcgtcttcatcaccctcctggtaataggcacagggatcctccgaagcttcatctccggcctctgattaagtttatatttgcaagggtgagtaccaaccgtactcagcaagccatcacatcaacaatgcacatgataggggtatttcaaaggatggctatggttcttttgcgcaaagcaagttttgtaattcttttcacaagcctaagacctagcattgactgagcaaattttagtaccagtgttcatatttaaacaacgatggtgctgtccaccatccattgtgatcccaaggatagcttcccgccattgagttgtcatggttttctgaggatgtccaccttccctcctctcaggaagtggctccaacagcataaaaatcatcatgcaatatcccattccacacaagttaagaatttagagtctagctaagtgtaatacatgtcccggtgctcaataactgcgagcacggctattcgaatagatttgttttactcacactacagtggatgtacactttacccgcactccgcgactgcccaacacatgagcctcgtcccaacacatgagacgtgtcacggcaaagcttttcgataacctggcatcggcagtatccgctctatgaacttttcatcctcatgcactctaggcgtacacagtttctagcagcgagaggagttctggcgcacccgggaagggaagactcacgcacatgcattaagttataattatgtctaaattatcatatggcagtcctaccaatggcggtaccactgtagagccccatcctcaaacatcaagaaaccactatgcaaggatactgcctccgctcagctatttactccgctaggtctatccccatacgagaagtgtggttgtacagggtcgtttcatgcttaacttcatggctcggtccttaattgaccggggacggtactagcctttcccagatatcacccaatattaccgtccgccccagtctaaaacaagtgtttaatttcattcctattttcataattcatgtcatcatatcatggcaatgtggcgctcatgtctccacatgccgcatctcaattaacttcccaaaggtaattgcccaagcatatagcatttaataaagtatgagcatgcataaatctagagtagcatttctaagcaagtgtcatagttgactagggactcatacgtatttatggttacaaagatttaaagatgaacaataatcaaggcatggcatagttcacaagtggaatgttcatcatcacatccaatcttatttgtaaacaaaataaattttgcaatcgggatcaatatgctcaaagaatagtgatgacttgccttgctcaaagtcttgcgggtcttgaccttcgctcggatccgcaactccctcgggctctacaagtacgtgcgaagaattgatttgaattccgaattcaaataaaatccaataaagaccaaatcaaaaagcgagcacgagagtcgattgttatatccactatattattcgcgaaatagaactattcctcaacctaagacattttgtgtctcctaagtaattttcctaagaattcaacacctttattttagttcttaaataaatctaaattcctaccgcaaattgattactcatagaggctaccaaaatataattaaatttcgcaattttacgactataattaatccacgattaaattctaattattttaaattttctaaacctctaaattttactcaaatgcctatttattttcttcctctttctttctttttctttctttttcttttccctttttccttttctttcttttctcttttcttttctttctttttttttactctcttctctccctcccggctcctttctccctctctctctctcggctccttgcccacccgggcggcggcggcggtggacgcgaggtgggggggcagcggcggcgacgatggcgacggcggcgcaagt

SEQ ID NO: 5133 - DNA, 3941 bp, Oryza sativa
  unsure (1)..(3941): unsure at all n locations
nnnnnnnnnnnnnnnnnnnnnnnnnnnnnnnncacggggcgcaaggcgacgacgcgacgggcgacagcggcgacgtgatggcggccaggcgcgtgcggcagaggaggggttagggctagggaacgcgatcgaacacttacagcgcaatgaatagtgaatttttttctgttttcctatttggttgtttttcctattcaaatcttgtcccaatatttataatttttgcacaaatcaagtttacacaatatttgtgttgctctaacctagattatcattacccatattttatttttatatataatttattggaatttaattagagttaattcttattccatcacatttaaatttaattgatataaatatggtcgtgataatgttttatttatttctatcctcacataatctttattttaaattatatcttaattatttctcttgccaatctaattttagggtttattcctaattaactattctttattcgtgatctatgaactccgaaattaaaatccgatgaaataggtgaacaaaatcagcatgatgcaatttatttaaaaagtttttgaaggtccatatttttggaactttgatttttgttggtcaaattttcagggtgttacaaaaattagtccatgacgcgtggggccaggtggttaaaaacctattataaattagattaaacatacactgtccatgacacatgggacccaccggtgtttaaagaaggaaagagaaggggcaatccgggcatttagaaaaatatctcacctgttttgacccggaaataataaaataatgcgacgagtgtcctacagccaattacacattttttgtagtgtccatcagccatgtcacgttttcgcggtgtctctcagccaattacacgtttttttgcgtgtccagtggcaaattttgcctttatgttgtccccaaatccttgaatggatatatgcatatgtgatattactactggcatatagtgaatatagcaatgccatcatagcattgtttggtgatataacccatacaattttcttttggagtagcagtaatctctatctatgtctgcagagctaggaacactactgcacatgattatgttgtagtacatataggacaatacatttatctagaatacaccgtatgtgcaggatgcatgttaataagatcatgagaggataaaagatatggacaactaacaaatttgtcgatgtatatccaccattttatgaaaatcttgaccacggtgaaatggttacgtgcagcagtaatgaaataaatactaaatcatataagtgattaaacaatcagtcaatgcacacaacatgaacaactaaggagactatcaaatgctagaatagatgcatacagctgaagagcagaggagcagcatgaatgtacaacccaaagattagtatattccagtgaaaaatcccaagcaattagtgtacataccttgcaccatctaaattaattgggtcttagagctactcgttgaccaccagctcatgctcatctccatggagcttgcagtgtagctcctgaagcccagggacccactgctgagagatctcgtgcataccttcatccagccatagctgctccaaaccgcccaactcctcaacatgcctcaaattcgggcaacaatttaaaaacaactctctcacttggggaaggttggagatcctctctaggtcttcacatctttcaactaaaagtaaaccagagaggaacgggaggtcctccaccgtcttcaatcaacttgtgtatcttataaggagctccttcaagttggtctgtccaagctgtggtgggagagccctcagcttggggcagtcccaaagatccaacctcctcaaacaaggcatcagccacgatgaccttggagacagggctactttccccttttgcttcgaagcaacagttccatcctctcccccttccttggctgctgcaactgcttcctcctcctgcacctcttcttcttcttgttcaacaaaggaccactcctcccagttgggcatatccttgatgatcaacatttcgagcttggggaaagcaactgcctctgtggatatgagattaccttccctgcagccaacgaattcgggtccaatcttggtgattgcacttgctccaataattttcaagtagttcaagtttggtagctgtccgattggtggaaggtgcacacaggatttgcaatttgcgaggatcatggatttcactgaaggcaaatgggtagtaccaagccaggtggggaatctacaaccaaagaaatacccaataacaagatctcgtaagttgtgtggaggtgttagcatctcgaagatgttctcaacgttgctagcattttcctctgaatatgcttcatctgtctgttcagtgcaccatagattcagaactttgagatactttttctctgttagcagaaatgggtctacaccactgtgaggagtacctctttccaagtttatcataataagccgtctcaactttgaaagatcagccaactcttccaaattccatccatcttgcattttagcattgtcacttccaccactgacagggaatccttctaaatcattgagaaattttagtcttcctatcccttttgggacctgatttattggtgtctcaactatatcaagccgtcttaaattatataactgagtgattgcagtaggcaaactgtgcaaagatttacacctatgcaagtgtaacatttggagattttttagagcaccaatagactctggaagacaagatatgcaggttctatcaagatcaagtaaatgtagatgaattaaatgtccaatacaatctggtattttttccacaagtaagtcagataaatccaaaacacgaagatacataaatctcataaaaattgtgttctcaattccaactggatgttgttgggttctaaaagttctcaacttaatctcctccttacccatgctaggtatgacaaccatatctttctcggtgataactaaaatgcgtcgcagtttacacatgttattatccacacatgatgttggatctccaatatagcattcttctcttgatatataacaagcaagttgccttaagagatcatgcattttgcattggctcttatcaaaagatgtgttaactggttggaggagattcctacttattagctcatagtagtattcttctgctgtatcttcaagtaattgatctttgtgcacttctacaaagccttcggcaacccacatcctaataaggtaatcacgatgaatggtccagtcttcaggaaatacaatacaataaagaaaacattgctttaaatgttgtggtaaatcatcatagcttagatatagagcacctcttatttctttaggaagtttagccatggaccaaacatttttatctaaaatccttttccattcgttctctgttttatctttgcttgccaaaactctagcaataaccttgattgcaagaggtagaccaccacatttctgaataatcttgatccctatgtctcgcagattttgcacttctttttcatcctgaatgctaatgctcttccagagtagctcccaaccatcagctggtgacatttggtcaacacgatgctgtttctcaaccccaatttccctagcgacaatatcttgccgagtagttatcaaaattattcctgaggttgcagcatgcagtggagttcgtagtagattggtccatacatcatgctgccatacatcgtccaacacaagaaaataactcttatctttaatagccaattcaagcttgctttggagctcgccaactgattcttcctgtctgtgctgaacctccatggttctaagtagttgtctcaaaacagaggacggggagtagtcctgagaaacacannnnnnnnnnnnnnnnnnnnnnnnnnnnnnnnnnnnnnnnnnnnnnnnnnnnnn

SEQ ID NO: 5134 - DNA, 2827 bp, Oryza sativa
tctcgcagattttgcacttctttttcatcctgaatgctaatgctcttccagagtagctcccaaccatcagctggtgacatttggtcaacacgatgctgtttctcaaccccaatttccctagcgacaatatcttgccgagtagttatcaaaattattcctgaggttgcagcatgcagtggagttcgtagtagattggtccatacatcatgctgccatacatcgtccaacacaagaaaataactcttatctttaatagccaattcaagcttgctttggagctcgccaactgattcttcctgtctgtgctgaacctccatggttctaagtagttgtctcaaaacagaggacggggagtagtcctgagaaacacaaatccaagcatgtttgttgaagcttccttttaatttctgatcattgaataatttctgagcaagtgttgtctttccgattccccctgttccaacaatagcaagcttgtaagccttcttttccttgtgtgcaagcacgtggcacaccaaatttctagaaacttttaatatctctttccccacaaggttgggttcaacaatgtgagatgtttttctcagttctgatgttgaacctttatcagctggttgtgcattcttaagtgttgcaaatattttatccttttctatttccgctaatttccggttcagacttctaattttatcaccaatctcatggcgaacctgaatattggaaaagcaagagagaggtgaaagcccaccgcatgcagttgtttttcttggtgaagaagaatggccatttaatagcttgcttccttcaaaactagccaaatcgataatgtcatcagcatcatacatagcatcttttagccaagaaacccaattgtgtactgctgagtcttccattccccttcgctcagcatcactgagaaagcactgtatttgtttcattcttttctgcagttttttgagttcttcttctacacctaaaattagtattgcctcctctgtaatgatgccttgcaacttgtttacgcatgatccaatcaaagaacccaatatggttgccatagagaaactcgttgatggtgatgcaccaaaatttctaagtaaattacttatgagaattacacgatctgaaaatggacaaaagttcaatcagtttcagagtatctagaataatggggttacatttcggtaaggtttttaataagttgttttgccatgagttttgagcaagttagcatactgaagctaaagaactggaataatggggttacatttcgggtaagcttcttgggttaaaggtaaatgaggagaaagaagtaaccggaaacaagttgaggggttttactcaagtatattgcatgcaaatcttaccttatggagtgataattcagcatgaaaagacataagtcacataacaaggatcaatagtatagtagcattcatcttgcacaagctagaagtttgctctgacccatctactttagatactcgacagactcagattagtgaagatcaaaagaaactcagtggatacgccaactgtagaaaggatttcagaacattatgagccagtcatcaagagagaaccactgattgtgctgctacaactgcaaaaaggggagatgaaaataagaggtgaagtgtatgctcattataccgatgtaaaacttgaatgattcagaaggttaactagaaggatcaatgggataataccaaaaatacaggtgaatgtgttgacatccaccgacgggagagtgtctgctacaaggagatatcagtatatatgtgtttattcagatgaagcagattttccttcctagcagacctcgtctcaagcgatcacagggcagacagaaatagacacgactgatcctgatgaaacaccgtgcctgcaatcaaaacgagcatttacagattatcttaaggaaacaaaggaagtaaattcagctatatgtcttgagcttacccacagctggtagaaatgcagtacaagaatgccacacacacaacagtggaacaaagcaacagtactgcaggagggagtggtaagaccttgcatatatatattgcatagctagctgaacattcagactagacaagtgctgaaccactcttttcttttatctttcccacgttaataccgctgacccaattttgagttattgtccacttgtctatgctccacaacccaacgttttgtgcttgtccacttgtctagtcgatgtgattagttcacagtttatttccatgtgattgatctacagtttacttctatgtgattactttactgttggcttcaagattccatgatgtggaactagtcaactagctgcgcccttgaattagaaaaaaaaacagatagagaaggaaggccacacatgcttcagttttgtttcctctgtcataggatcatggcatctcatactcttgttgacaaagtaaacatagaccaattcatggcataacgcaaatctctactgcctttgcatgccacgtactccctccatctgtgaccgcagctggggttgcagcacacgaagataagcgtcatgccttcctcacccctcgctgtggtttaaagcttttaaagctttcacctttcagagtttagtagtttctatgtaattctgaactatgaagaaactggtggtttgtctctgaccgataatcctgacctggaagaagacatccttccaggtcaagcaatgtggtgaactccccggcgatgtggtgcaccatgttgcggtacacacagtatctgtcagctacctcctgtgattcaggagcttgcaaaagttcagtcaagcaatgcagagattgccatccaaagc

SEQ ID NO: 5135 - DNA, 18948 bp, Oryza sativa
  unsure (1)..(18948): unsure at all n locations
cacaatggttcataatgatgttgttccttttacataaaaaggcaaaaacacagttggaaccgaaagtctgaaggttgagttttctcttgactgtactgtaacacttgtggtacattagtgaagtgcagaagtaatcggttcaattctaggtcagctcatggaagtttgtcacctcaaagtcttacagaattttagagattagccccttctaaatgtctataaataatacggagtagaatatgtgaagttggatgagggctttctaagaacctgatgttgttactgcactcacactcagcaacaacaaaattcttctattatcacttattacatagaaaactaagaaaggtaaatatatatgactatataagattctaatcagcttaccattcacggcaaaacttcatggtactcatggctgatgcctatctggttcttgcagatcttcctctccacgttgaaccctactaagctgcaggcaactgagatgcttctagtacttctcaagaaggagattaaaggtgacaaagagcaaatctttgttatctcaaagagtctagagaatgggatcacacccgaccatccagaccccaatcagttcactctgctttgcatctgcagtgtgaaggagccgggcaatagagacaaggacagagcattcttggagaatttggatcttgctagtcatgtcgcattctaattctagaatttatggctcgatgaacatatcacgaagtcttcaaaaactcttggagtctgtgccattgtaactatttctcatagaatattatacataattactggagtaattgcttagatgagtacttgttttcatgacttctttctatttgaccaaaatttatttcctccagtttgatagtacttctgcaagtttgtgttgttgataactatgccttagaatacctctgatctgaaaccatctggtttgattgaagtgttgaactcaatattgcacagaacatttactcctagaaagcattttactcctagaaagcatccaattggattgtgacatcaacaggagcactgatctaacattgtcccaaacagatatgtgttgatatcaaaagaattcaggtgttgctttcccgggataatttttggtaacacaatagtatctgaagtttactcagcagtacagcatctctaatttggtatcatgcgcaacttgtctgatctgtgagacagagagaagaagatgaaagagccaaagcacattatggaaagggaagactcgaagaacctacgtgatgcaaatcttcgccggagaggagctccgtggccagtcggcggagctccggcgagcggctgccatggcggcggattctctcatccaggagactatcgctcttgcggtcgggccgattaatgggcgtacgccggaagcgacgtaggcccatgttatatggtccagcaagggattccatttaatttgtgggcctggacgatactatgggggaaaaagtacaccaaaggtccctcaatttgtcatcgagatacaaaatcatcctccaaccacaaaaccaaatagcgggcatccctcaactaacaaaaccgttcactttacatccttcggtggttttgaccctggttttgtccgacatggcggctgagttagcgtaggacccgcgtggatcccacatgtcagtgtggccacgtcagctcttctctctcttttcccctcttctctcccttcctcatctctctctctctctctcacttctctgctctgcgttctgcgaggcgggagaggaggagggcgtcagcggtgatggcgtcgcgcgagacggacgggtgcgtgggggagggaggggaccagacccacgaagcggcgacgggggaggggcgtcacgcggtcggtggggggaggggttgcgcgcgagcggcggggcaaccgctgcttgtgccgctccagtgtgggtgcccctcccactcgcccaatgcatacgcgcctatgcagtaccagatcaacgccggcgacaccttctggattgtctccaccaccaagctgcagagcctgatgcagtaccaggccgtcgagcgggtgaaccccacgctggtacccaccaaccttgacatcggccagatcgacatgttcccctccgttccccgctgcgtgttcccctctgttttgtcgccgcagcgtggtcgtctccgattgctgccgctgcctggtcgcgggacggcgttggcggcaacaccagacctacccaataaactcttttttattttcaccatcaattcactaacaatggccaagctagcccgagcannnnnnnnnnnnnnnnnnnnnnnnnnnnnnnnnnnnnnnnnnnnnnnnnnnnnntgacgatgaggagagagatcacgacggcggcggcacgggtgccacggacgggagtgcctgcgtgagcgccgccatggcgccttcgccttgctcggcagtggcggctgcgagcgcgcggtaggcggcgggggtgtggcgaggcgcacgcacacgcgcgcgtgcgggaggcgaggcgaggatggcaccggctccaccgcgaccgccctcgcgcctagctcctcccccgccgccgccgctcagttctttccggtcggccgccggccacgccgtgcccagccgcccgcgccccgcctctccgtcccgcgcacgcccgtcgcccgtggaagggggattggaaagggcagtagagagaggaaggaataagatgctgacatgtgggacccacgtgggtcccatgctgagtcagttgccacataggataaaaccggagtcaaaaacaccaaaggacctattgtgaccggttttgattagttaagggacgtgggggacaattttgtaactcgatgacaagttgagggaccttcggtgtactttttccatactacggggacatgcggcccgtcagcacagctgcacagggcaggagcaaaacgaggcccaaagtgtatggcccatcaaagagtgtatgagcgcttcgatgagtcagtgagtgagtttcagtacaggggaagaataatttctagtccagttgttaattactcggaacagttgagatgaaactagagcactgaactgcaataactgaacacaaaactcgattctgatttcagagtccatataagagggttgatgatttgggggtgaactctaaagcataggagagttaattgcaactcaatctgctgttaattgcagttggcatttgaaattttccatttacaattttagccagatttgtgtgtacagtaaccattttgtggcaagaactcgagttctgaatcctgtacaggagatgtagcacataagccattgctagtagagcagattacaatgcgaaaaattaggaaaacagcttacatggaatattaggaaggttgaagtatccaaaaggggcactttttagcatcccatcaaaactacagttaattcaacaatatgacgggacaacaaggggaaaagctagggtatttgtcataatatctctcctgattcctgaaccaatcctgatgacagagtaacaagctgttctgttcagcgtttaaatggaaaaggatggactcaataaaaaacgatgttggataatggaaggaatgattttcttttctgttcatcaagatatacatggattttgtggtcataaagcatcatctggtggaggaaagagggccttgcacacaatcattgctgatgtaaaattcagttaaggtgggctgtaaccatcagggagactaaatgtaccgagatagtccaagagggattgcgtaattctacaaaagtggagacacaagatatgagggtgtggcatcctttctcattcatccattgcattctcaagtgtacaatcctcctctctactcctctatttatagccattccctcttccaccttccatatttagtgatgggcctaattagtgggtaaccgagccgggccttcatgggccggcggtttcctaacaatacacacagtcagtatggtactcctaccatctacccattgatccattcattcattcctgctcaatagaagtttgatgttctgataatgagctgcatggaagttgcagaacctgttggtgtaatatgcaactttatcagggaactgcttgtaattttgttgaataagatatgtatgtgtgggggtgctggccatgggtgatatatatgcatgtgaagatgaatttcgttcagatcattgctgtgagaaacactgttgattttcgtttaggatgctgtggatttggcgattgggatttgtctagtgtttacctgaacgccctgaattcgattgtaagatcttcctattcttaccataggtagcgctgccgagcgtctcgctttcgacgaccttaatcgtcttgctccacttccagtgtcccttgatcttcgcctcggggaagaagaaccctgcgtgacacaacgacttgaactcgcccattcctacccggatcagcattgcttgtttgcattgctgctggaccatttcctgtccaactctgtttgttgagaactccgctttcctgccaggcttaatgtgatcgaacattcagtggcaatttcagtccagttcagtatccgctttaaggtatctttcaaaaaaaaataaaaataaagtagccccctccaggtgcagtttgttattctgttccatgtttacctttttccagtcaagaaacttgcatggaggtgaagtgattatgtaaagattcactagagcaatgtacttcagtaattactgaccatcgctggaaatcattcttgtcaggacatcaagcacgcctctctgtttttctggtttttgccaattccatttttcatgaatttaaattcatcatttttatttgttgatcatgtgcttcataattatgttctgaacctaaatagcgtgatatgtgataacagatgttttctgcaccagttttgatcatgaaaaatactaaagcctccaacaaacagacttgtgcatttgtggtctccaaaatatcaactcttgtgatcattgatctggcactgataactgaaggatgtaggacagaccgacagaggagaatgaactgatgcatgtgttcatccaaattgcttttactggaaaactggactgtaatgaggtcaaactaaaatagtctagaatcagatttgttgaacaattaaacagagtggatgactctccataactattctgatccattactgaagatgaaattagcttgataaaagtgcagaaacttccaagaaaatatcaaatgatgtatttagcagcagagcatcatttcaatatagaagtatacaagattatatcccctcctcctttttccgggcttgggaccggctatgtcatttagttacgccttaagatgacataggcggagttacctacacacctacaataaaaaaagttttaaaagaaaacaaacgcaagcaaatataacaaattatatgaagatgtattttacaatagctaaagaaaatgctttttttttcaatttttgacatttcccctttttttgatgcttttgttttttttttgttttaaattttcatgttttgtgatttttttttcattttattctctgaggaatgactgcactccaactcttcaagattaacaacctacaaaacaaataagcacacaaaaattaatcacggatgtatatatactttatacatcagacatcagttttaataacttaattaaggaaataaatataagtgctatcagtttcgcaacaatcatatttcgtggaattaacttaccaaacatcaggcatgcattacaaaaagtataaggaaaagacacatatacagataggcatgtcggtaatatcctccgcttattttaactgatagaatatgaaaaaaaatattaatcaatttgaaccaatgcaaagacatttaggtggatacttttggcactaaacaaaccttaattaggagccctacagtagaaacagatgttgggcacaaccctttcatgtttaatatcctgctaacaggtcgcaaggaatctgtaacattgggcctaacctattttttgtcgtaaaaaaaaattattctataggtctaatgtcttgcaaaaattcatgtgtatatgtgtttttacaagatagtaaatgctatcttttgcacacatgcatgatctgatatagaacacacttgtgaaattgaaggctaaatgcatgtaagctggtctgcatcatagctggtacattcaagagtcaaattaagggttacttatctcttggcctaacgaagcccaatatgtttagtccctcacttttgcagcctatgaaccaaatgctaaaccatttatgttgggacaaatcattggatggatatatccatctatgatattcctattgacatatagtgaatagcaatgccatcatagcatgtttttggcgatataacccatacagttttgttttggagtagcagtagtctctatctctgtcttcaaatctttgtacactactgcatatgatcatgttgtagtacctataggacgatacacttatttaacataccatacaggatgttaataagaccatgagtggataaaagatatggtcaactaattaatttgttgatctatatctaccattttatgaaaatcttgaccacggtgaaatggttacatgcagcactaatgaaaaagagcattgctccggtcattctttttgtaccgcaaggtactaaaatcccatccattaatgatggcatatcgaatggtcacgattacatggtacctcagggtaccagcttgatcgtggggtagcaagcacgagtgagccatagtggaagggtataatcgtattttcgcgtttggaaggatgtttggatcggtggtttgtttggggaagtgccgcagagtagcaaaaccctaggcttcctcccgacggcggcgcgtggcggacaatacgacggcggcggcggcggcattcgttggtctcgatgctggcgtcttccccttgtcccatcgttttccccttcgcggcggcgcctcatccattcctctcaacgctgcgactcctgcgaccatgctgcggatggggtcctggagatccactgcagccacggcccttgcagcggcgccgagacgactcctgtgaccgcgatgatgacacctacggctgcagcgatgacacctgcggcagcgacaactcctgtggcgctggcgaggacaactgcagcggccacgattctgggacgattgcggatgccatcgcccttgctgcgtctgcctgcggcggtgcggccgatggggtcgaccttcacctcgacttttttctcatgtgccctgcggcagcgctagatgcagaaggagaagggaaagcgagagatatcgagacacacacgctatttggaccacacgtgatacccatcgtacccctcagcaatcaacggccggatggagactggtacctcacagtaccagtaccgcgtgctacaaaaggaaggccgggagaaaaactcaatgaaaaaagaactaaatcatataaattattaaacaatcacaattcacacaacatgaacaactaaggagactatcaaatgctagagtagttgcatacagctgaagagcagagaagaagcatggatgtacaacccaatgattagtttattccagtgaaaaatcccaaccaattagtgtacataccttgtgccatctaattaattggctcttaaaaccactcgttgacctccaacttatgctcatctccatggagctggcgatgttgctcctcaagccctgggacccacagtgaagagatcttctgcatattctttgacagccatagctgctccaaaccacccaacatctcaacatgcctcaaattcgggcaatgatttacaagtagctctctcacttggggaaggttggagattatctccaggccttgacaactttgaacaaaaagtataccagagaggaatgggaggtgttccaccatcttcaagcatcttgctcttcttatatcgagctccttcaagttggtggcctgctgtccaagctgtggtgggagagccctcagcttggggcactccacaagttgcaactgcttcaaacaaggcagcagccacgacgaccttggagttggagacggggcttcctcccccttttgcttcgaagcagcagttccatcctttcccccttcctgggctgctgcagctgctttctcctcctgcaactcttcttctttgacaaaggaccactcctcccagttgggcatatccttgatagccaataattcaagcctagggaaagcaactgtctctgtggatatgagattaccctcccagcagccaacaaattcgggtccaatcttggtgattgcacttgctccatcaattctaaggtatttcaagttggtagctgtccaattggtggaagatgcacacaagatttgcaatctttgagtttcaaatatgtcagtgaagataaaagggatgtactaagccaggtggggaaccttcgcccaaagaataatacaatcataagatcttctaaattgcgtggaggacttagctgctcaaagatcatctcgacattgctaatgccttcctctgagcatgcttcatcagtcggttcagtgcagcatagatgtagacttttaagatgctttttgtcagttagcaacaatgcatctgtactgctcctaggagttgctctttccaatttgttcaagtcaagccggcgtaactgtgaaagatgagctaactcctgcaagttccatccgtcttgcattttagtattgtcacttccacctccaacaggaaatccttctaaatcattgaggaattcaagtcttcctatccctcttggaacctgatttattggtgaatcatcaagaccaagccgccttaaattgcataaccgagtgatcatgctgggcaaactgtacaaagattcacaccgctgtaagtgtaacatctggaggttttttagagcaccaatagattttggaagacaggatatgttggttccactaagatcaagtaaacgtagatgaattaaatatccaacacaatctggtatttcttccacaagtaagtcagtcaagtccaaaacacgaagatacgtgaatctcatgaaaaatgttttctcaattcccagtggatttggttgggttctaaaagttctcaacttaatctcctccttacccatgctaggtatgactaccatatctttctcggtgatagctaaaatgcggcgcaatttacacatgttattatccaccaatgatgttggatctccaatataacattcttctcttgatagatggcaagcaagttgccttaagagatcatgcattttgcatttgctctgatcaaaagatgtgtcaaccggttggaggagattcctacttattagctcatagtagtattcttctgctgtatcttctagtagttgatctttgtgcacttctacaaagccttcggcaacccacaacctgataaggtaatcacggtgaatggtccagtcttcaggatatacaatacaataaagaaaacattgctttaaatgctgtggtaaatcatcgtagcttagatatagagcacctcttatttccttaggaagtttatacatggaccaaacgtaattagctaaaatctttttccattcgttctctgctttatctttgcttgccaaaactctagcaataaccttgattgcaagaggtagcccaccacatttctgaacaatctcaatccctatgtctcgcagattttgcacttctttctcgtcctcaatgttaatgctcttccagagtagctcccaaccaacagccggtgacatttggtcgatatgatgtggttcctcaaccccaatttctctagcgacagtatcttgcctagtagttatcaaaactattcccgaggttgcagcatacagtggagttcgtagtagattggtccacacatcagactgccatacatcatccaacacaagaaaataactcttatctttaatagccgattcaagcttgctttgtagctcgccaactgattcttcttgtttgcattgagcgtcgatggttctaagtagttgtcccaaaacagaggctggggagtagtcctgagaaacacagatccatgcatgtttgtcgaagctttgttttaatttctcatcattgaatactttctgagcaagtgttgtctttccgattccccctgttccaataatagcaagcttgtaagtcttcttttccttgtgtgtaagaacctggctcaccaattttctagaagcatgtaatatctctttccccacaaggttggattcagcaatttgagaactttttctcaattctgatgttgaatctttatgagatgactgtgtattctcaagtgttacaaatattttatcctttgctatttcttctagttttctgttcaggcttctaattttattaccaatctcatggtgaacccgaatgttggaaaagcaagagagaagtgaaagcccattacatgcaattgtttttctcggtgaacaagaatggccatttaatagcttgcttccttcaaagctaaccaaatcgataatgtcatcagcatcatacatagcatcttttagacgagaaatccaattgtgtattgatgagtcttccatgccccttcgctccacatcacttataaagcatcgtatttgttccattttttcctgcagttctctaagatcttcttttacacctaaaattagtattgcctcctcggtaatgatctcttgcaacttcttagcacatgatccaatcaaagaatccagtatggttgccatagagaaactcgtcgagggtgatgctccaatatatccaagtttttttttttggcgtaagcaatatatccaattaaatcatgcaagagtaataccgtctgaaaatggacaaaagttgaattggtttcagagtatctttgtagctagcaagttattttgcaatctgttttgagcaagtatatactgattactgaagctgaagaactgaaatcattaaggggtttacctttcggtggcttctttgtatcaacaggcaaacgagaaagaagtaaccggctcaaattgcggtgttaattttgctcaagttgacaaagctaacttgcttggtatgaaagccgagctgaggctgaagtgaatcggatcgacaggaacggcagtggagcaggcgggtgtcttctggaatgcaagatgatgaccgagcgagccaacgtttcgattggctagctcctaacgtgacaagcagaaaattgttcaaaccctatgttgtgagagaaaactcagctgagcctgagagcaaggcctttgatgcgtgcagccgaggcatcgccggtcacaaggaagacaacgagcaagttcccattatgagattatgtctcgtggactagatgggctggctctcttatgcagtgttcaaatagtacaatggctcttttatccgtctcaccatttatgtcccactgtgcatgaggagtttgttttccagtgtgcaaattgcacggaacaagacaagccatcttagataaagatgtttgaacaagtttgcaaattgtgcaaatggcagtctgatgtatgaacaagatgtttcagctgcatatataaatttctccatcgtgctactaaaaagattcccatgtcaggaaagatatttggactgaaattcattcagagtactccaccctagtaaatagagaaagaaagacctcctaataccgaaggtatcgagaaataccaaattttacattagaaaatatggtacttcttccgtttcatattataagactttctagtattgcccatattcatatatatatattaatgaatcaatatatatatatatgtgtgtgtctagaatgtgagcaatgttagaacgttttataatatgaaacggagggagtacctcctagtatctcttaaggattggggtgcagctcatcttcaaaatcttaattctgccctagtaagtagagaaaaaaaggccaagaatatttcaactcatgtaagtaagaaagaaagacgagatatagtgttatttctgaatctaatccattcaaatggccgtatgtgagccaagaggaaagtaacatggctagcagtatgttggcttcttgtcttgatgtcagaatcgatgaaccatcgactaaagaaaacgataagaacatttgacttgctgacttatatatgttaggaaacatacaagaaaggatttatgggtggctaggatcatcacccctagtgctgtcgacttatcaggttcagcttcaccatggttgatgctgatcagttgctcaccattcactgtaaaaatgatcaatgctcaccattggaccattttctgtccttttgtccaggactattctcctctgaaccgagtggttctgcgtttcgcaactgttccatctcttccgagtgaaataatattaccattctcaacttgtgcactaatgcacaaattgcacacaacatattgctgcacttgaattgcaggccgaattgcagcagcagccctgcttcctcgtcaagagatgttgagaactgcagttaaacgtattaacagattgaacatgaatatttgcctaacacgaatttggtcctgagttgaatttgattccaactgtagcattgatcgaacattctcccaaacagatacaggtttgatggatgctatgaattaaacagtgaacacaataaacagcagtgcagcatctctttcaattcatggtgttgatgatatgattatctgaactagtgaactctgcagaccaacgaacaaacaagagctcaacttctatcgaccaaactctcttcctaccagtttggagattgagattcctctgtaaatttcgctgcgccccgctggataaacaagaactgaacagcctccctgatctgaacgaggataggagcccaagaaccaacgggacacgaaccgcctctggatacgggcgccgagatttggggtttccggagggagctccggcgagcggctgccggttagttctcaagcaggagagacacgcgtcgttcttgcgttcttgccctcaagtggccccacgagtcagggagacattatatgtttatattgccgttgatgcgacgacggcaagcgagcgagcgctccgacgaggtaaatcgccgccgagtcccacgtcgccggcgccggagaacctcgagcacaaccgaggtacaggacccctcgttttcctccccctttttcttctcatcgctggatgcgctatagctgtgctttgctttgtgctgcgttgatcagtcacgataagaataatttgtccgttgtagatgaacacagaatgattcagatgaaaattcaaactgaatagctcaattgtgtacatgaatgaacacaaacctcgattctaatttcagagtccatgagaagcttgcagacctgcaggtcgactcgagctccccagcatcagtagtgagcatctttgaacataatgatcaaatgccatcaaatgaaatgtcaaaaccgaatatctcaaaccctatcgttgctagtagaacacattacactatgcaaaataaggaaatcagcttacacggaacattaggaagatgcaagtatccaagaagacactggtttgcatccccgtccagaaaatacgaaggcaataaaaccatggttaatttaacaatgtaatgggataacaaggtgaaaagctagtgcactgtcataataacattttcctgaaccaatcctaaagacatacaagctgttattttcagtgttcaaaaggaaaaaggatgaattcaatgaaataaacaaaagttggatttacttctcttcctcaagttatacatgggttccatcccacataagcagcagctggtggagaaagagccttggacacaatcattgccgatgcaaatttcagtcaaagatgtgttgtatccatctattaacacaggtattgattgtcaatacgaggtatcatcactgagatttcctcaagtactgaaacattgtcagtacaaaggaatgactaggaaggttatccaccatttcctctcctctcgatcacaattcacaaagcacaatcagtttctatcatgatgggaggataaatatatttttgcctcagtgatcttcattgatttccttgtcctgcaggcttgtcattaaggactgacaggagaatgattggtgcttgggtttagcccaattgcttctggtgaaagaaggggttgaaatgagctcaaactaaactggtttccaactcaggttcgtccaacagagaaacagagtgtatgtgcctctgaaagtgttttcataattattccatcacaaaaaaaatgcagtagcctgacaaaggtgcagtttcaagaaaactttcaaagacctggtagcagtagactattccgtcattgaaaataagactggatgagtctctagaagtgtctccataactattccatcattgaaaatgaaattaatctgataaaagtacggaaaaatcccaatgatctactatatagtaggagagcgtcatttcaaccaacatctatacaagattatcccctcctcctttttccgggcttgggaccggctatgtcattcagataaacctaagatgacataggcggagttacctacacacctacaataaaaaaaataaaaagaaaagaaacgcacacatctaagaaaacatgacgatgtattttacaagagctaaagaaaatataaccttttttttgacattttcccattttttgatatttttgtttttttaatttttttaatatatttcaaagaccagtagctaggtaaagacaaaagtacagattacaggtgactgcagcccaaattcttcaagattaacctacaacacaaataagcgcacaaaaattaatcatggatgtatattcataagcaatttggtaattaaataacttaattaaggaaaagaaaatacaagtgacatccgttttgcaacaatctattttctacaattgaacttaccaaacatcatacgtgaattacaaaaagtataaggaaaagacacatagggactatacataggcatgtcgctcggcaatatcctctgcttataacagatgtaatacgaacaaaaatattaatcaatttgaaccaatacaaagacatttaggtggcttttgttttttcaccaaacaaaccttaattaggagccctacactaggaacagatgttgggcacaacccttccatcttcaatatcctgctcacaggctgcaaggaatctgtaacattgggcctgacctattttttgtgaaatctaaaaaaactactctattgcctaatgtcttgcgaaaattcatgtgtatttgtgtttttataagatactgagtactaaatgtgcacattgatatgacatagaacacacttgcagacttgaaggctaaatgcacgtgatctggtcttcgtcatagatagcgcatttttaaataatggattaaataaaacccggcctctacatcccgaaggatgtacacggccaatcatagctagcacattcaagagctgaattaaggattacttatctcttggcctagcgaagtccattatgtttagtcgtgcacttatgcagcctgtgtaccaaatgctaaaccatttatgttgtccccaagtccttggatggatatatgcatttgtgatattactactatcatatagtgaatatagcaatgccatcatagcattgtttggtgatataacccatacaattttcttttggagtagaagtaatctctatctttgtctgcagagctaggaacactattgcacatgattatgttgtagtacatataggacaattcatttatctagaatacaccgtatgtacaggacgcatgttaataagatcacgagaggattaaagaaatggacaactaatgaatttgtcaatgtatatccaccattttatgaaaatcttgaccatgatgaaatgcttacatgcagcataaatgaaaataaaactaaatcatataaatcattaaacaatcagtcaatgcacacgacatgaacaactaaggagactatcaaatgctagaatagctgcatatatacagctgaagagcagaggggcagcatgaatgtacaacccaatgattagtttattccagtgaaatgtcccaagcaattagtgtacataccttgcgccatctaaattaattgggtctcacagccactcgatgacctccagctcatgctcatctccatggagttggcggtgttgctcctgaagccttgggacccacagctgagagatctcctgcataccttcatccagcaatagctgctccaaaccacccaactcctcgacatgcctcaaattggggcagacatttagaaacagctctctcacttggggaaggttggagaccctctccaggccttcacagccaccaattgaaagggcaccagagaggaacgggaggtcttccaccgtcttcaagcattctgcttctcttataaggaggtccttcaagttggtggcctgctgtccaagctgtggtgggagagccctcagcttggggcagcccacgagatccaacttcgtcaaacaaggcagcagccacgacgaccttggagttggagacggggcttcctcccccttttgcttcgaagcagcaattccatcctctcccccttccttggctgctgcagctgcttcctcctcctgcacttcttcttcttcaacaaaggaccactcctcccagttgggcatatcctcaatgaccaaccattcgagcttggggaaagcaactgcctctgtggatctgagattaccctcccagcagccaacaaattcgggtccaatcttggtgattgcacttgctccattaatttttaggtatttcaagtttggtagctgtccgattgggggaagatgcacacaagatttgcaatctatgaggagcacgtatttcactgaagacaaatggttactaccaagccaggtggggaaccttcgcccaaagaaatccccgatagcaagaacttctaagttgtgtggaggtgctagcttctcaaagatcttctcaacattgctaatgccttcctctgaatatgcttcatctgtctgttcagtgcagtgtagattcagaactttgagatgctttttctctgttagtagaaatgggtctctactgctgcaaggagtagctctttccaattttatcatatcaagctgcctcaactgtgaaagatgacccaactcttccaaattccatccatcttgtattttggtattgtcatttccaccaccgataggaaatccttctaaatcattgagaaatttcagtcttcctatcccttttggaaccaggtttattggagtaccagcaagaccaagccgcctcaaattgcatagttgagttgttgccaaaggaagtctgcgcaaagattcacacccctgcaaattcaatatttgaaggctttgaagggagccaatggcctctgggagagaacatatatttgtcttgtcaagatcgagcaaccgcagataaatcaaatttccaatcgcacctgggatgtcatgtacaagtgagtcagacaaatccaaaatgcgaagacatacaagtctctcgaaaagtgaattatcaattcttgctgacttcccagataagtttgtaaaacacctcactttatattgatccttgtccatgctaggtaacaccactatgtccttctcagtgacaactgaaatacgccgtactttgcacatagtattagtccctagtgactctgggtctccaacaaaacattcttctcttgacaaataagaagcaagttgccttaagagatcatgcatcttgcagctgctgtggtcaaaatataaaccatctggttggagcaagttccgatggatcagctcataataatatctctctgctgtatcttctagtaattgtcctttttcctcatctataaagccttcagcaacccacatcctagtaagatcgtcacgcaaaatgcttgcatcttcagggaaaagtgcacaataaagaaaacattgcttcagttggtgcggcagcacttcataactcagatataaagcaccacttaattcacgaggaagtttgctcatggaccaggcatttttccccaatatccgtctccattcattctctgtttgttcttggcttgctaaaactgtagcaataactctgattgcaagaggaaggccaccacatttgcgaacaatctcaatacctatgtccttgagattttgcacttgtttctcttggttgatgttcatgctcctccaaagcagctcccatcctacatcagctgacatcaaatcaaccctatgagtgtggtccaccccaattactctagcaatagtgtcatctcgagtagttattagaattactcctgtggcggctgcatgaagtggagtgcttagtaaatctgtccatgcttcagagttccacacatcatccaacaccagaaaaaaacttttatttgcaatgtgtgatttaatctttctttggagctctggaactgattcatcttgctcatatcgaattcccatattacgaagaacttgtctcaaaagagaatccctagaatactccttggaaacacaagcccatgcatgatggtcaaatctcccttctaattttttatcattgaatattttctgagctagtgttgtcttaccaactcctcctgttccaacaatagcaagcttgtaaacattctttttcttgtgtgcaagcaccaaatccaccacttctctgcaagcacgtatgacctccttgcccacaaggttgggttcaactaggctggagctttctattggtgtccatgctgaaccacttccattatgatgtctgcggttgagttttaaaaatacctcatcctttgaaatgttatcgatctttttgttcaggcttctaatttttacagcaacttcatgacgtatacgaatattagaaaagcag

SEQ ID NO: 5136 - DNA, 787 bp, Oryza sativa
  unsure (1)..(787): unsure at all n locations
actattccgtcattgaaaataagactggatgagtctctagaagtgtctccataactattccatcattgaaaatgaaattaatctgataaaagtacggaaaaatcccaatgatctactatatagtaggagagcgtcatttcaaccaacatctatacaagattatcccctcctcctttttccgggcttgggaccggctatgtcattcagataaacctaagatgacataggcggagttacctacacacctacaataaaaaaaataaaaagaaaagaaacgcacacatctaagaaaacatgacgatgtattttacaagagctaaagaaaatataaccttttttttgacattttcccattttttgatatttttgtttttttaatttttttaatatatttcaaagaccagtagctaggtaaagacaaaagtacagattacaggtgactgcagcccaaattcttcaagattaacctacaacacaaataagcgcacaaaaattaatcatggatgtatattcataagcaatttggtaattaaataacttaattaaggaaaagaaaatacaagtgacatccgttttgcaacaatctattttctacaattgaacttaccaaacatcatacgtgaattacaaaaagtataaggaaaagacacatagggactatacataggcatgtcgctcggcaatatcctctgcttataacagatgtaatacgaacaaaaatattacaattnnnnnnnnnnnnnnnnnnnnnnnnnnnnnnnnnnnnnnnnnnnnnnnnnnnnnnnnn

SEQ ID NO: 5137 - DNA, 704 bp, Oryza sativa
tcgggccacgccctagccgcccgagggaagactattttccatccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgctgagttgtcccgtttcgcgtgtagtttcggagcccgaagacccgcagcgcgaggatttcgaggatcaagctccagatctcgagcaaggcaagccacctttgaacatcttgagcctatatttgaaattcaattatattgcttgcaaaatattatgcattgataggatcgcacttaatctgttgtcccgtctgcaaggcagatcggcggacctacctaactaggggcatttgatccttccattgttaattgctataccatgtccccttgtaaccatccagttgcgcctcgatattcgtgcactctgtgcgagtatcgacggtcgccttcaaacttaaaatctgagtaacaatttgggtaaaactggagttttacaaaagacttggaaaaccccacacctgggtcggggcttgcgaactaaatgaatttccaaaaccccgaaccgggaacgtac

SEQ ID NO: 5138 - DNA, 576 bp, Oryza sativa
tagctggtaaagataagccaactcttccaagttccatccatcttgcattttagtattactactgccaccatagactggaaacccttctacatcattgagaaattccaatttgccaatcccttttggaacttgatatatcggtgaataattgaggccaaggcgccttaaattgcacagttgggtgatcgctgaaggaagactgtgcaaagcaacactcctctccaagttcaatatttgaagatttttcaggttgccaatggactctggaagacaagatacattggtaccatcaagatcaagcaaacgtagatggatcaaattcccgatgcaacctgggatgcttggtacaaatgaatcagtcaaatctaaaacacgaagataaggaaatctcttgaaaaatgaattatcaactctgagtgttttctcataagaagttttccatgtccttactttatattgcacctcgtccatgctaggtaacattaccatgttcttatctgtgacgactgaaacacgtcgaagtttagacacagtgttacctaccaatgattctgggtttccaacaaaacattcttc

SEQ ID NO: 5139 - DNA, 352 bp, Oryza sativa
cattacccgctgcataggtagcgtcacgggcaaactcgtactcggtccagttggtaagagtgaatttctcgctgcccagcataaagttgtaacctgcaacccagccggcgacatagccgttgtcgccagtgtaataggtttgatctgtataacgcttagcaaagaacggtttgaaccaccaaccgctgccggtgaaattgtagccgataccgtacaggaacatatcgtcgtggaaattcacgcgattcggagaaccgtaggtgccatacgcatgcaagtagagattaaatccggtgtcacccaagtaaataccgttggtatttttaaaggtataacgctgctcgctacctgg

SEQ ID NO: 5140 - DNA, 1044 bp, Oryza sativa
atgatatcactgatcttgctaggatttgttgccactccatcagaagatatcacatgtcccaagtaagccacactgctcagaccaaaagcacacttcttaagccgtaccaccaactggttcttctccaggacttgcaatactgccttgatatgcttgatatgttcctcccttgttttgctataaatcaagatgtcataaaaaaacacaagaacaaactttcttaaaaagggtgctagagcttggttcattagtgactgaaaagtggcaggtgcattagttaacccaaaaggcattacttggtactcatagtgacccatgtgtgttttgaaggcaattttaggaatatcttcctcaaccattctaatctgatgatatcccgaccttaagtccagcttagaaaatattctagccccatgtaactcatccaacaagtcctctataattggcataggaaacttgttcttcactgtctgggcattcagctgtcggtagtctacacacattctccaagatccatccctttttctaaccattatagctggacaggcataagggctgtcactgaacctaatctccttagactggatcagatctgatattatgttctccatggcctccttttggtaatgtggcactctatagggtctctggttgggaggttctgacccaggtttcaagtttatcacatggtcacaagctcttcttggaggtaagccttttggctccttcatcactcctgggaattgtgataaaacttcctgaacatctgctggcactgcagcctcctccttcctctcttcttcagtcatcgcattcacttgtaacacacaccccacagctcccttttttatcagcttctccattttatgaccatcaattaagaaatgtttcccaggtttagtgaaatcctgaaattcaactagcttaccttccttggtgatagacagttccctctgtttgagatccaaagtaattggactatgccgaaaaatctagtcttgccccaagattacatcatatcccttcaaggtgatcaggctgaaa

SEQ ID NO: 5141 - DNA, 1418 bp, Oryza sativa
  unsure (1)..(1418): unsure at all n locations
nnnnnnnnnnnnnnnnnnnnnnnnnnnnnnnnnnnnnnnnnnnnnnnnnnnnnnnnnttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgctgagttgtcccgtttcgcgtgtagtttcggagcccgaagacccgcagcgcgaggatttcgaggatcaagctccagatctcgagcaaggcaagccacctttgaacatcttgagcctatatttgaaattcaattatattgcttgcaaaatattatgcattgataggatcgcacttaatctgttgtcccgtctgcaaggcagatcggcggacctacctaacttgttgcatttgatccttccattgttaattgctataccatgtccccttgtaaccatccagttgcgcctcgatattcgtgcactctgtgcgagtatcgacggtcgccttcaaacttaaaatctgagtaacaatttgggtaaaactggagttttacaaaagacttggaaaacccgacacctgggtcggtgcttgcgaactaaatgaatttccaaaaccgcgaaccggggaacgtaccgggtgtacggttttcccgctcttgcacttaaggatcgtttccttggaatttcatccgaacataagacaagtacgaccacataggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttatcaaactattcgaacagccgtgcccacggtcatgggcggatgtgaggtgattcctagcgtagttttgtttgactactgcttgtgaaattgctgttgtgaaaaaggggttcgatgtttgaaaaatctgtagctgaagggatcagctaggcccgggtggccgtttggaaaagttgttggcccgggtggccgtttgaaaagttgttggcccgagtggccgttgaaaagctgtcggccgggtgccaaccttgtttcaattctaaagactgatacatcgcacannnnnnnnnnnnnnnnnnnnnnnnnnnnnnnnnnnnnnnnnnnnnnnnnnnnnnnnnnn

SEQ ID NO: 5142 - DNA, 1740 bp, Oryza sativa
gccattctcaagggagagagggagggagggatagagagaagaaggagagagaggatagagagaaaggggatagagagaaggggtagtgaggatgataggtggggtccacgtgggccccaccatttttttttattattgtgtgtgtgaaactgacatgtgggtcccataggttttattaatttttggatcgaattgccacgtaagcgcaacgtcaatgccacgtcagatgaagaccgagtcaaattagccacgtaggcgccacctcagccaaaaccgaggtcaaatactaccgagggaccttatttaaacggtttcgtaagttgggggacctgtcgtacccacttttgcaattaagggatgaaaatcagactaggcgacaaatagagggaaccaaagtgaacttattccacagagaatccccttgatgggccatacaatatgggccgcacgttgcatccggccgtagcagcccacgatctccccagggcggccgctcgccaagccctcgccgtcgccggccgcccgccgccgtcgctttcctcgtctgagacggcgaacccctgcccaccacaccgccatgttcgctgcgaggccggccggaccgccatgtgcgggcgcgcacgatcgagcatccccaactctgcctgaacacacaacatgaataatacatgcaagtttcagtcactgctactcactgcttgtctgcatctgaaagttcggacttttacttacggattctattagtattactgcatctgcacgcatgagaaagtattttttttataaaaaatattttcttaaaaagtttttaacctaggtgcccatggatttgatttttgacatgcttaatgtgtgttcatagctatctaagatttcgaaacctgtgaattgtgcatggactgattttttacgggcacagtgctacgctacttgactatgacttccccgaatgcaaaatagaccttttgttttctggattgctcataagcatcgtctatgtagatgttttcaacataaaagtacccatggatctggttgagccaacaaatgaaagaataacatcgctacaaacaaatgctactaatcactaatcagccggtcagaatcgcacaatatatatgcatgatgttatataacaaaggcactgttgatccaacaaaacctggaaatagtagcacccaaggaggaaggtggtgatcttaaatcaatggacaataatgaatatctgaatcttctcattcggttattagtttcgacattgttggttgctctttgatgttcttgcatatttaactcaagaaagggtaaactcaagaccaaattcatgtagatgtaggcaaatattcatgttcaatctgttgaagcatataattgcagttctgaacatctcttggctagaaagctgcggctggactgcaattccgctggcagaggagaggactacaagtgcagcaatatgttgtgtgcaattgtgcatgagtgcacaagttgaaaaaaggtaatattatttcattccgaaaagatagaacaaccgtgaaaataacgttcaaaccagtcagttcagaggagaatacggtgatggacagaaggccagaaaacaacccaatggtgagaatcgatcatttttctagacaatgaatggtgagcaattgatcttggtgaagctgaaccagataagttgacagcgttactgttagtggtgatcaacccagccatccgtaaatcctttcttgcattttg

SEQ ID NO: 5143 - DNA, 1211 bp, Oryza sativa
  unsure (1)..(1211): unsure at all n locations
nnnnnnnnnnnnnnnnnnnnnnnnnnnnnnnnnnnnnnnnnnnnnnnnnnnnnnnnnacatatatccatggactttgtagaagggttaccaaagtccaaggggaaggatgtgattttggtagtggtggataggttaaccaaatatgcacatttcatagctttatcccacccatacacagtggaggaagtggtgcaggtgtttatggataatattcacaaactgcatgggatgccgatagctattgtgacagatagggacagagtttttactagcacattctttcaagaagtgttcaaatctcaaaaggtccaattgaggtttagcacagcttaccatccccagacagatgggcaaactgagagggtgaaccagtgtttagaatcttacttaaggtgcatgacatttcaagaaccacaaaattggtgctcttggatagctttagcagaatggtggtataacacaacatatcacacagcaatacaaatgactccattcaaggccctttatggatacagtccacctcaaatcagtgaattttctgtcccatgtgatgtatctcaagaagcaagggtaaccctggaagagaaagagactatagttcagaaactcaaagcaagcatggaagatgcacaaagaaggatgaagtattatgctgataggaatcgaacagagagaaagctggaggtgggagatatggtatatctgaaactacaaccctatagacaaaatgcttttgggatcagaggatcattaaagttaagaggcaaatactatgggccattcaaggtgctagagaaggtaggtgctgtagcttatagattgcagttacctgaagaagctgctatacatccggtcttccatgtgagccaacttaaaaagcacctgggtactcatgctgtaccaatgccaaatttaccggcagtgggaccagatggtcaaatcaaaacagagccagtagcagtgctgcaaaggagaatgattccaaggaacaatgttgctgtcactcaatggctaattctgtggagcaatttaactccggctgaagcaacctgggaggatgcttcttatattcagaaagtgttttcaaattttcaaccttgaggacaaggttgggcttaaggggggagtaatgtcagactcgtaagaagaatggaggaaaatttagaaagttcagagtttcgggtaactgaagatgcaaaggagggagaaa

SEQ ID NO: 5144 - DNA, 584 bp, Oryza sativa
  unsure (1)..(584): unsure at all n locations
nnnnnnnnnnnnnnnnnnnnnnnnnnnnnnnnnnnnnnnnnnnnnnnnnnnnnnntttaaatgcaatttcatcaggttgtacaaaatgtttaagaagttcattctgtcattaattaatatatttaatggcggcgcctatcatgcacctgatttgatcgccagcaagaagaggattagaactgagaataacttcgcttgaagaaatcggactagtaggttgatttaacaagctttgctggaagaactaatgacgtgtcagaattacttaccgtttagaccaatgcaaaggatacgaaaagcttcatcaaaatggtttccttgtacggaggtattgtttggcaactttgctgacatggattgataaatgagagcgaaatgagtgtgtcactgtcaaatcggattagatgagtagttcagctgcaaaggttaaaagcaagaggataaatacgatttcagaattcagatagcaccaaaaagagtaaccaaagtttgagtgttaatagatcatctgtgcacaaaacttgacgtctcttgcaggtctgcttgtgcttatcccttttcactctgtttaaagcttctttttc

SEQ ID NO: 5145 - DNA, 168 bp, Oryza sativa
tagattggtccatacatcatgctgccatacatcgtccaacacaaggaaataactcttatctttaatagccaattcaagcttgctttggagctcgccaactgattcttcctgtctgtgctgaacctccatggttctaagtagttgtctcaaaacagaggacggggagta

SEQ ID NO: 5146 - DNA, 1449 bp, Oryza sativa
aaatgatttatatgaaaaacgatccaatgtcttcctttctttgcgtgacatgtttcaaaaaaaatgtttttctaaagaaatgcttgtcaaattgcatgattgaaatctgaattgactatcttaagttgttctgataagaagctttagtcgagaaaaaaaagaagattgctccatgagctggtgactattgagacttgagaattctggggactaaagctactagtcgagactattgagacttgagaattctggggactaaagctactagtcggaatgggtatcctaacaagtgataacaaatttgagtctttgtatatgctttagcctgaaatgttgaatgtgtagtcccaatgaattcagtcaatcaagcacattggccctaattttagttagacttgcacatgtcttggaaagttggaatttcactggtctttcttctcgtatttatgttcatgatatgatttagtatcatattgcctaacttatctttgtgctctgcagtgaggtacgacaagatgttggaacattcggagagtgcaacagaaaaaattatgagcagcatcatggataccattgctgagaaccttcctaagcagaaatctgggaaatttgacgtaggcgctgcctctgacaaaatgaaggagaagctgtttggtcgtcagaagaccattcatcgagttctgggtggtggaaagcgtatgtaatcttcttatatttttataatgtttcctttgtgtagccatgtgtgatgctctgtctgtgcttgtagctgctgatgtgtagccatgtgtgatgctctgtctgtgcttgtagctgctgatgtgttgctatggaggaacaagaagatatcctccagtgtcctggctcttgcaacagcaatttgggtattctttgagtggctcgactaccacttcctaacaattgtttcatttgcccttgtccttggaatggttgtccagttcgtgtggtccaatttctcaagtgctctaagcgggtatggaatttacaaagcatctgaatagtgtgtcccctaataattcttcatgttgtcataaaaaatgtcttttgccactttttagatctccttctaaagtaccccgtgttgagctgccagaagagctgtttgtgaacattgcagttgcagttggtacccaagtaaataagttcttgagttttcttcaggatgtgtcttgtgaaagaaacctgaagcactttgtactggtatgtggaccttctttaggttcttatgtactccataaacatcatgaatagattaaactggtaaagactaaagaatcaaaccctgaatatgcaaacaaaattgttctgtttgtttatcactgacctttatgcctgtgtcaaactatggttcctttcaggcaatcgttggactgcgggctgcggctgttattgggggctggtgcaatttcttaactgtcatttacattg

SEQ ID NO: 5147 - DNA, 1626 bp, Oryza sativa
  unsure (1)..(1626): unsure at all n locations
nnnnnnnnnnnnnnnnnnnnnnnnnnnnnnnnnnnnnnnnnnnnnnnnnnnnnnnnnnnnnnnnngcacaaaatggggaaccagaagaagcccttaaccttttccgtgaaatgtgtatggaaggagtaaagtacagtaatgtgaccatatcttctgtgctatcagcttgtgcaagcttaccagctatatattacggaaaggagattcatggtgtcgtcataaagggccccataagagcagacttgtttgctgagagtgctcttatagatatgtatggcaaatgtggtaacttagaatgggctcatcgtgtttttgagtccatgcctgagaaaaatgaagtctcatggaatagcataattgcttcctatggggcttatggccttgttaaggagtcagtaagtttattacgccatatgcaagaggagggattcaaggcagatcatgtaacgttcctcgctttggtttctgcttgtgctcatgctggacaagttcaggaaggattgcgacttttccgatgtatgaccgaggaatatcagattgcacctcgaatggagcattttgcttgcatggttgacctatatagtcgggcagggaagttggataaagctatggaattgattgttgatatgcctttcaagccagatgctggtatttggggtgctcttctccatgcttgccgtgtgcatcgcaatgtcgaacttgcagagattgcttcacaggaattatttaagttggatcctcataattctggttattatgtgctcatgtccaatatcaatgcagttgctggacgatgggatggtgtatcaaaagtgagaaggttaatgaaggatacgaaagtccaaaagatacctggttacagctgggtagatgtaaataacaccagccatttatttgttgcagcagataaaagccaccctgattctgaagatatttacatgtccttgaagagtattcttctagaattaagagaggaaggttacattcccatgccagatttatgttgtcccacgcacctggacagcagcacacaggttcagcaacaataactctgcaacttgtttgattgtgcactttcatacttcaaaccttttgaactgctgtgtcaataatgtctaaacatgttctgaagatactatgttatggatctacatactaactagcctctgttgaaaagccatcactgctctgctagcatcattgtagtaccagattgtctatccattaatagcatgcaacatcagaatgtagggtcacttgggcaattgaagtttaggtaacctgtcacagatcgtctctgtgttcagtgaacagaacaatggcatatcatgacttaccttaacattctttgcagattggctaaatcagaatggcattcttgaatctcgacaaatatatgatgcccctatgctattgtgcattttctgtcaaggaattatcaaaagctatttctatctgattcagtaatgtcgtaacattgcctggttcaggaattcatttattttgttgtttcttatgtgtgcgttaatgaaaagtttggtaagagttgccagtctagagttaagattttactgataatgtctttatcttcttgcaggtcatggggatttgattgcgatgttgtcc

SEQ ID NO: 5148 - DNA, 10673 bp, Oryza sativa
ctgcagcccttgaatctcgacaaatatatgatgcccctatgctattgtgcattttctgtcaaggaattatcaaaagctatttctatctgattcagtaatgtcgtaacattgcctggttcaggaattcatttattttgttgtttcttatgtgtgcgttaatgaaaagtttggtaagagttgccagtctagagttaagattttactgctaatgtctttatcttcttgcaggtcatggggatttgattgcgatgttgtcccaacactgctagctgttcttccatttggtcattgggaatttggtgatgatttaattgagaaccattatatcattatcatacaaacttttgtttgtgaccaaatgatcttcttatgcagcttattcaatatcttcatctgaaaaagtggtgggttgacttacattgctcgtacattaattgcttcaagagtgtagggttcatctaactgactaagtaactatgtcaatcaaccttctccttgttgttcagggctgttcatatcatgacaattaaaatcttctgcgtttcaaccttctccttgttgttcaggagggttcatataataccaaatttaaaatcttctgcatgattcaaatgttttttgtgtaccaacatggttagccttattctcttacggtactcaatctgccaatcatgagaatttcagttttgctggtttagtgtatgtgcctttcaatctttcaattttttacagtaactgagcagtgaactgtgccaaactagatctgagaaatatctatatgatacctagaatcagtacaaaatccaaaataagtgcagctacacctaggcttggttgaatttatagaagcttcttgatgtgagccccttaatgatttctgtaggtgttatcctgcataaataaatccagaagcatattgccttgtcttatttgtgaaaagttgttccattttgccactggcgtgagttttttttttcatgacatttcttggttaaattatgtgtgttcttgttccatcaaggccctactatccaacctttatctcgtgtgtaatctaagtgaacatcaggctgcaggatgagagggtcatgaaaacaacatcggcgtcaaagcttggcaagttaatgcaccatcgtttcctagaaagtatttcattgaataaggcttgagttgtattatatggtgctaataataatttggaactttcacatcaatgaagtccagcttttgaactgatcaaaaggtaattttatcggttttacccatatcaatcgtacaatttagcatgatagttagttatatgtgttggtttatgttacagggctttgcacatgaacagagggctccttgattgctaacttggagatatctagtaagtttgctcagattttgaaaaggaaatattcgtcagttaatgatataaatcaaaagatccttatgttgactttattattatataggatcctgtattcatgaaaaacatggtactatattatattatatatacaagagatttctgtatttctgttgtttctgaatagtaacctcacaatggttgatttcaaggccatgtttttcccccttgcatagctgtcacttggtaccaatgtttcataaacatttcatgtaaagagcaacagtacttgaagtacatacatatgaagttggccgatgttctgatccataatctggatcataacaatagcatcacaaactcaagttaagaatagtacagggtcactttatactacacaaaccgtcacgtttcttttgattcatgtattcctgtttaagagacttttaactcatatgtcgtcgtccaaaattttcagatcttttggaagcttctcacgctgtatgcgtgcaaggctctgaggatttctgattgcatccagcatcctgtccaagaattcaatgaactggcgatcttcatgagcaacctgaggatctgaaaacctatcgaagcgatactgatcctgcacgttccattacaaccataaagcttcaaaaaacagaggaactccagcactaagcaatagatacatcgtggggatatcatatactacataagtacgtcttaaatcacaggtatgtgcaaacagaaggtcagtaaacttgtagatatatatttacctcaagtttagttttatgatgattatgattactagtttaccacaatcttggaatttatttgacactgtacatgaaaagctgaacaacaacacatctacttgtctaagcacaaaccttttatttaaacggaataaccaaaccacaaacattcaacttcgatgtagaaaaaaaaaaaggcaaattttggatagaggtcgaaccttgatcgtcgtgtcgacttgcccacacgcgctgctgcagaaggattgatagctcgccggagaaagacgacggagcccctccccatggaacagctgcagctggcgatggccggagaggcggcagatcgcctgaattctcccgaggaccaactccgatgccatgtttgcccaagcaagcggttatcctttgttcccctcttctaattttcccctacttcaatctacaagcttctccagggatcgagcagtagttgtagttgtagtactatcggagtattacgcaaggtatcggcagtcatggaaagcttcgttggcctcgtttggaccggccgggtcagagattgactgagattagcagtcatcctttgacggaacgttctttggtctcgtcactgatgactagataatcgcaagtcacaacgtgtctcctgatctcatctttgatttctcctcctgtagctatcttgttgattactactaggtttgtctccgcacacctgggatgctcccagtttagttattatccctctcaggctctgccacgtagagcagaattaccatggctgtagaccccaaggcgccgtttgggcgcgtaactgaattttttagagatgtttcgttacgatccttgattgccaatttggctggaaagatatggcatctgtagcaataattttgatcgagaaaacgtgtacgcgtttcagcggaagcctggaaagatgcttcgagaagaatattttgccaattggtcatacatattacatggtcgctggccaactttcttttatgactcggctcaaacttttaatccatggtctctgaaaacttaatatagacgtgattcacaaaaaaaaaaacagaaaaattcacacgattcttcacagtaactgtagatctcgggttgtaaaattctccggtcgtgtggtggttgtcataaaccgaacgacaacaatgtcgtatggtgaaaaaaaatactgccacacgattaactcactggcatttttcagcctatctgcaatagattcttctgtaaaacttggtgaatttgtattttcggtgctatggtatcaccgatgacttctcatccaagacctgcacttccccgttcaatgcaactacgacatatgatctgcagataaggattgcaatgtcttagaatatgtagagcactgcatagctgcattactgtgcactcaagtagtaagtgtagcattgatagaaatcttgggcatcaatgattactaaatatcataaaggaaaggctgcttctcctaggtctaactatctatatctttgaaacaccttggtctagtactagattaaactatatatagtcatgttagtttgagaaatttacggaatgctggaaactatcccatggtccacgacaccggcaattttctccaagctttctgctaccttacctgtaaccgaaacaagtcaaaccagctaaaaatcaatcgaagaaatggtcactaaatcatcgagttaacttagcataccaagatccgggatgggagttgtgaagataacatcaagtacatgatggccctccttggtaaccaatgggaagtcacctcctaatggaccagcggttccaatcgatggccgcctccataccttcatcaggttatcatgtaacgatgaccaatgatggaaagtactcagattcacatcaccacaaatccagtagttgctcagacttcagagtaaacattagaattacataataaatatatgagtgcacctctgcgtctcctaggaacaagtcatcaatctcttcagcagtgtcgatccaatttgcctgaaatgacccgttcttctattaatgatgattattgcaattgcagaaaactgatcactccagtaccagaaggtggcttacacttttcaccaagactggaattgaaccttcgatgcctttcacatatttttcatggccaatgatgaaggcaagtttatcagctgatttaacaataccctatggaggcattttcacatgacaatgtggaaaagaagagaacagattacaccaaggttgtctcgatgagcaactaaatgaatctcatttctgatgagctttttgaataccttctccaccatgaaagaaggctctccgctctccgttttccgacggccaatgacagcggtcattgtgtcctcttcaattatatcagcatcagtgaaagcaaagtcaatctatatgtcagtaaacaccgtttcagcagttcacccactttctcccattgtcagcaagatttacaatggtgaaagaaatcaacatacttgggtgccttcctcgtagctgctgacctgtatccctgctttcactgcctcacttgcactgatcgtggacctggctgatcaaccccaagaatggattaaatgcaactgacaaagcatgtcatccaaggaaattcaggtcaggagctcatgcgtccactcttgaaacaatgagtgatccaaaaagaagttagcttcagcaaccagaacttacgagggtattccaaggatgccagtgagagaccctcgccggaggcgagtgccgaggtactggatggcgaggccggacgccgggccggagccgagcccgaccaccatgccgctctccacaaacctgtccacctgaggccaggccaggccagccaccgagctcgtcagaataatatacacatgatccaagcgtcaacgagctgatggaacagtggagaatcccctcaccgtgagcttggcggcgtcgaagaggccgacgacgtcggcgtccgcggcggccgcgcaggtcacagcacgtctccggctacggcggcgcacggtggccggtgcgacgttgccgatgcggcgggggcgtgggcacgggcggagccgcgccgaagaggagctcacgcttgccccggcaacggcgtccatggttgggctggtgcctcagcttgctggcctagcgagcttgacagttgcatacattggatggatggcacattgacgaagcggataaggggtgcgaagcaggtgcaacaccagcctattgtccttgttctcctcaggcctcatatgctcggttgtggagtcaccgatagctctttgcggtataaatacgttcactaatcgatttgtactcaatttacatattcatatgttttatacaatggtagtttgtactcaattcacatattcatatgcttatacaatggtaggctagcatttgaatattgggttttcgttgcaattgtacagtgggattttagcatcaataaaatgatttaggctgcgtttcccaacacagctgctgcacacgtccagagcgatcgattagcacgtgattaattaagtactccatccatcccataatataagacgcacccgtatttgaagattaacctttcaaacatttgaccaacacttagttaatataaaatattttttatttattaaaagttatattattggattgagatttaaatttactttcatacggtaataattttgttgctacaaaccttatagtatgtgagaaattataaactaaatattaattttggatggagtattagctttttttttcagaaatatatcaatataatttttttaagcaactttcatataaaaactttttttaaaaaatacaccgcagtttgaaatcatgacagacaaacagcatttgaatattaggttttcgttgcattcgtacattgggtttgaagcatcacagaatgatttagcaacatttgcatattggataacatggcatgtaaattatgtaagtttgaacgactgaacaactttccatgtaaattggataacatggcatgtaaattgtaagtttgtaagctgcaaaccactaattattcacaaagcagatttgataacgaaatccggcaggcagataaaagcacagatcaggcaaaaacctcttaagctccatattcaagcaaataaaacactcggcaaaaatatgaacgattcttcaatacataatcagtatcttgcagagcaaaaaaaaagagacattttccaaaccacgttaccacatatcaatgctgcattgttcaatactttaatccaatatcaggcaagagcaagaaagcatttcaaaaacacaaagcagatacaacacatctaacaaagatcaaaaggacaggtaaaggtacttcaaatctcataaactttcataaagcgaattatggtcatcacattacataatactccagtctaggaacataaccagagacatttcaacagctagaattaaccaaaaccagaaaaggtttcacattcctacaccaataactggaacatcaagaatccgaaggcaccatcaatccaaatgcaccggtcaacatgatgtaagaagacatccacactactgataacgactacttggatctctgcctcatctttcggcgcttcctcttgagcctcctcattctcttcttcttccactgcagattagcaaaggctcagaacaaagcatcgacggtatccataattaagtgtagtagttgaataaattaacatgcaagcaatctatctcgtgtggatagaagtaatctatctcatgaggataaaagttttggaatcagaagtatgagtgcttcattgtagtttcatcacgagatgatcagaaacacggaccaatggttcttcatcatgttccataaaacgattaattttgtggtagtcatacagcatagagccttgactgaatcatgttcatgatttagcaagcagaacactaacgtactgactaacgtacatatgaaaagaaagaaacaaatgtacaggatttggcattcagaatgagtaggaggaatttatcatcaaatagatcagataaacgtaaggtttcctcatcatgccaatacagtatcataaagaagaatcacatacagaacaaaggaaaatcggcaagaaaataaataaaatgttctctcagacaaatgcctcgattgtccccatggtttaatggaatggattagatcggactcgtcatctgtgtgttcatcaaggagaaccgcatccagaaatataacaatttagaacacctactcctatagtacacacgaagattgctagcgaaagaaacatttttacagctatatagcagtagtagcagaagaagaaagttaaatcgcgcaagcgcgacacgcaatgcaattctctcagacaaatgcctcgattgtccccatggtttaatggaatggattagatcggactcgtcatctgtgttcgtcatcacggagaatcgcaagccacaaaataaaccaacaacaatttgcacatcccaaaacctcaaatcgaacgcacaaagtacaacaatttgcacataccacaacctcaaatcgaacgcacaaagtaaccctaccaccaacgctacatcgtaacatctagataaccgaatcagcacaggtaacaaagcgaaacgaggcatgcgaacagatcaaaagggaaaggatgaacgcggtaacgaaccttggccctcatcgcggcggcggggacggcgaagcactcgctctctgtcccttctctctcgacgtcggcggcggcggatttgtggaggcggcgaaccgggtgagatggtggcggcgaggtctctctcgtcttatttatagagctaagggaacagcggaagggagaaaccctaaccaggcgtgagcgatggacggctcagatcttccgcccaacccgggttctactccgattagggctttatttaatgggcccagaaaaaaggctttaccatcttattaggcccggcccatgaaaactatcaacaaaagtgagaaaagcttttgagtcaaattcaacgcgaattcataaaaacgatagatttgtgcctcgttttacaggacatatggaaattttaaaagggtgtagttatatttatggcaccatatttttcatcaaaaaatagtcggcatgtatttatattgtaagtccctaaattacatatgtaattttagtgtatttacaatgtaagtctcaaaattacatatgtaagtactaaaattatatatgtaaatttgaaaattatatatgtaattagtatgtaaattcgtaaatgaggtgtaactactgtataaatggctgaaaaaaaatcgactgtatagcatatagcgtcatatttatagtaactccgttttaaaaactcaaggattcatttcgtgtagaactagaactacgtggtgtgccacgtcatcgatattggctcagttgatgacttggctggcggcgctcgggtccgcgtcgccgtcggcgccggcgccggcggggggatccggcgcgtactggccgggcgccgccggcgagccccagccgatgggcttgaatgggatgccggggagaggcatgccgaggccgggcatcccggggaacagcgggaacgacgggatcgtcgacggcggcagccaccacttcatgctgtcgctgccggcggcgctccccgcctcggccgccggcccaggagccggcaccgccgcgtccgcatcccccgcggcgtacggcgtcgacccggcgtcgaccggctcgaactccaggtggctgatctcgttcttgtagtcgtccagcaacgggtccagcggctccgtctcgtcggcggcggcggccttggagccgaaggcgaagccctggccgaagtcgccgtcgacgtcgtggaggatgcgcaggccatggccggagacggcgagcaggaggaggcagacgaggatggacagcttcttctccatggcgttcctcctctttggctttcttggcctcctgcaaatgaggagacgcgtgatgaaaccatcaaatccatcgaagaaattatagcttggcagcaatggagttaggttggatcatggtgacctgcattctcatttcagtatgataatctgatagctccaggaattgagaaatggcatgtcgaaggtgtgcattgccacctaaactgcatccgcatcgttgagtatttggtaatctagtatgatatgcaaatagatttcactgcacataggcttgaatcaacaaccttgatggatccgcatctgttcagcattgcagccttggagcggattttgaacacagcctgactgcctgagataaattcagaacagcaacacaacatactgatccaaagttttgtacgttccattgtctctattctttattcttataccctgttcttttctccaactaaagttggattaaattttggatactcatggcacgctttttaaactactaaacggtgcgtttcgtgtgaaaactctctgtatgaaagttgctctaaaatatcatattaatctatttttcaagtttagaataattaaaactcaattaatcacatattattacaacctcgttttgcgtgaaacacttaatctccatcttcattttcatcttcaggacattcaaacaccatcattaatgttcctcttccttttctcatttgcccttgttcatgcaactttgtaacttatcatttctatcaatgaaatggctacaaggtagagctgtctctacattcttatgtcaaaaaaaaaaagatccagagttcagaattcaatgctatcatattattcagcagtcaatgtccatgaagcccctgatatcagtagtatcatgatggtgatctcactattttctaatttctgcaaacgaattatggtgatctcactaattcattgttttgctgagctccactagtgaaaagaaggaaattaattgagccacttgaataacactacataacagaagaaatgcagggcagagcagttgaaatattaattcagattgcagcaaatgagcgccccattcaggaaagcacacagctctcagatgacaactgacaaccaatgtctgcaatacgcaactgagcatggtacaaattcttgattcattccactgatgaaaacccagctaatctatgatttcagttcttaaaacccagacaatctactcgctcttcttgaacttcatgttccccttcggtatcttgctcaagacaccttgatcaagtttctgatactggtcacgcaggaggccaagaatattgtataggaaatcatcaacttgatcttcatacttctcgtagagcacgggcagcgtgtgagcgctaacaaatcctgttccagttaatcaaatgtgaaatatcagtgacatctgtcactaatacagtggactgcgtacattcagaaaatagtgacaacatgaaatttctaaatttcagagggagagaaagatcttgtcatggaagaaagtttgaagtagcagtctcttaccaatgtaaatgacagttaagaaattgcaccagcccccaataacagccgcagcccacagtccaacgattgcctgaaaggaaccata

SEQ ID NO: 5149 - DNA, 10725 bp, Oryza sativa
acccccaatcacacaatctaaaaaaccaaaccacgccctttcccccaatcttccgaacctatattaaaaaaacaaatctaccttttcgttcagtggagtccccaagattctcccttccaacaaaaggctagccaaaaaagaaaagaaaaagattccacctccacatcgccacacatagcgaccatcagagctcgaaacaaccaagaacaaggtctcaaacagatcatacccaggggagacacagcagcagatgaacgaagagacggagaagccctcggctctcgagcttcttggagacgaacgaggcgaagagcaagagcaggtattcaaagtaggagtagtagtagtagtagatggggaagtgttcttcaaggggactagtagcaattttattccagtggtgtgggtgcgcggcgtgtgatctgatttgcagcctgtgcagtgctgcactgcgggtcccacgagcaggttatctgctacgtgtacgcgtgaccgctacgggttgtttcacttacaggtgggccatagcgggggatattcatggtggggcccacgtgcaagagaatgtcacgatctcgagtaggaaaggaaaagaaaagtggttgcatggagcacgagggaagtgtggtccattccgaggatatttttcgaatttattattgggcttgtttgtgttgagcaaatcgccatgttgcctgttgctgattcgaaaataattgctgaattgttcgctggggccaaaatatatatgagtttaagcaaaatttacactccacgtgggtgccattgttcaaaaaaaaattgaagaaaaaagagttgaatgattgagtcggcaactgcctagatatatagagcacgtgggcaactaaaagtaaccacaacctgctttgtaagtcgttttgattttcttaaatcaattaagtttatacaaaagtatagtattctcttcatcttaaaatataagaacataaaattagatgggatattttgatacttttctagtactacatatctaaatagactatgtgtagattaatttgtgcttttccttaaacacgttcacgtcattgtattgtactatgatctgaaaaatgtgtttttgtggtttgctaaaaatgccttttgatatgattatctaaagatatttatcctaatactatgacgcactaaaaatggtactattgtggactaggttctctcaaacatattcttttttatgtgtgctctagtccaaagtgcaaactagtgtaagcacgtgtggtgttaagtgagcacttaggtttagcccttgtacattataaaattatgctcgaaatatatgcccaatgtaaaatttactcttataaatttgataaacttcacaatccatgacaaaaacaatggcccttgaggccttacctccttgcatcattaattggcgcacaatcaaaacaccatggctctctttctatgaaagattctggattttcaaactcatgaacagtgcatttcatgtaaaaaaatctatataaaggtatctcctctgatcttcatagaacaaaatttcaactttataatagttgatttagtcatttatataccctagaatagtgagctgtcacaaaaccagataatccactcaattagacaattagaagataaaaaaagctaaaaaaatatgggtggctagtttggtaaacatagaatggcattttgccagactcttttggcaagagaaaggtttggcaacttccgcttgaactggccgaagttgtaagcaattgaagcctcccaacaagatcatcctatcaaaactccattggaaagcctgcaactgttttttttatattaaaaaaaaactccattggaaagagtcagaaaaaggcctggctacaaagcacccaaaggctggatcattgggccgggtcactggctgcggttggacggacagtgggcctctgttgccgtgtggggtgggccggaccgtgggcccatgcagtcactccatacccggacggacgacgcctccgccgcccgccgcctcgcctgcgtcgatcgatctccatcgccgccgcgctaccatcgtttccggcgtctgctgcttccgccgcatatcctcgctcgatcgctggctggtgagtatccatgcatcccctctttctcgaatttgcattagtcctagctagggttcacaaactatgtgtgtcgcttgacatatctaggggtggtactcatcctgacatatcacatatgctctttgatttgtgctagaatcgtgtgccaggctagcttagattgtttcagatctgtgttgaaattgagaacaatgctacatgttaaattgagggataagttttttttttctgatgaagttgcgtgcttgtacaaattagtcttgattttcaccgcacctgaatttcatttctcaaacggaaaaaaaaactctgtacaaacgacgggcaaggctataaattattctcgattgattataccctctctagtcattgctcgttccttgctgttattgattaatagctcaaaaataatccagatttttcacccttctccactgaatgtctagttacttctccttttcagtgtcagtcaggctacggtaccaacgaattaagagatttaatttaagtcgctcatctgttctgttgacatgtgcaatgaattattctctttccttgattggacagaccttcaggtcaacgaagtgtgagtgttgaagatgagttgtcagaagttcagccgtcagtctctgcacttggcgttgaacgaggggcgcggcttgtactcgctaaggcacatggacgtatcaaagctcttctacccatcaatggcagaagcactggaagcagaggctaaagcgaagaagaagaagaatggcgccaacaaaatccggagcatcggccgtttgccaacaccgagcatacactaccaaccacatgtgtcggctacgtctaatccatacaatttcactaatgtgtttgctctctttggtgagaacaagaacaagatcctcttctcagacatggaaggccactccagcacctacaacaccgagttgcattccttcatgatcatgcctgatctgaattcacccaagggacccaattgtttggctgctcatatcacccgcactgctgcccacgcaaggtatgactttgatatccggcctgatgtggactacgatttctttgcctataatccccatggtgagcacactgacagcctctacttgatggacatggaccaaggcaaaccaagctcctttgaactgcttgcatactatcctgtgggggaatggcaatggtgctcactcccattgccgccgttctttgatgacccggagcacaaggcctgcagcaacatatcctacgcagtcatcgatggtacccgaatctgcatatcatctgccactgcgacctactcttttgacacagtggccctcgagtggagcaagattggtgattgggtgtttcccttccacgccaaagccgagtacattcctgagctcaaactatggcttggcctgtcagctagcagtccctctgacctgtgtgctttggacctctccactgctgccatggattcttgtgatgtgctacccatggtgcatcatgttgggcttgatgctgaccttcctgagggttgatcgctgaaaaatcgtaccctggtgaacctgggcatgggccggttttgcattaccatgttcttccatactgcagatgacggtcctcaggtgatcgtcttcaccggtgtggatgtcgtgccctgtggtgacaatcaacaaggggggcaggccctccacaggatcaagcacaagtccaaatgccttgtcacagacaggatcgagcatgtgctatgaattgtgatcgtcgatgctctcatctagagatggcaatggggacccataacccgagactcgacgggtttttattttattaggagctaattgtgttctaactcttataccaaatgttttaccgttcatcttattcaaaaacttttgtgaaatatgtaaaactatatatatacatataaatatatttaacaatgaatcaaatgataggaaaagaattaataattacttaaattttttgaataagacgaacggttaaacatatttaaaaaagtcaacggcttcaaatatttagaaacggggggagtattaatagcactgttgctagagaaaatagtgatggtttataactctaatatggccaattatagtacaaaacttaggctgtgtttagtttctgaaattggggagaagtttggagaaagttattagttttgaaaaaaaagttaggagtttatgtgtgtaggaaagttttggatgtgatgtgatgtgatgaaaagttgagagttgaggggaaatttagtgtgaactaaacacacccttagcccgaatgatcaagcacaagtccaaacgtttcatcactcacatcaagttcgtactctgaggtcatcgattgatcctcatttatccatgtttaacctactgggagaagtaggttcagagccagtaggaggacaaatactgcacgcagtgattttgctttaatgtgccatctactcactccgtcccaaaaaagacaaacactggatttccgtgttcaacatttaaccgtccgtcttatatgaaatttttttataattagtattttcattgttgttagatgataaaacatgattaatactttactagtaatatgcccgtgctaacgctacgatgctattattgttattttataaaaatattagaacttcatgttagggcaaataattttcgcacaatcctctcagattcaatgtcgtatatgaatttaaagtaggcagataacaataatatgatttgcttgaaaataataatccataaccatcgattacttcaatatacaatatacgtgagcaatatatgtggacactatatgtccacataaaaaagacaaaaaatggtagagaattattccattaatttgcatacaaacatgattaatactttatatgtgacttgtctttttaatttttttcataattttttcaaataagacggacggtcaaacgtccttgtttctctgccgataaaacttaatatatgtgccatctatatttatgttactgttgtactagtttttattttttttggtcgtaagaactatgtatatcttagcccttgtttctctgccaataaaactaaagctatagatcaagtgtggcgtctgctcagagattggctgtgaatggcattcccgcttccagaagaagggcctatggagtttggggattggtggctgaaatctattagccgatttcggacgtgctacagggggcttttgattccctttgtctcatggtgtattggttcatttggaaagaacgcaacacaaggatttttgagcatacatcttgcacaacagcttagctctaccgggatattagagaggaaatcctaatttggagagaagcagagatctttaaacgagtagattatcagtgctcagttttgtgagagttcttaggtggtgtttgaatcttctaaagataaagatgaagatgaagattaagtgtttcatgtaaaacgagatggtaataatgtgtgattaattgagttttaattattacgaacttgaaaaatgaatcaatcttatactttagaacaactttcatatagaaagttttagcatgaaacgcaccatttatcggtttgaaaaacgtgacatgagtatccaaaatttaatccaacttttgttagaggcgtcacccgaaggtgatcgctcctgtcgtttcttcaacaatcaacacagcttctacggattataggtgcggttgcagcactgcatgcgagcacaacttgacagcgatcgattaatgaagctgaagttaccacgaaatctgaggctgcatatctttagactaatgaagctgaagttaccgattactaatgtttgagggagttccttcttgcttcgttagtggaatttggcccggcacaaagtgataaaattaaacgcaaatgaagattggcccggcgcaaagtgacaaaatgaaacaggaattggagatgcggggtatcgatccccgtacctctcgcatgctaagcgagcgctctaccatctgagctacatccccgtgatgagcattagttttttttatcttgattgatactgtgttcataactgatggactgtaaatcgccaaaatgcatatgcaacactgcagctagcagtacatcgatatgcaagtgtttttttttaaaggaaccagcacaagaatgtgcttattcattaaatatagcaggagaaaaatacaacccctagaggcaaagaaaaagcaaaaaacaaggaaagctgtacactatacaaactgcgggatgatctctccaagacgcttggcgcctgccaaggcccacatgccagcctcttcttttatctttgaaagtagatacgaggttgcggtttccttatgatcaaatatcctcctatttcgctccttctagacttcccatacgatgagtagaatcagggtgcggagtcccttcttggggacgccagacacagaggctagcattttcaaccaatctttgattgattgcgccaccccccagcgtcggggttctaactggtggaaccctacccatgtcgcaacgagattccaaatccgtctcttatacctgcactcggcgatgaggtgcaaagccgtttcatcttctcttctgcaaagagggcacctgccattattttgccaacccttggtcgcaagccggtcagaggtccaaaccctattctgtatgataagccaagcgtggagtttgcattttccgggcgcctagaccttccagatcaaggagtcaaaagttgtgtcaggcgcgccaacacactgcgctttgtaggccgatgaagccgagtactgcccatgaggagtgaacttccaggcgatttggtctgactcttcttcttctaactgcatgttgcgaactgcagtccatagggccaccagctgctccacaagggccactgtaattactgggtttgtttccagtgccaaatcacctacccaggcatcattctcctttccttggcgcagggtctttttcctcttcttagaaattgcgtatactaggggcatgaggtcctttggtcttctcccatcaatccacgcagagtcccagaatcgcactatattctcgtcaccaatggttatcttagtggatgcggcaaacaagctcttgtctacttcatcgcaggggatctcgagaccaacccatggcttgtttgggtccttccattcatgccacagccagcgtagacgcagggctctcatgaatttttctaggttcaggatcctcaggcctccttgcctagttggcagacatgtctttgtccaattgactttgcattttccacccgtgatgtcccccatgccagcccagagaaaacgtcgccgctgcttgtctaggcactctaaagcttcctttgaagttttcagagcggtcagtaagtagattggctgcgccatcagcactgatttgacaagtgtggacctcccggcaagtcccatgtttttgcctctccatcccgttatacgccctgtgatcttatcaaagatgtgctgcatgtccgcctttcgcatccgcccgaggatcagggggagtcccaggtatttgatcgggaagcatgctctcactgctgggactccctctaggacatcgtccaaatcaatgttattgcatttgatgaccgcgacttgagatttttggaagttggtaacgagtccagtagccgtgccgaaacgttgcaggatttccgtgagcgcttggacatcccctcttgtgggattgacgaaaatgacagcgtcatctgcatacatagatgttctcaggcgaggcattctgcctcgaagcttagagagcgaacctaggtctgttgcctttgtaaggagatgttggagagggtcgattgctaggacaaaaaggagcggagacagcgggtctccctgccaaagtcctctcccatgcgtgattttttgaccagggatgccgttgagaagaacttgcgaggtagatgtgcagaggagggcacctagccagtctctccattttacagggaagcctaggcattgcaaaagggccatcaagtagtcccaacgaatggaatcaaatgctttcgtgatgtcgagcttgaagaggagcatcggccgattcgtacggtgaaatcttctggtcatgttcctcacaaagagaaagttgtcatgaatgcttcttcccttgattaaggcactttggttgatggagaccaaggagcgcatgtggggcctcagccgcaacgccagcagcttggagaagattttggctatgatatggattagactaatcggcctgtagtccgaaacactctccgccccttccttcttcgggatcaacacaatattcgctgagttcaggaggcccaagctggcgcagcggaggttgaagatggaattgaagacaagggaaacatcctccttgacgatatcccaacagcttttaaagaagataccagtgtaaccatccggccctggcgctttgtcaactggcatctctttgatagcccggtggatctcctgctccgagaaagactcttccaaggtagagaggtcgaaaggctggatgtctagagcttcccagttgagctcattcggcctcggccccggccgccccattaaatgggcgaagtggtcaaggatggtcatttctttctcatcgtgagtgactacccagccattttccttgcagagtctttgaatgctattcttcctcctacgcgcattcaccctgaggtgaaaaaacattgtgtttgcctccccttcacggatatgagtcaacctggaagcctgtcttttccttgccctctctatcgtggcgagagtcagagttttgcgctttagggcagctctcagccgcaattccgggccagagagatctctgtgttcctgggccacatcaagccgctgaatgacatcgagtgccatgtgaaactgaattttcacctctgtgaatagacttttagcccaggttttaatgcaagaagctgtgcgctgtagcttgtgatttatgtggcgcattggctctgtgtgcggggatggttgggtccaactagccttgaccatgtccttgaaacccgaaatgcgtgtccaaaagttctcaaatctaaaggggcgcggcttgcacggggcagcgggatttgaaagaacgagagggcagtggtctgatggccctgttgggagggcatgcaggacatggtgatggaaggcgagatcccagttctcattgcagaaacaatgatcaagcttcactagagtgggcctttgacgctcattactccaggtgaatctcttgttttgcaaggggatctcgcggagttcacatcgatcgattgttgctcgaaagcgcctcatgcgagctagattaaggttgccattgtttttgtcccttgctcggtagatcatgttgaaatccccgaataggagccacccttcgccagcattgggctttagccgccttatgtgcctaaggaaggcatccttaagccggtgtctcgtgggcccgtacaccccggtcataaggaaggtagcccctgtgagtgggaccatcacttgtgctgagatcaaaaagcggccgattcgaatatcttgtaggatgagggcagcattgttccaaaggatgataattccccctctcgtgcccgtggccggtttgaaggcaaagctatccaatttgtagccacccaggaagcgggtgaggccgtcgtcgatgttctgaagtttcgtctcttggaggcatgctaggttgcatttcgtatccaacatcatctcgtggaccgtgttgcagcgtgctggcgaattgagcaccctcacattccaactaatgaaatctaggctgtgcgacatctgcaaaccaaaggtggactcttgattgggagagtaggcccagccggggttggagcacggcctgcttggcgcgaaggaggggaaggggacttgggccgagaagatccctcgcggccataattgcgtcggcctcgagtgtcgttgcacgcgcagcccaacgaggcccaagatggaggacggccttagaaggcgcgtggaggcccaagcgagagcgcgaaggcccaagcgaggcctagcgagaggtaaggcccatggctggggagccgctagcgtcgtcgtcatcatttctgccttcgtcgcggcggcgcacatacacacagacgccggcggcagacgaggcgcaacgcaagcggggaaaaagacagcgcaggcggggtgaagcaaagcgaagttctgaccgacatgtgctccaagagctgaggttccatagaaatgctggggaggcggcacgcaggccaccggcgacacaccagctgcaaaagaaaagacgacgacgatacatggaacgatgacagctccgaatccgacgatacatggagcgacgacagctccgaatccgcgcgcacaggcgctgctcaagcgaacgtttcttccactttatcggccacatcagtgatcccttcgtccacaagagggagcagagcggcatccatggcgcactcatcatcgtcgtcgaggccgaagatcgccgtcaaggcggcgatggcgtgcggcggcaggggcccatcaaacatggccatatactggctgagaatgcgctccacggaggcatcttcttcgtcatggaggatgcccaacctcctgaacagg

SEQ ID NO: 5150 - DNA, 2585 bp, Oryza sativa
aggcatttgtctgagataattgcattgcgtgtcgcgcttgcgcgatttatctttcttcttctgctactactgctatatagcatgcaaaaatgtttctttcgctagcaatcttatgtgtgtactataggagtaggtgttctaaattgttatatttttgtatacggttatcctttatgaacacgcagatgacgagtccaatctaatccattccattaaaccatggggacaatagaggcatttgtctgagagaacattttatttattttcttgccgattttcctttgttctgtatgtgattcttctttatgatcctgtattggcatataggtaaccttacgtttatctgatttatttgatgataaattcctcctactcattctgaatgccaaatcctgtacatttgtttctttcttttcatatgtacgttagtcagtacgttagtgttctgcttgctaaatcatgaacatgattcagatccccgtccaggactggccggggtacacaaacgacaatgttgacattcagatccacgtcttacaaacatcataaaagtcttacataaatgcagcggaaaaacaaaagataacaggagctaagccttgacttgaactgcagcgggaacaccactccacaggcatcctcgacggcacggacgaagcctactccttggagaaaccaccatccgacacatactcgtactctggggttggggaaaaataaagcaagactgagtactatccataggggtatgatgcagggaattatcaaaggagagctagagtggttcatttgcataaagcgagcatttataaacagaagttgaaagaagaaaacagtcgtaataattaatcaatattaatcatccactgtccaacgctataccacgttgcgacaggcccaaccatccacctatactatccaatttcaatagactaaactagggtgagactaatcacggtgaatctggttgaccgcccataaccgcgggcacggctattcgaatagttttactctgatcagaggtgtacaactgtacccacaagacacagccccacgacatgtttccatgccccgacatgccaccacgacataccggaaagaggccgtgacaggacccttcgcataaccccctctaaccaagcacaccacacctcaggtttcactcccactcctcgcaaggcagcgggcagtcccctctcgtgcctaggtgaatccggaagcgacggaggctgtcgcagggcccgccccgctccatcacgcccacccttgtctggatgcgtcagctagaggaaagctacactacaagcccagccgttgcccacgctggcttgtggtaagtacgataagttcttccagggcatcccgcgaaccggtccttaactgatatgggtgcgactagcaaaactatgcacccacaacccaccatgtgatttattttaattaaccaacaccaaagcggtggtactaaaccaacattatcatatgaacctacagtttatattttaaatgagatttccccattatgtgctagttgaactaagcatggctaagcaactcctagtccaacgtctattcatgttataacccgagctaacaaaggagcagggtaccaaaatagcatggctgtaacaataggtaaacatcccatagtaacattataaaacaatgcagtatttgaagaaaaacaatagagcatttgcaatataggatcaacatgttcaaatgacaggcatgacttgccttgctctgcagctggaggaacctcggcgactatctcgaagtacaccggagcgtcggaagaaccggaatctaggcgatatacaaagcaaacaatacaaacaggctataagactactgaaacaaagaacaaaaccatttttaatggattctacatatttttcttgatttactgagacttgaatgggcttaaacggagctcggttgaattagttatgaattttagaaggttcactgtgttttttactataacaaaaagtccttaaatcatttattgcgcaataattcccagggctgacgtcatcaagggggggcgccgacaggcgggtcccactggtcagtggctcaggagagaggggaaggggcgccggcacgcgggccccactcggcagtggctcaagggggggggtccaccgtggaccggaccacatgggtgatccaccgccggtccacgtaaccgacggcccagatcggccccgagccgatcgggcggtggcgatagaggtggccgccgggctcggctcggcatcaaagtcggtcggccggccagggctagcggcgacgacacgcggccgacggcgacggcgacggcgaccggcggcacgggaggcggcggtggcggccgaaggcgacggcgcatgacttgaagcggcggcgcggcactaggagggagagggaggggagtaaaggggagaggacgcctcatcgagggtggccggcgcggaggaagacgacggcgaacggcgacggcaagccacgggaggacgacggcaaccggcggacgggcttcggggtgccgtaaggaaggaggagagagagattagagagagggagatgaaccacggcgg

SEQ ID NO: 5151 - DNA, 4740 bp, Oryza sativa
aaacagccgcggtctcattccactcgcgcagctcctcatcaatggcgtacgaggtggggatgaagatggtgtcttcctccgggcgcggggccgggtcgccgagctgcgtcatcctggttgcccgcgttctcggcgggggcggcgaaagctggagcggaaaggccgggcgattgcttgtctgcagctcgcgcacgcgatgacggggagacggactcttgcgcaggcgacgcggtgacgacgagcgaggacgcgaccgcgggggcgtgcgagcgcccaaccgcgcgcgccgaagcggggaccgagagaacgcacgcacggcgcgacggtgccggcagtcacgcgcgcgatgtccggaacgacggcagttgaagcagcagaccgggtccctgtactgcgcagcgtggtgctctctgctgaggcaaatgaagcatttcccacttgtttgagcccagaacgcacgatacgaagaggagtaaatggggcgctgtcgacttgaaggcggaggtaggcgggaggcggatgaatgctcttctctacgccaccagcgcttgcgacgcaccggaatctaaggcgaatccccggagatatggccatccatcttctgctcggcgacgtgacggtgaggaaggctagtgacgtagggagtactcctccgcggcggagtgacctctcgagcagagcggttgttgcgccggacagtggaggtaaaagccaacttgaatagggggcgtggcggagagcgcgtgcggctggtgcccaaatttgaatttgggaagccctgaccacggacagcatcagcgaaggaccggcgagcggcagcaggtggcggatctggcgtctctgctaccatcgaggcgacggaggccgaagggggacgcccaaatctgggcggaggcggggacttcgggcacggctggaggacacttgcggagaactggcgtggctgggaggagcttgcggagcgctgggacgacggccaggaggcggcgaaaaagctagctgggcgtcagaggatacacgtgggcggcgtcagctggagtgccgacaccggcggcgggcgcgggggcatgctgcttacctttttgccgatagatatacaggttattgctacctgctattctgtcgatatgcaagtgttgaagtgaagcctgaccagcttcactagctgcctgcttatatgttgccctccacagcctcacagctactagtagcagaaaccaatatctcgttgtggcttggtctgccaacgcgctacgatagtttgtgggtaggcttgtggtgaactggtgatcagcctagagtttgaggcaggaagtggcgccggccgacgtgttccaacatgcagtaagacgcgcgcgtatttaagactcaactctctaaatattttaccgataatattttattttaaattaaattttatttgatagatgacatttgaatttactctcgtataattgtggttttattgctacaaacaatcgtattattcaagaaatttaaagccaaaaactagttttaaaaaccgtaataagtttgactgtgtcttaatcaataggaggaaggaagtatgtagcaacattacacatgcttagagcgcataaggaagaggagatcgagatgaggaaagaaaggagagaggatacggaggaaaccatgccgttcactctcaggacagtcccaaccctccacttaggatggtatctatagcattaactacattgacatgtaggacttttaacttatgtggcactatattaattaagagagagagtgaagagaggaagaaactaggtctcatgcaagacacagcttcaacgcgagaacctatgcactagacactatcaagttttgcgttgggagataatagtgtcttcataatatatgaagaataaatatgattggtagagaagagagatgatgtatttattactgggccactttaagaaatcatgggttgtagagtgtagtttttattgtgatgtcttattgacatggcaccatagacactgcttatggacactatgggttgagactgccctcacagcgtcgccattacgccaagcatagtatttttttatgccattcacgactgcaactaaattttactgttgtacacttcttcatacttatgtaatattttttttactcccataatcccattatattcaattaaattagcacaattctaagcgccgtttcgtgaaaaaaaaagaaaaaaaacggagcgccgcattcctcaatttttcaacgacgtttgtcagtttgcgacgacgccgttggaccaccgggatgaccgagcagaagcatagcttgggcgtcgcgtggcccggagcccccatctcccccgactgctgtgacgtggcccaatggcaccgttcaaaagcctatccggcagcatggcccatatataccagtataccaaccaccacaagagaagccaaggccgcattccctactacgagccatacagacaatgccgaaatcatggaggtttaagcagccatggccacccaaatctcgtctccaacaacaccgggctctaactttggcactttgcatcattaatgtagaccagctctagcgaaggtgaggtactaaccacagaaaagaaaaaaaaaaccatgtacaatgtggtgcatatatacctacattgaatatatgccatcagttaaccgataaaaaaacattaggttgccagtttctggcctatgttgcattgtcatatgtttgggtggccatgcatgaatcaaccggtgcatattgttgatcagtattgtgtgttgaactgatggactaatggactataagtcgccatgcatttcatccattcttttccgccacaaaaatgcgtgcaatctgcaactgcaaaatgcagagtgatatgaacgcaccaatgtgcgtataaatgcatcggcatcttcctaactgcttatatataggcatagccctccacagtgcacacatagtatagcagtaaccaattaatcaacctagcttaattacatagacgagctagcttaccacacatggcgtcttcaacctcgagctcgctcgccgtggcaacaatggtggccgtcgtcctcctcctgggtgccaccacccaggcggcgcgcctcctcgacgaactcgtccccggcattccgatgccgacgatccccggtgtaccggcggtgggccccaccatcccggccatcccgacgatccccggcgttccggcggtgggccccaccatcccgaccatccccaccgttccgacgatccccggagttccggcggtcggtcccaccatcccggccatcccgacgatccccggcgtgccggcggtcggccccaccatcccgaccatcccgaccatcccgacgatccccggcgtgccggcggtcggttccaccattccgaccatcccgacgatccccggcgtgccggcggtcggcccgactatcccgaccatccccggcgtgccgacgatcccgacggtgccgggagtgccggagctgccggtaaatcccggaggcgtggtgccgacgatcccgaaggtgccattgccgccggtgaatcccggagccgtcgtgcccgccgtgccagctctgccggtgccgccgatccccggagccgcggggggtgtcgtgccgaccctgccggtgccgccgttgcccgccgtgccgggagtcccgctgccggaggtgcccggcgtccctctgccgccggtgccgtccgtcgtcccgcccgtgccttaggtcaactccggcgagccccgtgccgtcgttaattaattactccggccagctgacgtgtacgtggcattgaccgtgtgcgccatgcattggccgccggcgccggcagccatctacagattaattacgtacgtgtgttaagtagtaagtacttcctccgtttcacaatataaatcattctagcatttttcatattcatattgatgttaaagaatctagataaatatatatgtgggaaatgctaaaatgacttacattgtaaaacagagagagtacaaattaagatgacttgcatgtacgttgttacgtcaagttggtatagtatttgtgtaatgaacgtgtgtgtgtgcagaccaggtgcagtatgtgtttgtggcgagtggcgacaaatgcgtcacgctctgtatacgtacgtgtgcaaaagcttaacgtgttgcttaaattatacgtgtcatgttaacaaatatatatttctatcaccgttttaattgtgtatatctttgttggcaaattaccacgcatgcaatcttagtaaaagtgccccttaacaatattgtttgggatgacatatgcgccacttatttcaaaatttacatataatcatgtgagaaatgaaagcccatatatacttggacttagtggcggacgtagctatagaaaaaaagaatgtgtttgatgctcattctataaggataatcgaacacaacatttatattataatcacataaaaaagtataatataatcaataaattaaacaaacatgaatatttaagatggtacctaatctttgagccgtaaatagtaaaaaactactcaaatcttaaattagaggaagaaaagaagaatttcccccgggaaaaaaaaggggggaaaaaaaaaaaattttacccaactgatcacttgttgctcatccgtcaatcaaattcaagttccactatacaatcctacgataccttggttctgaacttattaccaatgacacttttcccatcaggcatgcattcg

SEQ ID NO: 5152 - DNA, 2631 bp, Oryza sativa
tggcgagtggcgacaaatgcgtcacgctctgtatacgtactgtacaaaagcttaacgtgttgcttaaattatacgtgtcatgttaacaaatatatatttctatcaccgctttaattgtgtatatctttgttggcaaattaccacgcatgcaatcttagtaaaagtgccccttaacaatattgtttgggatgacatatgcgccacttatttcaaaatttacatataatcatgtgagaaatgaaagcccatatatacttggacttagtggcggacgtagctatagaaaaaaagaatgtgtttgatgctcattctataaggataatcgaacacaacatttatattataatcacataaaaaagtataatataatcaataaattaaacaaacatgaatatttaagatggtacctaatctttgagccgtaaatagtaaaaaactactcaaatcttaaataaaaaaatcgaaggaaataaccaactgatcacttgttgctcatccgtcaatcaaattcgaagttccactatacaatcctacgataccttggttctgaacttattaccaatgacacttttcccatcaggcatgcattcggactcaatagcctttctcgccctcagccagcggcagtgattcagattgtccctccatctccatagattgcacccatagtttcgctcttgttaaaagctcctcttcagagaccatgcatgcgaggaatgaatgaagaaagtgaaaaaaacaagtcacaaacaaagtctcatgcgattcgattggaactttatgggctgacctttgtcgatcgaccgagcctacctaatgggtaaatctgcccctgcttggcctgtgaaatatcttgcacaatatgttaaatcgagggataagttattttctgatgagattgtaatattgtatgcttgtataaattattcttgatcatatattgatatatagtatgccattaattagctaaccagttgaaaatttagcttattgctagaatgctcgtttctggcctatgttgcattgtctcttatgtttggatggtcatgcatcattaattcctgagtatatattgttcaactgatggactgtaattctttccaccacaaaatgcgtgcgatgatctgcaactgcaaaatgcaagcgatgaagcaacatgcgtaatgcattgcatgcccggcttccctcttctgcaaactccttatatatagccctccaaactccacacagctagtataccagtaaccaaatcaaaccctagctagctagctagctaagctagcacgcacccatggcgtcgtcttccacctcgagctcgctcgccgcggcagcgatggtggccggcgtcctcctcctcctgggtgccaccgccacgtccacccaggcggcgcgcctcctcgacgaagaactccccaccgccgccatcccggcgatccccggcgtccccggagtgccggcggtcggccccgggatcccggtgatcccccgcgtgcccggagtgccggaggttggccccgggatcccgttcgtgccggtgatccccggcgtgccggtgatcgtgccgatcatccccggcgtgccgatgatcgccggcatgacaaccctgccagtgccgccatttgtgccgccgattgatcccggcgccggcgccggattccccggcgtgccgccggcgtcgtcgaccaccgtgcaggaagacccacagccgccgatgccgtccgtcgttccacccgtgccataggtgttaatcaactccggcgagccaccatgccgtagttaagttataccgttgctcacgccgccgcgatgtgtgtactccggcggcttaatataacgtgcctccttactgtgtgttaattaagtactcctcctgtctaaaaaaaattaacttctctatgaatttatagacgtagttagaagttgattttttcttggatggtaagagtacatgtgttaccgtgtgttgttacgttaagttggtaatttgtgtactgatgaatcgtgtgtgtatgatgtgcactgtgcagtgcagaccaggtacgtacgtgtgggtcgcgtcacccaatctctgagtgctcgcaaaatttaatgtgcttaatgcacgaattaattatacgtcgaatattataggttttaatttaatcttgtgtaacccactattttatcactgtttgaactttgaatcatacgtgtctatttttgttgggatattagtcttgctaaggtgcataggaatgaaaatcatattagtcatgttttagttagtaaaggccgagttgaggaactactcatttctggccggacaatagctgtactgctatcgcacaactttgtttgtgtcgatgctttgattgaataaagtggtccctgtttcctccaaaaaaaaaaaagaaaatcatgcgtgcttatatgtgactgttaattttgggggcctagagcattccgggcaaaccggcctgaaatttacagcccaaaacaaatgttgggctttgcctatgcagcaatttttcgggccaaaacaaacaaccatgcatatgctgattttttttaattttttattaaaatatttacaaaactaattccatgtttcaaaaatttacaatagtagttgcccaccaccctctgatctgg

SEQ ID NO: 5153 - DNA, 5092 bp, Oryza sativa
  unsure (1)..(5092): unsure at all n locations
aaaatggcagccccctacagccggccgctaggcatgagccaacggccatctgccacaacacgaaaatcgctatttgggagggctatttctaaaaatcgtcctctcaaagagcggcgggtgactaattttgtaaatttttgaaacacaaaattagttttgtaaatattttaataaaaaattttaaaaaaattctgcatatgcttacgtcgtcgataaaactgacgaaaatactcctttagaaaaagctgacacgaacaaaacggttcaacagattgaagctgcacctaaacaaagaaatttcgatccacggatggtacggagtatgcactaacaaataatcaaaacaaaaacaacctcgtcgacaatatatttggccgatcgctacaactaaatctcctgccttggccacacaatttcagaatttatccttttgttattattccttttgggatcgatcgatgaacatcctagcaagcagccaagcatatatgagttctgattaccaaacatgggcgattaaagaacaaatttgttgcagctgcaacgacacaccgttctggccaaccaccgatctaaccggatatatattcacttaattagccttataaattgcgcacagattggctcgtgttcttcgcactcactgcaagaacagattaagaaaaaaaaacacacacacacacacacaagctagtcttgctgcaatggcttctagtgtgagcttcatggccacggccatggcgatggcgtgcgttctgctcgccgccagcagcagcagaacgtgctacgccgcccgcatgttggccgacacgccggcgacggcggcggcggcggccgcgcctcccgccgccctccctgtcctccccgccgtgccggcgctgcccaccactctgccgcccatgccggccatcccggccgtgccacaggcggcgctgccgccgatgcccgccgtgcccaccgtgcccgcggtcgtccctaacgcggcggcgctgccgccgatgcccgctgtcccggccatcccggcggtgccgaaaggtgtcgttgccaccgatgcccgccgtgccggcggtgaccctgccgccgatgcccgccggcatccccgccgtgccggcggtgacgctgccgccgatgccgtccatcccgaccgtgaacgtgcccatgccgttccaggcgccgcctccatcggaataggcagngnggcgaaccagccgtgccagtnnactgcggnggcggngnnngnnnnnnggnnncagtaggtaaantaagatttttcatgtgaaatttctcaatgtttgtgtgagtgtgttatttatttcatacttagtttgaattcttcttgaaattggggtccaaantagggttagnaattgaaactactagtgtgcttggcttaattgaagtgtacattatattttgggtacgcacggtctcaacgcatgtgttgaggtcgtgccattgtgttttacgtgtacgtgtacgtacggtttatgtatttgtttttactttcatactttcagagattatatatatgttactttactacatttcatttttaaagttcacaattgtactttcatgtttgaacattttggaactttgatgtaatctcgtgggcggcagctacgcagagaatatgacatggaaaaaaaaagtactccacttttcagttcctgacgcaggtcacataatccggtgcagcaaaatgcagcgctgcagccttgacggtctaaggaactgaaacgactaaaaaaaacaaatttaactaaaaagcttgcggcgttcttgtgtagttggattgtttttttttctattcgcgtagtcgaatttgactatgaaagcctgtttggtacagctccaactcctaaatattgctccgggagttgagtctgaagtggagttggagctgccttaaccagctccacaactctagtacattttgtgagagagctccacccaactccactctcagttttggtggagctgaaactgtttggctgagctcccgctccaggaggggtggagctggagttgaagttgtgccaaacagaccctgaatttagtcccggtagtatagtttgagaatttgatgaaaatagaggcttgcctagaaaagttcatgtgaaaatgagaaattttagaggtgtacatagagacatatcggtatgtatatatgtttataggggtgagtatgtctccgtgtatattaacgtctgcttgtgttacaaattgtttttacttctaaaaaaatatttttaactgttagaagtacttccagaagacactctttttgtctgtgagaaaagttgggctgccgccgaaggccgttttccatttcccggcccattaacgaaaggaaactgatattatagcccaacaactggatcgcactgctagttggccttggtccccttctaaaagaaaggaagataatctaccggtttgactgctttaaacacataaattggcataaactaatactgtgaaaacggtaatggaaatacctgactgcctgaagttcatttctgttttttatggaccgagccatgtagaaatgattataccgataaaattgaataaaaatgataaaaaaatggaaatagaaacggaaacgatattgatattatgtgattatgtcaaccgtttccaaaatctaccctgttctaacggaaaataccatttttatattatagtaattatcatatctactccaatatatatgatccatttctttatttgacccatagtttgagcatcatcaactcctcaaccaaatcagtataaattgagtgtatggttaaatgggagataaattgtaatatgattacttagtgtgacatttgaatttatttccaatattatatagtaaaactagagccaaatcttaataaaataaaatttgcaagcaaaattttctttggaccttagtgaccacatcctatggatgagatgttgctgtcagcaaagagcttaagctatcttagttctttgtcttcacaagaatggggacaccctgcagatcttctctgaagatgagaaggcactgccctgtaatctacatctgagctcccattggctcaaactcacctggctcaagatcacaacagcacagcctgcatcccaagaagaaaaagaaaacttctttttttttctcatcacaagatcacaaaactgcagaaaggaacagggaatggaaaacgtcagaatggaatgatccagaggggctagactagtagtagtagctagataaccccaagccgagctagcaatgatccaaatcccacagttgctttcctatggctttggatgttgggggcacatttcgttttcagattatgcccagatgcaagtagagcacatgtcgtttcaaattattccgaaatattactgtcttgaaagagatgctaacttcgcattgctccaaaggaatcgtatgctcctgtgtttcgtttcagaaataaagaaattttggttttttggcgcaccgttttcagattctttgaactggtatgattggaatgattttgcagccgattccaagggaacaaaactaaccacttcttgtcaaattaaaacttgcacttaaccaatacaatcatgagagtgatgacatgtttttttttgggtgatttcagaaacagaaccgtcagggtcactgttggtgagtttggtctcatatgatgaagtaagctgaattgaagaagggagaatcatttctggtcattgccctgccccccatagaaagaattttatgcgtatctccaatgctagtggtgggcaatacttggcatggtatccatcaaggcatcaagcaccattgctcatcaattttcataaaaacatatttatcaactacatactacctttctaaaacaaacactaaaaatatgctttgactctcaaaaaggtttcaaagaacattttatctaaggatcgttcctatgcttcaccgaaactatatagctagacaacatacaaaattagctaaggtggagctggtatacaaggcctgcgtagaggtcggatttaatccattgtcttaaaaaaagtatacaatgccttgttattaaaaagtaaaaagacatgggagatcctaatatataatgttttgtaaatatttcttcaagatttgtttatggtttagtaaaactcctcgggaaattccaacaatattttgggaagataccttgactaagaaaaaaaatccccaaagaacaaaaaaacactctacctcaggctgtcaaaaacatgccaggatgggcaatgtgatgaatagtcctattgaggtctctttctgtagagaaactatcgaaaaactaaatttatggcttggagcaaactcagttcagagtcatcaattatatgtttatcgcaacagtgagatgggaccaacatcagaaaggagagaagatttcctgtccaatctgtttacatggcattgatgcacaacaatgttcccaaataaaccagactctatggcatcaacaaatacctccaaaaattacttactagcatttttccaatgcttcctgtgtaggggtctgaatttgaccaaagataaccaatggaatcaacaggctggtgcagataattagctacctgtttaatagatcatcttgatcatttttttgcaaagaattaactaccccagctagatccacatcagtcaaattataatccagtatgaataaagtatattactacgacatcaacatgcatatgatgcattgatgcatacagtgatacaggcttacaacatcagttacatactcttaggctgtgtttagtttctaaaattggggagaagtttggagaaagttggtagtttgaaaaaaaagttaggagtttatgtgagtagaaaagttttggatacgatgaaaagttggtagtttggggaagtttggtgtgaagttaaacaggcctagataggagaagaaagtacagaagcagaaaccattagtttacagagccctaagcttgcagcagcagcagcagcagaagtagcagagaagtgggagagcgatgtatccattcctgcaaatccaagttggcaattccgagggccgacatatatcccactccaaggagatccgac

SEQ ID NO: 5154 - DNA, 17221 bp, Oryza sativa
tgttcccttctcaccacctccaagtacgctttgcgggacactcgcggcagcaagagttcgtatactcgcctctgctgctgctgcactgccgcgcctaaagctgagcaagaagaggagactttgcagcaagagttgctactgtttggtttggttcaggtgagagaggtcaacaatagctgttggcgtggctagttgcttgtgcagaaaaggattctcttttggttttgccctttctgagaagctgatgatgatgtggtggtgggctatggttgtgcaggttggggagctactagaagaaggaggaatagctaggttgggtagctcagctttgctctccttttattttttatttttttttctgtttgttccaaggtttcttgcatcactttgcggcttatcttgttggttttccttctattttaaggtgtaaagtttgtctccttgtcttggttgtgcttgctgttcttgtttgtttcaaccaacttgtgcagttatacttgatgcttaatgcttctttttttttctttttctatgtggtttatgcaggttgtgaatttcttggggggacacaagaatcgtgggatggatggcaatgcgagatcggcggcgaatcagacgaagcaaatcgtgtagagatttcatctgaaacccaagaacggattcgtcttgtgttgttgccgaatggtagtgacctgacctgactctgtgtgcatttgctccaatggcgatttgcagcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgcggtgatcttttttttttcgttggctgtaacctgcaacttgctatgcttgagatgaattcttgaatgaaactgatgagaaatttcaggatgctgaatgcgaggcaaccgaagagaccaaatcgtcgtcgcggcgatatggatcaaagaggagaactcgtgcagctgaagttcataacctgtcagagagggtgagatcatcaaatacagctactgatcttaagagataaatttttagtagtcatcctaaaagatgatactgatgtagagaagaagggatcggatcaacgagaagatgcgcgcattgcaagaactcatacctcattgcaacaaggtaagaaacattattatatatgcatcttttttctgatcaggtgcaagtccatggactgatacagctatgttggtgagtggtggcatatctgatctatcctttgttgatatgattctcttttttattcaaaccttttgggtttactttactaactgcagttatctatatatttttcaattagaccgacaaggcatctatattagatgaagcaatcgagtatctgaagtcactccaaatgcaagttcaggtttgaactactgtttcttgtatctgaacttacatggtcctacatgaggccaattactagcacagattgagattgtcgaatctgtgcctcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggtacaaaaataccatactgacaaagggaattttcaggcctctttgattgttcacctagattaggcattggtcatttgcaggtatcaggaccatatgcttctgggcctcaagtagcacagcaaaaccagataccgaaagcgtcagctagcactgttctgccaaattctggggctgaacaaccaccaacctctgatggaatttagaatgaccagaaacatgtaagcacttgcaccaatcagtacatctgcctatttacttcaaatgatgttgagataactagagctgcgtatcgctacttgtatgtattactattgttttcagccaatatatctgtattgaacacgatcggcaatttgtgccgtcactttttgtcagcttaagctttcagagcaactaggtaacatgaggacctatggacttacccatatcatctgtagtctgtttgttgagctcgaaatgcatgactagatgcatagaatatgaagccatcatcgtccagcttaaactttcacagtaacctgttagttcatgcaagctaaccagttgttttcatctgacctgtcatatgatggactagtcggtggctccaatctttttggtttttgacatcttctagcactgtccatgaaaattaacggttgtatgtctatttcagcgtcacgctgttgcatcaaatagaccacatgatagcaaagagttgctggtggataacttcagaactattatttatgatcttcattttcttgatattacaggataaggaattcaatgtaggctttgcacaaagggtcgtctttctggagatagctgaaaatattgacatgatgaacagattgcatccatattgctgttatgtatctcaatcagtatctgtctgacataaatgctacaagtgtctgtaaatgcacatagcatttccccccttccctaagatgctaattcccagtgtatgtactaataatccttataatatgaagtgccagtggcaatctttgcccttctttatcatcctctctaaattcttagaaatgtctttccttttctgggaggaaagaggaaatgttgaaatacttgttaaatgacaaccatgcaagcaacaggaaggcacaaaagaagccaggtcctacatgaactcattggataacaaactgacactgttcctgttctttaaatccaaagtacagctcaatcagagctcgtcttttcggccagtgctactgctggtgggcaaccagcatatgatacatatcttatctatgctttagcctaacacgactttctgtttgtggaaagatttggtgaacactgattgtctgattgtgtctgactgttgcacaaacgagccgacacacttattgccaaaatcttcagcattctggttctttgtgactcatgcagcagcagcaggaacaacaactgggagagcctgaggattatgtctgggaaccctaccaccattgcaaattgccatcatcccagcagaaacctgaaggtatacaggagttgccaatttctttttttgcctgatgttacagcactcaagtgcaggttattacatggtcctacctgcacatgctatggggggtccctgcacattgcaactggttcataggatcatatctactatctcctgagctttttttttcctgtctaccacaatgggatcccctggcactccttgctccacgcctcgccgctgttgctttcgcctttccgttattcttcgggattgaacagattgtcgcctgcgtcattgcagcgtaagaggaggaggaggaggatgatgcagccgggggcacttgctgagcctggacagtgatgtccatgtaaatgcaacctctggcttgtattgccggaacatgtacagtagaggtggtgtaaaacactttgctgtggcgttttactgctgtagttacttcttttcacctagttggcaaagccaatatatggccagcttatggaagtcctatttcgcaatcagctgcgagataaacagtttgcgatcactgctttgagccgttggatcaaccgtacattgacttcgaagtggaaggggggaaacaactcaggctcagtttaaaatagatttttaaaatagattattgaacggattgttgctgtagattatctactttattatagggataattaatcattttgatataacagataacttaaaacaagtggttaagcaatcttgtagatttttttttgataaaacatatttttcaaagcatggtgcaaataatccggtgaatagtctgaaaggaattaagtgtgccgtgtaatatgcgctcccaaaaggccatattgccgtaagcttcccttaagaacattgatgttttgttccataataacatgaatatctcctacatcattttagatgaaaaaagtagactcgttgatgttcatgtcagcatcttgtgtttattagggttctacttcagtcaccatctacgagcactagaatctgggatcgtatcctgtttcacatttataggtggagatttggagttcatgtccaagttggttgcatctattatctcttgttgacccagtcctctcaagttgtgttagtactgttgttccatgctaatagtgcagactgcagagcaagagaactgattgatatttcttttgttgtgataaatatagggctaactgcttgctgaattatacgagcttgggcattttaaaggaaaaacgagtggatctatatacaattcttattttctactacctctattccataatgtaaggtatggtcaaactcggcacagtatacaaaactattttttgacttataatttcttatatactataaaatttgtagcaacaaaattataaccatatcaaagtatattgaaatatcaatccaataatattattttcaacaaataaaattcaatttatattatactaatcgttagtgagatattttgaaagttaaatcttgaaatatgtgtgtgctttacattatggaatggagggagtacttctataaaaaaaatgcaattatgatttctatataaaactagaaatagagtcagatttcatatacaactcttgaaatagaaaatagaattggatgtcatatacaacttttaatttcttttctgttacctgtagtttgtatacaccatacttttaaaagtggaattagatatacatctcttaacttctcgttttatagataccaccaaccaatttacaccgctatattttaaacccattatgacaatggtcatttttttttctaaaattaatgtgagaatttctaagcaaacttggtgactcttatttgagttaccttaataataaatccaacgatcaacgttaattttagttatttatattttatttttttccttggatagagaacacattatttatttgattgagaaaatatggaagaactataaactcgtagatgtcaaaggacacagtaggaacaacaatatagatgtcacgatcagcgttcattttaattcctttttctttggataacgattaacgaacacgttatttatttgatagagaaaatatggatgaacatagtatatacaaaaagaaaaaaaaatgatttgatagagaaaatatggatgaacacagtatttgatagaaaaaaaattggcttcgcccggactcgaaccggagaccttcagtgtgttagactgacgtgataaccaactacaccacaaaaccaagctgctggtaagtccaaattactttaaataaattatccctatgggccagtacaacacatgctttagatgtaataaaatagattagctcgacataactactctatttcttatttagttttatcattgcaaatgtacactattacttgaaggtttaattaattaaatccatgcaattgtaaattttatggtttttaaaatctaccactatattcatgtaattggaaccatatcaccatgacaagcctaaaatcgaatccatatcacactattagcttgagacctgtgttaaatattttttctaccatactttttatggaacagaatgcccttctgtctccctgttttaacgaattttttagagacaatactattttaatagaaaattataaaaataggggtcagatggttgaaatcacaactttggtgccctgtcaaacaaccaaaatttgacaaggcacatatcaaacagccgcctattgaaatgtgattgttcgtcagggtagaagaaatacaagtgtaaacagaatatttcaggtagtaagaatatgccatttgacctccatcaatttttaaatatgttatttttagtaataatataaatagctacatcagttatggggtgcatggctgtaatgacatgttcgagaagtatcagatgtcaacgtataaattcaaacttgtgagtcagaaagtacataaagacgcagttttcatcaaagtgtaagttcaaacttgtgaacgacaaagtaaaaatgttcgagaagtatcagatgtcaacgtataaattcaaacttgtgagtcagaaagtacataaagacgcagttttcatcaaagtgtaagttcaaacttgtgaacgacaaagtaaaaatggaaaaaattaaaaagatttggctttgcccggactcgaaccggagaccttcagtgtgttagattgacgtgataaccaactacaccacgaaaccaagttgcagccaagcccaaattaactataataaacggatcattttgtgcctatgagtatgacagtgcaacacatgatttggatatatagaataaaataagatcagctggagttaattactctgttgactgttgcttatttagttttatagttttagataacccactaaaattaggtggacatgggtttaattaaaattatgccattataatttttacggttttaaaatctaccactgttattcatgtacttgaaattatgccatgacaacaatgctaaaattggatcatgtcacagtacacgcttgaaatacattttgaatctcctttttctaccgtattttgttatggaacataatgcccttgtcttcctgcttttaatagcctgtgggtagtcatatggatggcgccggtagtgaggactgagaagaaagtgaggagttcatcctgctcaagcccaagtgccgacctcttattgtccttctctaagggtttgttcgttttggaggaaataataatttaaggatttggacttttagggattaatgtctatgagtgtcatttgttttgtaggattagaagtagaggaaaaccaaaggaaaattttctttcctacatgtgaaaataactcgggaaaaaaagttgaaatatgacatcaaccatgagacaaaacgaaatgaggttcattaccatgagacatcgtaaaagtggatttttttttatccgagcgttacgcataaaatctgagtattatgaaataaaatatttctgaaagcaatttaaaaataaattgaaacgaccattacgccaaaaaaaaaactgagtattatgaaaaatttttctgaaacgaatttaaaaaaattggcttcgcccggactcgaaccggagaccttcagtgtgttagactgacgtgataaccaactacaccacgaaaccatgatgctcgcgattttaccgtaagaactccatatataacaaattccccatttgaacgaaatttacatataaacataagaccaattttgcatgtttataagactatataaatcctccgaagagaaagaaattaaggatctgttgatagaaaaatgaaacgaaattaggatgtggcctctcttggatgggtcggccaggccgaagaaacacgccaagctctctgcattgtacaagtgattcttgcctctcctctgcttcctcttccaccttcccgacgcatttcggccttgcagaaaagtatatgatactacaactgttatttctgatgtttcccatctgaatatttcagatgggctcaaaatacgtgtacggatcctaatttcctgtcatttgttcaaagattctagagatagcaaaaaaaaaaaaaaagacagcttaacctttttcaagaaaaatgtttttagcaggagcttcattcattcgagacgatacaacaaggttaagctgtaatacaaacttttacttatgaaatcatacacatctgtagtacctgaaccagaataccaaagaatctgtgccctcgcaaaaaaaggaaaaaaagaagaagaaaaaaacacctgcgaatggcgtcctaatccaaacttatgagcgtccgtgcatgtgcatgggcatggcggggtgatgccgactacctgttcacagtgatgcatccctcagagagctttcatttttcatctttctgcagggacggagggaattgcttcgatggccctctataacacaacactctgatcactgatcagtacagaatggactaacattccacaaaactgataaaaaaaatcattctgattcaccatcactgccagtgccaaatcccagtatagaagcagaatcatagtcttttttctttttgtgagaactaagcagaataatagtcacgatctgctttcttggatagagtaacttgtttgctgccttgctgagtgctcacaggcataagcataactgacacatggatcagttgttagtgaccagcaaacactgtgcaaaatcttgcaacaggaacatagagatagaactgctgcgcagcacatcacctgcaattagaagaaactgggtctgagattaaccatgcctacacgttatgaacttatgatgtacacctaacaataaaattcattggtttccctgatccttgtgggaaaaaaggggtacatatgctatggcatggaattacaggtgataagatcataaaaggagataaaaaaaattgataacagatattacctaaccaatttctggttcttggaagaaaatgatcaccaacgcgattttcataaaaaatatccagccatctgtacttggtgaatactgagaactgagagcactggttgctccttttctgattccagataactcctgactcgttcttctgaattgcctgtgcaatttctctccacttgctgctccctctagtaacattctgaccctttgtgtccaaaagaaatatcactatcaccctttctgaaataagctgcggcctgacctcataatagtgtcaaatactccatcatgttacaacttacgacagcacaacattgaaaactttgtttcaagcataattgtgctccatcaaccccatccatgggccaacatcgtgaacaatcccctgagaattcaaataagaaatcaaccttgtgacaggttgaagactagcagaagtggaaagagaggccatgagctcattgattatattctggaaacttgagctgaagttactcctgatcgattttatgtgctcaatggccaaatctacttccccaacatctattagacacttcaacaaaatgacgtgtgaattcacactctcaacattagatggaatacaagataaaacactcagtgctcctttgaaattacctgaaatatatcatggatgatattttaaaggagatatttaacaattaaaacatcactaatattattgaagaatcataccttgtttacagagtgcaaggataaacacagttaaatactgaactagccacttcagtatcctgcaccacacatttggtaaagatctccacagcctgttcatatttcttttcttggcacagcatattgatgactgaagtgtatgttgtgacatcaggggacactcctttctggaacatgcgatcaaacagttgttgggcttgttcactttcattgatttctgcaaattttgttatgagtatattgtaagtctgcagatttggactacagccactggtaaacatttcatcccacagcttcttggctggcctaaggaggttttttctgcagagtgactccatgagagaattgtatgatgaaatgtcaggctcaagtctctttcttttcacctcctttagtacatcatatgcctctcgcaccttcccagccttgcctaagaatgatactaccaaatggtaatccctcacatctgtacaataccccttatctaagagcaccctaaaaaattcccacatatcatcgcccttcccattcgtgcagaggctttcgcaaaggtgtataagcatatcgctgcttggaaatctctccttccctatcatgaacttgcagaacataacagcagcatcgacatcaatctcagacactgaacaaatcagtgcattcaacacgtcatcattgatagggaaatcccctaaaacaattgcctctgctatttcctttgcctcgccaatctgcctgctggacaacaatgcaaacataaactccctgtagtcctccttcctaggcgcaaccccgagcttcctcttctgcttcaagatcctaccttcctcttctgtcctccctgcttccctaaacgcctctgatacaactctataagctacaaaatctggcttccacccttgaaacctcatatcctccaaagcttgccaagcatcctcaatcctcccctcccgacacaaaccatcagcaaccattactgcaacaactgacctatcaactcggtccccttgatggcgcactgcctgcaccaaccgcagaacctcggccaatccatgcctcctccccacatttttgacgaacaccccgaaaccaaccgtgtcaagctcgacggccctcccgatcattctgtcgaacaccttgcgcgcggaaacgagtgacccggaggacgcgagcgccgcgagcagcgagttgcaaagcggcgcggggagggcggcggagtcggggacgaggccgaagtgcgcgagggcgtcgggaaggcggccatgtcggagcagcgcggaggcagcgaggacgcgggttgccgggaggagcgggagccccgcggcgcgggcgcgggagagcgcggcgaggatggagcggagggtggccgggtgggcggcgcgggaaggcgccgcgagcgacgcgaggtgcgcgtggaaggcctgcggtgtagaggtgggcgcggcggcgtggggagacggcggcggctggccggagatgccgcgcgcggcggcgagtcgcggcgggaggaggaggaagcgcgaggtcgctggcggtggggccatggtgtcagcgagagagaagggggcccgcaatgcccaccaagtagtcctcaagcggaaacacagaatacgccaaccctacaagaaggcgtaaaattaaattacgtaaatgatatatcgcttgtgttttctgggtcgcggccgcttcgagatcccacgcgcttgtctctttcttcttcttcttcttcttcttcttcttcttcttcctcgcgcagcctccaaattctccaaaaccctcgcgttttcccgcggcttcgcttccggggagaggagattttcaaaaataaattcctcatccacatcctcctcttcccctagctcctaggcagggtctcgtctcgactccgaatcttagggtttctcctccccgctccccgccgcgggcgccatggaggcggtggtcgtcgacgcggggtcgaagctgctcaaggccggcatcgccttgcccgaccagtccccatcgctggtgagcggccagatctcccgctcctcttgagattccgttggttatttgagaattatctgaggttttttgggtttggtttggttttggttggttggttaggtgatgccgtcgaagatgaagttggaggtagaggacggtcagatgggcgacggcgcggtggtggaggaggtggtgcagccggtggtgcgtggcttcgtcaaggactgggacgccatggaggacctgctcaactacgtcctgtacagcaacattgggtgggagattggggatgagggccagatcctcttcacagagccgctcttcacacccaaggtgataggcttcgtggttcatttgaacgtgttcattgttctacgctgtaaacctgttgatttggctgataactggtccaaattgatactcactcattactttacatgccgaaatgttaagctccgaatttttagggtcatttggtatgtctatgaggtgcccatagcgagtttaaacactttgcgtctaacttgctagctatagtctctaggctaactgccattatatggtcggattttgtcctaaatttatgtttcagtcaaactcttgtgctattttttggttatttgttgaatagctcaattgtaaagaaaattctagttttggaccaaatcggtatatgctctgcgttataaagtttaaatctaactcgattttaacgtgctatgtgcattataaaatatttaaaatttaaacatgtaatatttaaacatgtcctattgaccattgttcatgcttctgctcaagcaatgtttgttagctaagctgcagttgttcctgcatatcatttcaaaattacgatttactgatagatatgctacctgaatatcttgcattccttctagtgaatattttccagacattgatattgcacgaacgggaatgggtcctttgctccttttactagcatatttagacatttcatgattgtgtgtgattgcagtgctgtatcttgtgttgctctatgtaatcttgatggttgcatgaatccatagaccaaataaatgtcagtagtttcgaaaagccaagctgtgctaaagggaccctaagtatgcttcgccgttttgaacttcaattcaaattctttgttactactttacgaagattgtttcatttgacttcgctcattatttttattgtgaatgcgttgatttaactattattctgttgtttcaaattttgacagcatgtttcctcatcttttgttatgctctctccaggcacttcgggagcaactggcgcaacttatgttcgaaaaattcaatgtttcaggcttttatgactctgagcaggctgtattgtcactttatgcagttggacgcatttcgggctgtacagtggacattgggcatgggaaaatcggtaatataaccctacttttgtttgagccaatatagtagtatgtttttccttttaaattttgtgcttatttttatttggctaaagatcatgctttgctctgcattttacttccttatgcatgaactcttgccatataagcaaaactaaatttctctgtgacccaaccttttgttttaggaaaaatgaattgaaaaaacaacatatgttgtttgttgttctgtttgtatgcttctctctctatatattgtgtatttgtgtgtgttgagaggatggaggggggggggcataattccatactgacagaaataaaaggtacaacagaatcaaattcacctaatgaatgcttctaagtacagagaagacaactttacaagtgtagcatatcttatgttccttgtgtaatgcttgcatcccttttgcttctttctacattactccctccattccactatacaaggctttggatgcaaaaaccaaggaagctcctataactgccacagaattagggggctttaaaacaaccaaagcaagccaacgaatagcgttcactgcatgcatgtgcatggatgagaattacatgattcaaagaggtgccgctgcagctgccttcaatgcatgcatgcgcatgaacgagaataacggagtcaaggaggtgccgctgcatctgccgccctatattctggaacttctgaaaaacacagttaagccttgtataatggaatggagggagtatttatctactttagagtaaagctgcacatatcgaaggcttgctgggaaaaaagaatgatttccttttgagctcaaaaaatgtgcaacaacaagtgccgcccagtgattaatgatgtttgtgcatacacagaacatcatacaagggtgacagaaatcttgtgtaattgaaatgcttaggttactcttcttccattattattgttctactcattaaggtagtatacttaccatgattttgtttcagatttttttaaaatattcatttttatcttgctattttctggcagactattttatcttactattatttttctggcacactaacttaatgggaataactgtggagtaactccaacctcttttgttgcaggcatagataaacatttattttatttgttaaaagattccatttaattaactagattctgtaacacatcagagcaggacacagcaatacaaagctggccccaacggatgtatataaataattcaattccatctgtaaactgtatttatgttgttcagcattggctgtgtggtgtgttttgataaacaccgtttagtttcataatggtggggaagcagcagtcgttttggagcttaacgttgtattgacatcctttctattttaacagatattgctccagtttgtgaaggtgctgttcagcacatagcatcaaagagatttgatattggaggaactgacttgacaaacctatttgcggaagaactcaaaaaatctaactcatcggtaaacattgatatttctgatgttgagcggctgaaagagcagtatgcatgctgtgcagaagatcaaatggcctttgaagctataggaagctcatgccgaccagaaaggcacacacttccagatgggcaggttggttattgacttgctctatattggtcttttctatgtataatatagggcccagtattgactttgtttctgttaactgtatgtgttatgtgcaatctgtctcttcatgaaatgcatgatagctgtatgtcttaatctgttttggttgatcacatatcttgttggctacttattgctatgaatctgtgcaaacctatatttctgaacacttcttcccccaggttataacaattgaaaaagaacggtacattgttggtgaagctttatttcaaccccacattttgggcttagaagattatggaattgttcatcagctggttacaagcgtctcgaatgtcacaccagagtaccatcgtcagctgcttgaaaacactatgttatgtggtggcactgcatcaatgactggttagttaatgctactttacgctgtcggattcatcagtcttttacctcacaaataaaaggcatatacatcaactattatttgagcatttttagtcttgctattttgacattgataatatatatacatgtgaagagcattatcattcggtatgaaaatttgcattctgtatgagacttgtggagatgcaattatctgagccagtattgtaatgctattggtttatgatccatgtgagaattactattgtttgtttccttgctatgttccagagcaaagaaatgggaccactatggtagtttgtccatttgagaactcttgctgttggaccttgaacttttatttggagggagagaaactgggatcttttattatattaggaaacctcttgttctgttgttgtcattttgaattttgtcagctgtcaatattacactgaatatgtggtggaaaatttgtgtttggttagagtcaagagtcttacgatactgcagtctggtcacagcagtgcatataatcaatattttagtgaatacttgcttaaaatatgttttggtctgtatacgatttggtttggtggcactactgtagctttgcattcattagtgctttcttatgcttggttgcagattgatttaaatggcttttcatttcatgtcaccaaaaccatttgaaaccaattatttagttaagagccttataacttagtttcaatttcaaggtatataacctcatgctttcactttcaaggttttgaagacaggttccagagagaagcaaatctgtctgcttcagcaatctgcccatctcttgtaaaggtaaccacctccctctcccttcatcccaattccccaggtccaactctgtttgaccttcattaaccaaacactcgttcctccagcctccagaatatatgcccgagaacctagctaggtactcggcctggctgggcggtgcaatattggccaaggtcgttttcccgcaaaaccagcacgtcaccaagggagactacgacgagactggtccatccatcgttcacaagaagtgcttctgaataacagctcgccttggaggcatgaacaccttgcacgggtaggtgcgccctttactgttgctgtcaagtcttagtgctttcaccaccccgtgattggtacggttgtacgtgcgtgaccctaactcaaagccggatttgcctttcagggcgtggatgcacgaatctacagtttactggcatgtaggggcctgcctgccctgtgcttcaactcgctgtactaacttcctctgaagctgcggttctgagcaattcattagattcggttgtgcccgcggctgccaggtccagtttagatggtgtttgttacacttgttactagccattcaggatgcagtagaatctaacattggcatctatttattacaagttgtagaggattgtacctggcaacgctcgtaggctgcattcgtttgattgtccgttcaccgagcgtacggaaatcagttcattctgtgattctcccttccaattgctctctgaattctgtgtagctgtagtgctgtgtagcaaactacaagaaaacaaagcttagctagaagcggtattgttcttccaagttgattggcaatttgagctgtgctatgagtaattcctgtctgccttgtcggatgtcttctttttttaaaacttttctgaaggacaagatgcagcttaaaggttggctacgaatcttgcgcacctatccttttggggccttggcgccatgcaaaccatgaaaagaacaactgtagtctgagattgattgctgggaaaataaaagttaaaagtgatctacacaacctttcaatccaatgtcgtgatgtaatggcacaacaatgcagtacatcatatagctgcattatttagcttggattgtactaatgctgcaatttgcaggcatggt

SEQ ID NO: 5155 - DNA, 1214 bp, Oryza sativa
aaaagaacaattgtagtctgagattgattgctgggaaaataaaagttaaaaggaatctacacaacctttcaatccaatgtcgtgatgtaatggcacaacaatgcagtacatcatatagctgcattatttagcttggattgtactaatgctgcaatttgcaggcatggtcgttgcatcaccggatttgttttggattggtaacagtagcaaacgtggcctccaacaaaggctgcctacggtccaacaaaggtggtactggtaataattcttgcagattagggtggccgcttgtgattgcgggtaagaggccaatgaaagtggtcgatcttgtctctaatggaagctagcgttccctttgccattaagctgctctcccgtgtcattcttccgcgattaagacccgcctcgtcatgtgggttttgtcctatcaacaagatgcgtcttaagtcgctgtcgggctatcgagccattaggacggtgctgatcgatggtacaaaacatttgctaagcaaatttcagaggtcgtacgaaggaagaaaaaaggaaaaatagaaaaaggccgtgtgacaaactggctcgtgacccgtttgacattgctgtctagctagtccctactccctccgtctcaaaaaaagacaaaccctgaattttcgtgtccaactttgaccgtccgtcttatatgaaatttttttataattcgtattttcattgttgttagatgataaaacatgattaatattttatgcgtgatttgtctttttaatttttttatatttttttcaaataagacggacggtcaaacattggacacggaaactagggtttgtctttttttgggacggagggagtacgtcttaatttcacgtgaaaaaaaataatgcgggattcatgatatatcaatcgatcaactaagctagatctgtttggcaaataatgtaatggttaatcagcgagtaacaataattaactaatattctttctcttcattccacaatatatttatctttagggcttttcagtggagaggtgaaattaaatgaggaataattgtgatcgattgagattaaaagtaggtagagaaatagatataattcaaaacaaaatgcaaatggtaggagaaattgtattttgtaatggaggaagtacacccattaggaatgtggattttaaataatgggcagccggtcattcgcttttaacagacaaccagttat

SEQ ID NO: 5156 - DNA, 2679 bp, Oryza sativa
taattcagaagcctcaaaaacgggctgatcacaagtacatgcatatatacagccggcagggttgttgagcttatctcctaatacagagggataacagcaaactctatctagagctaacaaccctatccaaaccatatgaaacaatatttcacgtaaatcctaacactccccctcaatctcaacctaccaggttcagattgtttctaaacatctccatctgccttactgtcaaggttttggtaaagccatctgcaacttgatctttagatgagacatactctacctcaatgtcacaccccaatccggcaccgccgtacaacggcacctgataggagcgtgtcgcaggaaaaacggcgcgaaccgcttcctacgaaaccgcgatcacagtaccagtcccaggacatagtgctggtacccacggtgacaaatatgattcattgcaaaatccttaaaataaatagaggacttatttaccttaacttaggttgcagctcaggacagcctgagaatacaaccgaagacactgacgagaaaacaccagcaacagcagcagcagcggaaccaacgaactaacacccaacaccacaggcgatggctgggaaccaggacgaaaccctaatcttcacttcacttcatcttcagcttcagggcggaggaactatatatatatttatatagagcaaggatgagtactttcgtactcagcaagtcacgggaacttaggtgtttaatgcaagcttggaagagaggcaaggttgttttgcaaatcctttgtttgaaaacattttggaatcactaagtgatttatttctttttaagtttgggtcgagaggagacttgcgtctcgattcgacttaagagatgcttttcaacaactcaaatggtaatgtactgacccccgggtcagatcattacttatcggctcccagagccatttcacttgattaagcggctcccagagcctttttcatttttgcggactcccaaagttcagctgcccagcagcaaagcaatccgcttccactcgggaagcctagtctatgatgcccgcagacatcccgaatcacacagattcgtttctgaccactcaggtcatccatctgccacttaggctgattctggttacgattcccaattcacaacaacttttcacaaagcacaggcaaacaaatctacgcatcgggaaccacctcacatccgcccatgaccgtgggcacggctgttcgaacagttagttaacctctgcagaggggtacactttacccacaagacacgaacttactccagacactggccggtgttagaggtttgcgacaaagcctttccaaagctaactttgggtcacctcatgccacatagagggtctccttgaccaacatcgggccaactccggctttccttttaggactcccggatgccttcctctgtttcggactcccaggatgcctctacccccacatcccggctttccgcctctattgacatacaagattttccaaaagcagctaattacttagccagggtgtcccataccaccatgtggttgcacttgttatgcttgatgagtttcccaaaggaatcggttcttatatgcgaatacgggacagtgccacccaggcacagcacctgcatcgcgagttttcacaattcattttattttcaaacacgccgacaccacaggtcgggttttaaaggcttctcaaacccatttcccatattatcgacaaacaatggtgtatgtggaatatttggtatacgcgcttagagagaacgaataccgaggtaccacaagggtggagcgacaaggaatcagggtagtacgacctacaggaattagtgcgactactaggtaggtccgacggtttggcacgcaaaccgaggccaagcaagttgagtgtatgattctaataatgcaagttgcaaacaaaatagtaatgatttttcaattataggagcaattggtcaaagggtgacttgccttgctcaaggtcttcacgaagcttcacgaatcttcgagaaaacccgcgatcgacgaaaatccggtaaccgcaactatacgcaaacaataaaaaacctaaacaaaagaccaaaagaaagatcctatttagactaaataatagttccattagatagatctcaattttacggaattattggaagtggaacggggtcaatcggtgttacggatcgggagatatgaattttggaagtttaattggaatttgtggacaaaggaagatatttgtggaacaaggggaaattgatttatgaaatttatagaaataatattctcaagaatattattgacagtcacggacgtgcgggaccaagggaaatgattcatggaattttggaataaagaattgatttatggaaaaggaaatggacgagggatgtatattagacttttttgggcggcaagggcgcggcccgagggttgaaggaggctcggccgagccatttgggccggcgcaggcacgggaaaggcggcccattagggcgcgcggaagggggggagcggttcggtggaccgagtgcacctcgcgggttccaggtggggcccgcttgtcggtgacacggcccacggtgggatgggcgcatgcgaggtgcggcgctagggtttcgggtgcacgtggcttaggagcggtgcaccgggtggacggatggcggcgggcccac

SEQ ID NO: 5157 - DNA, 18716 bp, Oryza sativa
cggcttggcccggtcaaagccgaggtggcgccgacgtggcgcctacgtggcagccatgcaggccggcgggagaaggaagaaggggaggccgagatggacggcggacggcgggcgtgttcactggagcaagcgcgacggatttggtcttcggggagcacaccggagtgacgagggcatcgagaaggagcgagccaacggctcagattcgccggagggagttcgacgttgacgaattgcggcggcggccgccggcggtggtaaaagaggggatttgtcgacaggcaacgggagtccgattcaaagcggtgggagtatctatggtggtcgggaagcccatttctggcatcggatggggcagagcgacgccatggaggtccggcgacgagcggtggcctccgacaagagcgggcggcgacggcggcaagcctacggcgagcagcggcggcagtcggggcggcgccagctagctactggaaggctactcgcactaatgcccgaagctaagggcaggagatggagcgaggaaggggaacggaaggctaccgtgtcggaacgtgcgatgggagatgcccgacggcgcggggcgagctttcggcctcaggccggggaaggggaggaaggagggtgcccgcactcgtgcgtcacacgcccacgcacgcaaaggttccctcggtgtttggcgacggacggcgacggcaagaacagtgggacggcggcaatggcgtggtcgaggcgaggagcaaaacgcgattgattgggatggggagggatctcagtcttgggtatttatagcggtggggagagggcggtttgggggaggaaccgacatagggcggttgagggtgcaaggatggcgagctggcgcggtcaagaacgctgctggcgctcacgggcggtagaggaggtccagctcgggagggaaaaaggaaaagggcagggtggaaaggaggggttcgaccatgccattttggggagggagagaaggatgggagcgcgagctctggctccacgttttggacgcaagcgcacagaggtgggggcaagcggcagggcggcatgggcggctgcgtggcgcaggctgccagggctgacgcggcggcgaccgggcagtcggccacgcgcgggcgagcgcgcgcgcgacgcgagggtgcggccggatttcgaacggcggcggcgggaaatcggcgccggtgagagggagttcgacgagggagagagagcgagcgccctcgctcagagcggcgcacgcgcgaggcacgcgagggaggaaggagcggctgagggagagagatgggccgagggaaaaaaaaaacggcccacaacaaccgagggaggtaaattagactttttccgaggaaatcgattcggagggatatgagatttggaaattgaatttggatttcgaacttgaggcttggtctgacaaagcagggaggagtcaaggggaagcacccaagcgagaattcggtgtttctttggagcaaagttatactcggcggtccgagggattagatgagagggattcaagtgagacctatctttggagttgggacaatggtatgggataggttccaaaggtagatgggtagagggacggatagattgatagatagatagacagctggttagttagatagataggtagatcgatacatagacagatagatcggctgatgggtagataaacgaataggaagatcgatagacagatcgatggatagatagtaggtaggcagattgattagagagagggagagagagatagggacgaaagaatcgacgattgatttcaggatgttgatttcagagacttgaatcggaattggaatcttgaggtggtggattttgatggcgacgaaagggaacaacgatggagattgaattgagatccatggcacaacttagactcgcacacaaagaacgaaattttcgcaattaggattttgccgaattagtttttaatgtcacgcaaaaagcggagcgttacacctcaagtaacttgtgagcaactcgttctctaacaaaatgataatccacctctatatgctttgttctggcatgaaaaactggatttgctgttaagtatttagctcaaatattatcacaccataccttagcggctctaggcccttttacaccaagttcctgaagtaatgtttgtatccacataatttctgctgttgcatttgccaatgccttgtattcagcttcagtacttgatctagaaactgtagcttgttttcgtgcactccaagatacaaggttgggtcctacaaaaacatcaaatcctctagtggatcttctgtcatcaagacagcctgcccaatctgcatcagtaaatgcactaacaagcaaagaactagacttgttaatctgtagaccaagtttcacagtatgttttatatacctcaatatcctttttaccgctgcccaatgatctgtagttggagcatgtaaatactgacataccttgtttactgaaaatgatatatccggtcttgtcaatgtcaaatactgcaatgctccaactatgctgcggtactgagtgctatcattgggaccaaggagagctcccccttgacttgacaacttttcagagatggacagaggtgtattaactggtttacagtcactcatacctacccttctcaggacatctgaggcatacttttcctgtgttagcactagcccatcatttacctttttaacctcaattcctaggaagaagtgaagatctcccaaatccttcagtgcaaactcctgattcaaatcctgcagaagagctgaggtggccttttcggaagagctagacacaatgatgtcatcaacatatacaagcataaacatagtaactccattcttatcatagaaaaacagagatgtatctgattttgatgacacaaaccccagctcattcaactttgtacttagcctcgagtaccaggccctaggtgcctgtttcaatccatacaatgccttatctagtttgcacacatagttaagtgccttagattttacatatcctggtggctgtctaatatacacctcttcttctagaactccatgcaagaaggcattttgaacatctaactgacgaagactctaacctttagaagctactaaggatagaacagttcttatggttgcagctttaacaactgggctaaaggtatcttcataatctatgccatacctctgcttgaaaccctttgcaaccaatctacccttgtatctatctaaactcccatcagcctttcttttaattttatagacccacttacagtctataatattaattccctttttaggaggaactaaatgccatgtttcatttttcattaatgcataatattctttgtccatggcctctttccagttcctatctcctagagcctcagctaggttctgtggttccccagatgatgtaaaacaaccatatttgactgtgccatcagtataaattttcttttttctaatcccactttggagtctagtttttggtctagcattaatatcaccttgctctgttgcagcgataacctccggagccgcagacgatcctgccgcatcatgatgaggccctggcgatgtgtcacctccgagctggtggtggcttgcgatggagcgggaactcgcgcgggagctctgtacagccgacgacgtggcggctgctggttcggtgacggtcgcaggttgctcaggggcctgcacggcgcgccgctgatcagtacgagacggcgattctgccgccacttctgtttctgctgtgtgtaccccggtagatgcaccaggatgaattccatcaggttgctctgcattaatttctgcattgctgtcgctagcatctgtgtcatctgcagcatcattctcaaaagaggaatcagtaacaacaggtaggatattatgcatatgatcattgctatgtgctactcccccttgatcagatgcatgcgatgtaagatcagcaggaagaagggaaatttcagcacgtagacgcgctccagcatttggctgaagcttggagaaaggaaactcctgttcatcaaaggtgacatcacgggaaatatagacttgaccggttgccacttctaagcacttaaaccccttatgtaaattgctaaaaccgagaaagacacattgtttggaccggaattgtaatttgtgagtattgtagggacgaagattaggccaacaagcacaaccaaaagttcgaagagatttataatcaggttgttggtgaaaaaggcgtgcaagaggtgtgtcaaagtcaattacttttctaggcaagcgattaatgagataagtggctgcaagaaaagcttcgtcccaaaatttcaaaggcatagatgcatgagcaaggagagatagcccaatctcaacaatatgacggtgtttccgttcaacggcaccattttgttgatgggtatgagggcacgacacttgatgtgctatgccaatttgcttaaagaaggaattcaatttttgatactctcctccccaatctgtttgcatgcctagaatcttacgattaaattgtctctcaaccatgctttggaactctttaaatttctcaaaaacttcagacttaaatttaagaaagtagatccacacaaatttactataatcatcaataaaactcacataatagcgcttggctccaacggagtcagaggcaggaccccatacatctgaatgaataagttccaaaggattactagaaacactaaaaaacttaggaaatggcaactgatgagactttccctgttgacaagcatcacaaacagactcactaggagactcattgctacaaggcaatttattttgattaataaccctaagaacaatgggctttgaggcatgccctagacgaccatgccatcgctcgaacgatggcatcacagcaaagacttgttttattggatctccggcaggcaaagggtagagatcgcgccgacatggtccttcaagaattgtcctcctcgtgaccttgtccttaatcaaaaaatacttttgatgaatctcaaggaatgcataattatcagcaacaagtctatgaactgaaataagattttttgatgccttaggaacatgcaaaatatttttaagatggaggggacggctagatgtaggtacataggaatgaccaatatgctgtatatccataccttcaccactagctgtgtggatttggtcggtgcccttgtacttctcccgtgtggtcagcttgtccagctgcccggtgatgtggtcggttgcctcggtgtcaacataccaattggtgtcaacaccgtaagcgtgcgtcgcagcgcctcctagcttctcatcggggacgtagttctcgtcgtagcggtgccagcagtccgccaccacatgccctttcttgtgacagacttggcaggtaggtctgttgtcagtgccgccgcgtccattgccacggccgtgcccgccacctcggccaccgctgccgccgccgccgcgtccagtgccgcggccgcgagggttgccgccaccacgtccctgatttccgctgccacggtttccactcgtagcagcgcacgctgttcggatcttcaccctgttttcaaagccaagaagctgtgagtagacctctgcaacagtgacagatgcattcttggcgatgagtgcttccaccactggatcaaactctgaatcaagaccattaataatgtaagcaacaagttcttcatcatctattggctttcctgttgcagcaatttcgtcaccgagagcacgcatcttgctgacgtactcggtgacagtcgattggcccttctgagtggtggtgagagccaatctaacgttgatcgcgcctgcgtgagatcgtgtcgagaacgtgttctcgatcgtcttccatgccgcggctgccgtcggtgcgcctgcgacttgcgaccgaatctccctggtcagagaggagaacagaaaaccaaggacctgttggtccgtggcaaaccattcgccatacgccgggtttgggactctgacggtcttctctcctttttctccttccttctgctcaagctcggcttctggtggaacggatgttccgaggacatggccctccagtcgcgcgccccttagggctgtgagaacttgtgccgaccagagggagtgattttgcttggtgagtttctcagaaacttggacgccgaacaaaggatttgcaaaagcggtggaggaggaggaactcgccatgagatctaatatagatcgagtttttgctctgataccatgtaaagaacagagatgcaagcgtggagaacacctcagtgggtggtttcgtgttaattcagaagcctcaaaaacgggctgatcacaagtacatgcatatatacagccggcagggttgttgagctcatctcctaatacggagggataacagcaaactctatttagagctaacaaccctatccaaaccatatgaaacaatatttcacgtaaatcctaacaggacggcgtttcttccgccatcccggcgaaaaataaagagagaacacgtgtatgttttggctgtgtatatcttttatgtatacagaggttggactaatgaaaatccataattaaaacattgttagctgtcagagatggaagaagagtgtaagcagacttgatagcaaatgatggaaaaaatttcagaaacagcaaatgtagcaaagctgagattttctttatctttaattgtattgacacaaccccctgatttgtatcccaactcgtgcaagtttatatgcagtacattcgcattaattccatatttcaatttcaccatccgatcgagcaagaagaccaataactgataaactaccgcagaagcacatgcatcgaaggcccctgcaactgcaaacgtgagtctttgccaaatttccagtgtggttaagccaatgagtttactttcttgcacgccactgatcacaattcacaaccccatcagctagcatgtaccgagcccgagtgcttcgtgcgtgtgtgttcgcttgtccatagccgatagaaatcggaggcaactccggctttccgattctggatttcttctgaaactgaaacggacatcgacacagctgacagcgccgagttcgaatcctacccccgtataattccacccctatatacgcagcgcgtctcgccgcctcgaacctcacagcgaattctgatcaccaccccaccaaccagagttcaccacgatcggttcgatactttgatctacgcacgagcgccgccgccgagaacctcacgcacgcagcagccgccgccgaggaggaggaggagagcgccacgccgtccatggaggactgggtcgtcctcagcggcagcgacggcggcgacagcgtggagctccacgacggcagcgacgttggtggctccgacaccgagagcagcttcgcggtcgtgcaggtccgcggtcgtgccgctgacacgccggcgatcgccgtggaggccgtgccgtcgcaaccttcgccttcgccgccggggttctttaagaccgtctcatacggccaggcgttctcgggaatagcttccgagcacgtcgcagcttcttctcacgctccggtgctcgacgcggcagaggaggacattgccgaggtgtctccggtgatcgtcggaggtgagcacgagaacgccgagatatctgacgtggtagagagcaacaatgaccacgtcgactccaacatcgacgccgccaccgaggtcacgaccttctccggcgaggaggacttggatgatgagaccgacggtgacattgaatgttttgatgaggaggacggaatctgcgaggagaaccccgatgatgaaatcttcgacgacgaagaggaggagagcgatcccgaggaggaggacatcggaagctctgacttggagactgattccgatgagtatatagaaagcaccgacgaggagagcgattacgaggaggaggataccactgacttggaaagcgattctgacgaagatactgaaagcactgaatcttcccatgacgaggacgacctagatgatgatgatgaaagcctcgacgacgatggctctgaatgctttgatgaagaggacaaaatcggcacggagaacccggacgatgaatccgtggacaccggaagctctgacgaggaggagagcgacgacgaggaggacagctattctgatgaggagattgacgacgaggaggagagcgattgtgacgaggagatcgatgaggaggaggaggaggagcatggtggtaataagtacgacgccattgacaacgaaagcttcggtgaggaggagagctgcatggagcagagtgatgctgaagaggagtggccggagttcaccggtgtccctgtcaggtacaaagacatcgacaccgactctgacatggagatcgacggcggcaagtcggggtcattggcagtgagagcttgtatgaggaggagagcgtctccgacgagcagagtgatgatgaggaggagcccgaggagttcgccggtggcggctacgatggcatcgactacgaaagccttaacggcgacgacttcgaggagtacctgcaggttctcgccgatggtggcattgacaatgaaagctttggtgaggaggaaagcgtcttggacgatgaggtcctggatttcttccatggcttgaacgatgagttcctggatttcttctatggcgacacgctctacgactatgaaactgaaagctcctgcgacgaggagtgcgagcacgtgtgcgtctgtggcgctgcatggagctcatcgacggcgaggagttctatcagctgatcaccggagacgagttcgatggcacgcagctcggagaggagatcggtggagacgcaagcggcgccgacgaggaggagccctctgacgccggtgagagcgaccacgacactgctcccgacgccggcgatggcgaggcgcacggcgacagcgccgacatggcaggcgggaatagcgcggcggcggcggccgagccggcgtccacgtcgtcgcagttccagcaggcgatgcaacaagcggcggctcggaaccaggctgcagcggcgatggtgagggcggccgacgcgatcgattcgtacatgcaggccgccgccggcgggctggcggcgcaggacgtggaggcgctgtcgcagggagccacgggcctgcgcgccatggcggccgcgcccagcttcgccgttggcgttgacgttagcgcgagcaacacggcggcggcggccttcctccctgatacgctcgcactccaagacggggtggtttcgcttgcagtcttctacctgctctttggtgtcgtgtaccttcttctgcgaatctgcgcattgaattagaattaaggatttattagggagtgatgctgataaagtttgtggtttagtactgcaaatatcatgttcttttattatatatatggtaattcctccgtccttaaatatttgacgtcgttgatttctttaaatatgtttaactgttcgtcttataactattgtgaatattattcaaaaacttaaattacttaaatttaaaaatgaatcaaaagataataattacttaaattttttgaacaagacgaacggttaaacatgtttataaaagtcaatgacatcaaatatttagggacagagagagtatatatgatatgaatcatatgatcgatcgtgatagtattgttatgaaacgatagacaaataaacgataaagaataatagatcaatcaagacacgagatttaacgtgaaaaaccctcccaagacaggaaagaaaaaccacgggcaccagtcagcaaaatatcttcactatatctggggtgaggttacaacgccgcacggcggcttacaagaggtatatatatggtagaaaccctaaaagggatgacgatccgtacgctccggcccaaatctaccggcgacgggcctatgctccactacggtagaagctagtctttattaagtgcaaatgaatttggatcacaactcaacaggtatatgtcactcctaatttggctgttttttcttgaaatttctcaagttgtatatatgtagtaagtacaaacaaaatccttgaattgggtttagtcggaataaatttggtcgagattcaatcgaagaaaacaggggttgatattccattatatttactagtcttattttggcaatgaaagtttctaaaaagcaaaaaaaaatcaggcaatgtaatactactattaatataacgtttaaaaagaaagaaaaatagtttacatatggtgatatcaacgaggcaatactgccccattgtaaaaacccaactcactgaaactgggcccaaccaaacgtggtccacatccccatcagagttatgcactactccgtgttcaagttacaaaattttaaatgcgcgatttgtaggggatttggtacataagatggcaacttacaataactaaacgcatgaaccaagtaacgtaacaagagaggactcgtgaggcctatacatgttctccttatcatcagcagcaaagagagccggcaacgaaccccaaaacacaaacacaaacaggttacaagtccttaatactcaaggaaagtagatgtcggtctcggtcacggtcacagcctcaaacgcggtcccaactccgactcacgtctcatgtcgtagcggtgttcccaacgacgaatttccgtctcaactcggattcttgcttctgaaactgaaacggacatcgccgagttcgaatcctacccccccgtaacgtatccacccctatatatgcagcgcgcctcgccgctttgaacctcatagcgaaatctgatcaccaccccaccaaccagacttcaccacgatcgcttcgatacttcgatctacgcacgcagcagcagcagccgccgaggaggaggaggagagcgccacgccggccatggaggactgggtcgtcctcagcggcagcgacggcggcgacagcgtggagctccacgacggcagcgagagcagcttcgcggtcgtgcacgagaacgcagagatatctgacgcgacagagagcaactatgaccacgtcgactccaagatcgccgccgccaaggacacgaccttctccggcgaggaggacttggatgatgagaccgacgatgacattgatcaatgctttgatgaggaggacggaatctgtgaggagaaccccgatgacgaaatcttcgacgacgatgaggaaatcgactgcgaggaagaattggatgatgatgatgatgagagcctcgacgctgatgacgttgaatgctttgatgcagaggacataatctgcaaggagaacccggacgatgaaatcatgtcccacttattattaacctagctagtaccaatttagccacgtacatcgatcccatgtacagccgcatctaattatcgaattattctgcatttttacccctactttcggtcgttagctgtcagaccttttatgttttgcccccataatttcgattgcgtctcgacacaatgttgatcgtggttgtgcatctatcagttattcaactaattcacaggctctccattacttatctagcacctgcctagttgtctttggactctatatacatattatttctgctcaccacttgcaacttaatttgtctcttcgttgtacgcactcgcactaagcttttgcatgaatagaacaatatggttaagaaaatgatagagagctatgcatgggttcttagggatggaaggcatctgcaggagcattcttgtgagaaatgtacgtgataattgctattggatagagagaagtgggcgtgaaaagcacaactcatgcggaaaaaaatgtgtagccattaaaatgttaagggtgtgagagatcttaattaaagagaaatgtttttgtttgacaccttaaacaagagatagggtgtgcatacaagaaagagcccgccattcatttgcaaaatagaaaacaaatattccctccgttttaggttatgcgacgttttgactttaatcaaagtcaaactgctttaagttatcgagtttgtagaaaaaagtaataatattttttctataatcaattatatttaatttattatgaaaatatattcaacttaagtttgaccaagtttgtagaaatttattatgaaaatttattcaattattgatttaatgaaattagtattataaatattattatatttatctataaacttagtcaaacttaaaatagtctaactttgactaaagtcaaaatatcttataacctaaaacggagggctacttgattgcacactccgcaggaacaaacaacgacaaatatctgttttttttcccttcacgttatcaactaaatgtccctgcgcagttcagttacctgcaccggcgtgtcatcatctctcaaacagtttactgtttacagacttagcagcagcattctccttccatgttactggctgactggtgaccgactttagaaggtcatctgtggaaccatcatttcggttgaaaagttggaacatatctgcttcgaaataatggaactttttaacgtgatgttcttagtctgccgatccattactccctccggggatatattaattaaagttttagacaagattgaggttaaacttttataactttaacaatcaataactttaaaaatatttagttcaaagaaactagaacaacatatatagatttgtctttcaaaacactataataaaagtaaacatgcatttatttattgtatatattataatagaaaaataaggtcaaaggtatgtctcgtagagcatgtcattgtccaaagcgtcaattaaaataaaaccggagggagtataatgtgatgtttttttccggcaaggcctgtaaataacaccttactttgtttgtttttctcctgctttatcaatacatacgagacaaagattttaacttctttttgaaaaaaacaaatctatatttgttttttttacatgggatttgcatcattgggttgctcgatcgaacatctccaaaagaccaaaatagtcaagaacgattcgatttttactgtagttttgtcccccatcaagtagcgttgcgcattatcccgggaaactattctaatccctcgaggggatgttccctcgtttgctcaaaaatcatttaaacggttatgaaaaattctggaaaaatttgacaacattcatacaacacatatatacaacttcacaaaatcttaagtccaaactcaactcacacttcgagatataaaaaagacaaattcagcgtatgaatagtagcgtactgtttatatctaaatttgtctttttttttctcgatgtgtagatcgaattggaacatgaattttggtggactagtaggtatcattatactctacattgtcaattttttttagaatttttcacaactatttgtatcaaatttgaaagaaaaaggtatacgaggggatgtcccctcgagggattagaatccactccccattatcccctttcttgacatatgtcggccagtctaatccttctctccttaatcacacaaatatattgcttgctcagacagtcaatgatatgtaatattcataactataataaaaagaattgcatgcatcctctaaactttggatgaatgtccatatagaatcttaagttttaaaactgaatattgacaacccctacacgcacagcgtaccccgaagtcccgaacgtcacaattcgtccattgtgtctccaactcacaaacataaataaggtttcaacagcattcatgtgcgtcgctctcccccaggggcgactcgggaggcgaacccggccgccccctcctcccctcccccaccttcctcctccgcctcgccgccgcccgagtggccgccgagccacgtagccgcaaggacggcggcggcggttgggcttcacgcctctccctgcgcgggcggccaggggagcctctagtgcagcggcgatggtgactgccagatcctggtagggtggcagctggcggcggggacagcgatggcggtgggagtggagacgacgacggtaggggcgaggggatgtgggcgatggcggccggaatggtgacgatacaagaaagagagcccgccattcatttgcaaagcagaaaaaataattgattggcaattcagcatactgcagcaaaacatgaataattaatcaaattagttatttttttagtaatgttctgtgcagcgtgaaaaataaacagtaaaccgtgcatacacagatacacgtaaactacttcagtgaaagtgaagataatatcacacttggtaaactattataaattttcgagaggacatttactcgttgtttgcatgtcatctaaataattataaatttttttaaaagaaaatcaacaagacatattaatatgtgaaaatcactctacaaacatgcaagatctaatttaacttctataggttacaacgtaaaaataaatttaactgtgaatatacgttaactagccatagccatagtttacagctagcttgctagttacccaaccatttaacttgacacgtacaaccccatgaaagacaacgagaatagcgccctagcatgccctcccccccttttttttatagataatgcgccctagcatgttctgatgtagttttgcctttccttttccttttttttcttttcttcaccctgggtggttatataaagtttttcccctacttataatataatataaaaaataaattttactgtccttagcaggtatatacctcctcaataactgtaaaattgctctaatataaaactagcaacgcttggcatcgtacagtcctattggttgcctaagtgacattgaatgctatgatgtagatgatagaatctgctaggagaatccggatgatgaaatcttcgatgacgaggcggaaatcgactgcgaggatgagatgagagcctcgacgacaatgacttgaatactttgatgtagaggacataatctacgaggagaacccggacgatgaaatcatgtcccacttattaacatagctagtaccaatatagccacgtacatcccatgtgcagctcctgcaaaaagagacaaaaatagtgatgttatatctccaatcaagtagtttacaggcataccgagttagtgaaattctttttcaaaaaaaaaggaacccagttagtaaattatcacgaagaaaatagaggatagactatatataattattcgtggtgcttctcattgtctgagaaagctagaatctttgatgacagtagttttatgtgtggtttggtggtacttgatttttcagtagagaacgattgatcaagcacctttctcagaaattatccggatgccttccactcctagtaggaggccaatgcaatgctcaaacatttctcacccagctacactcaagcacagctgttctatcagtgtacaatatgacagcgtcttcttctgtcacttctcagttatcaggcattagacaaggtatttgatggatcagattcagaggatgaggtgagaagcagccatgaatgaggccatgtatatataaagaagatggctggcctgttggctgcacgttagttgtcagagatccaagaagagtttaagcagagttggtaggatcgaattgatggaaaaagtttcagaaaagagctagcattgttgaaattacagcaacctttgttccttttatgttgtgctcgttttctttttgggcctggcttttttttatatatataatgggcagcgtccggcctttgcattataagatgaatatacatggccaattttgggcctggctaattggtcatttttatgctatttaatttctcaaatacttgaatagctgcatatgaatacgctgccaaaataactgcaaatcttttctttttccaggaattgtacatccttctcttcgtatttgagacgaactctactcctaaaagcattcgttaatgctagctttatctatgcaatcaaccacaaatgtttactcatctggctacaagttttgcaacgacgagatcatcctgctcaaccgtagtttcttccaataatgccaaaatggccgagtctaatccagcaaatccccaatcctgatcaactcgtctagttatgaaaaaacttataatctaaaacgtttgttccagagtctagcttggattcaagaactgagtctgatcgtcagtgtggactgtatcatgccatcgactagtccagcatcaatctatatcgcgctggtgtctggttagtgccacaaattaagcattttgtacctcatctagagagacgactggtgccgcggtcctgcataacatgacctaggaaactgaaaacacctagtactgacatgaactgtcggtaaccaaattcctaaactccatcaaccatcctacccttgtgtaagggattgtcacgccccgaactagtcccgaccggaactagcccgtgacgctccaaattaacctgttaatcgataccagtcccaggaaacaatgctggtatcacagggagacagagtatcacagcaacagaggtctctttattatagagtagaagtacagtcatgttgggctgcggactgatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccgcttcatcttcttcagcaactgggggggggatatttatatagaacaagggtgagtacgggagtactcagcaagccaggggaaggctgttgtttttgcaatttggttttatttgaactctttttctaaaacgactaggtgagtgcttctcaaacgacacggatgggacagtgcgtctcgtccggtcggagtatgtgcaatgtatcagtctttagatcttgaaacagggttggcattcggccaacagcttttcaaacggcctcccgggccaacaacttttcaaacggccacccgggccaacaacttttcaaacggccacccgggcctagctgatcccatcagctacagatttttcaaacatcgaaccccttttcacaacagcaatttcacaagcagtagtcaaacaaaactacgctaggaatcacctcacatccgcccttgaccgtgggcacggctgttcgaacagttcaatgacctctgcagagggggtacactttacccacacgacattactaacccgggtcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggttgtacttgtcttatgtttggatgaaattccaaggaatcggtccttaagtgcgagagcgggaaaccgtacaccccgtacgttccccggtccgcggttttggaaattcatttagttcgcaagcaccgacccgggtgtcgggttttccaagtcttttgtaaaactccagttttacccaagttgttactcagattttaagttcgaaggcgaccgtcgatactcgcacagagtgcacgaatatcgaggtgcaactgggtggttacaaggggacatggtataacaattaacaaaggaaggatcaaatgtaacaaattaggtaggtctgccaatctgccttgcagacgggacaacagattaagtgtgatcctatcaatgaataatatttcgcaagcaatataattaaatttcaaatataggctcaagatgttcaaaggtggcttgccttgctcgagatccggagcttgatcctcgaaatcctcgcactgcggatcttcgggctccgaaactacacgcgaaacaggacaactcaacaaacggcgaaaataaagccctattaatgacctctaagcgtgtcattagatagatctcgagatttgaggaattttggaagttgaacggagtcaatcggatttacggttgggaagatattgaatttctaagattattggatttttggtctaaaggaaaaaggatttatttaaatcctttttgaaaaagaaaaaagaaaagaagggagggagggaatatagacttttctcggacggctagggcgcggcccaagagaaatggagcggtccggccgagctaaatgggccggctggcccaaggcggcccaaactcgcgcgcgcgcgggagggaggagatagagagccggtggaccgggctcaccacgcgcggtcccgggtgggacccgcttgtcagcggctcggctcaccgtgcggagggagcatgcgacgcacgcgcgcgggcggggacgggacgcggtgcatgcgcgcggtccgcggtggacgcaggtgcggcgggcccacgcgcagcctcacggctcgcggtggatcgcgcgcacgcggagggaccgaccggggtcggcccgacccggtctggctgagctggcgccgacgtggcgcctacgtggctgccacgcgggccggcgggaggtagacgacgacccggcctcgaatggacggcgggcggcggcggcgagcggcgaagcgaaccacggcgatacgggcaaaagcgtgcacaccgggcggttgcacgtg

SEQ ID NO: 5158 - DNA, 3772 bp, Oryza sativa
  unsure (1)..(3772): unsure at all n locations
aagagatgggccgagcggaattcggcccatcgaacccgggggaggcaaactagacttttgcggagggattcgatttggaaggaattggattcggaattgaactcgacgatagatcggggattgagatcttgagatggcacggacactagacaacaagcaaagaaacaaatttcgcaattagggtttttaagagataattttcccgctaggcgccacgacggaacgggtgctacagggatttagttggtcctgcataaaagaaaaatgatgtaattacatcttcaatcaagcagttcatacgcaaaaaacttcggtaaaatcatcagacatgaacataaaataaactttttttttgaatggaaacataagataaactagaatcttggtgcttaggtcgctccagttttttttttgacgatttacttactattacgcactcatggaaaataagattcttttttcttttcgcttgctttcaatgtgattgaaaattacgaatgcccttgaagacgatggtgtacaccaatacaccatacaaaaaccaaattactttctccccaaaaggtgccaacttgaagtctctgttataaaaccggcccccaaatcacatcggaaaccaaacgcggaagaaacgccatagaagatccaaatacgatgacgacactgaggcacgatatttgataacgaagttctgccgaggcctacatctctgggtcactgattgcgggcgttcctccccgatctagcatattacagcgtatcagagttacaacgactcacggctggtcactgccggcagccgctccctctcgctgtgctaagtcgccatgcggttacaagaggcacgcccctctatttatgagagatcctaggatatagtccgactcatactctattcctatacctagtacaactctaagtcctaaactgtaaccgattttgtacacatgttcgacacaaactctaacactaatgctagtttcagcctctatatatacggagtagtacattctttctgctcaattgctgcatccttgccccttcatttgcacacactcacactaacatagaaaatgaagctgcatgaatagaacaatatagcgaaggaaatgatagagagctttgtgttaatttttgggactggaaggcatcaggagcattcctatgagaaatgtacgtgataattactctaaaaaactgctatcgcatcgactctttcacgagtgcgcatggtacatatataccatgtgggaagaatgtacctctattaaaatcagtggcggaggatggaaaaaaatctagatatggcggtgtgacccatggactagcgcgaagccccagatcagacataatggctgtgtttagttggatccaaagtttgaattttggttgaaattggagatcatgtgactgaaaagttgtgtgtgtatgacaggttgatgtaatggaaaaggactgaagtttggatccaaactttggatctaaacacagccaatgtaatctgggttgaacttagttataccttcaaaattctcttcaacacgttcttccccaagctcttggacaacatgctcctccatctgcccctcctccttctccatctatactgcaacattttggcttccatgagtacttgggcatgcactacaagagccccaggtccaataactcttcaaatatgcaaaacaaatgaaacaaatgctaaaatgttctaaaattgtcagcatttgaagaatatgtacctctttgtgaagacaatgcttttccttttctctttctatccatttgaacttttgaagaatatgtatcctctctcggtctctcctctgcctgcctcactggctctgtggctcactgcttgttgccggctgccctgctgcgctggccgcctgcctcccgcggccgcgccgcagcacgcccacgccgccgcgccgctgcctggccctggccggctagctgctgcctgcctcccagcgtggccgcgcacccgcctaccccgccagctgccgagcccccaccggccatcgcagctccctgtcgcagagtcacagtgtagtcgtcggccgtcggcgcttgcctcctcagtcggatgcccggattggattggggaatgggggatggggaattttggagttagggtttcatgttcaacaggtgaaaaggcccatttacaccaaaaaaaagcctaattggttggcctgttcgcacgtgggctgtgggcaggattggcttcggcaatcggcagttggatgcctcgccgccggctcggagcgatgccgccatcgccatgtgagtcaccgccctgggacctgggattcgctgcaggaggggggggggtccggcgggagatcaaggtatggcgagcgccataccgactcctccgcccctgattaaaatgttagaccatgagatctaagcacttaagagaaattcgttagtttgacactaattaatcagttgaaaggatgtggatccgaagcagaccatcatgcattttctgactaggaaaaattatcaattgattaagagttttgcagcaaaatataaatatttaatcagatttgttcttttttaccaatgttctgtgaatacaaatttcaaaattttcatccaggcaaactactgatcatctaattaatattgttttctccgcaggaagaacgaaatatctcatggacttgcacaggtgcatcagtcaatagcacaacttgtggagtaggccggacagaacgcatcctggtccacatcagggtggtgtggttggccggtggaagagacagcagccgtcgaggacgcgatcgcaaattacacgtttttttatacccgatagcaaattcacaggaaataataaaataacgtccgagtgtctaggagctaattacacgttttttttatgcccgatagcaaattctcatttttgcggtgtccatgagctaattacacgttttttcgatgcactgtagcaaattttgctaaaaaaatttaaatttgatgaaaattcaagcgttattatcgaaataactttttttttctgtaaggccttgtttgatcatggtagaattgcccgttgtgttgctcgatgatcgcgtgcaaccacgtcaccctgctgtccaggggcaaagctatgtagtccccaggtgttcctaggaacccgactaggaaagtaaaattagtgattaataccccctaatgactatgtgggcacccccttggctcacgtatgtgtacccccagaccgagaattaagccacgaagacgtaaagtccagtgcgtgcattgcagatcaccaggccgaacaggtgctactaggaaggcttcaatgcactaatgtgttcataacaaggctcctgatggattagatcatactcccgaaaattgcggactatttgtcaatgctgtataggtgattttttgggatttttttttataaaagaagtggccgatagaacaagccaacagtgtgaaaggaatatatataaatatccaggtttgccttagtgtttaacaagcattaaaaaaattaaatgtagagtcataaatagtagaagataatgtatgatgtatctatttgacgtgaatagttcataacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5159 - DNA, 451 bp, Oryza sativa
acgggccgcgcctctctcgctcgctccgctccgtatcgcggtccatctcaatcagcatccgcgccgcgcatcgcatcgcatcgctgggtttgttggatagcgaccgccccgcgaatctgcccgatagcggcgtgcgtgcgtgcgtgcacgggcgccccacgcacacccccatcgacccgtacgtacgtgtcgttgatacgcttctgctacgtatgccgccgcccgcgcgcgcgcggctcgctcacctacgcgccccgcgcgccgcgcgctgcgccttgccttctacacgacgagtcgacgacgacggatcggatcgtacgccagtaaggtagacagcgcgcgcgcaacacggcgacatgccggctaaacctgaaccccggatcggtccttccccgcgcgaccgcgggagtacgtactacgcggcgcccctggttgcggtgggcgcgtacgt

SEQ ID NO: 5160 - DNA, 537 bp, Oryza sativa
attgccattgcataaaactgatcactacattaccaaaatgaggatgacacttttcaccaaaactgaagttgaaccttttatgcctttcacatatactacatggccagagacgaaggccagtgtatcagctgattgaacaataccctaaggaggcatttgcacatgacactgtgtaaaacaagagatcagatttcaccatggttgactcgacgaacaactaactgaatgtcattcctgatgagcaatttaaataccttctccaccatgaaagaaggctctccgctctccggaggacgacagccaatgacagaggacattgagtcctcgtcaattatataaggcccccactcagcgaaagcatagacaatatatatgtacgtaaacaccgattcagcagttcacccactatctcccattgtctccaacatttacaatggtgaaagaaatagacgatactagggtgccttactcgactctgcttacctatgtccatgcttgcactgcctcacttgcactgatcgaggacctggctgatcc

SEQ ID NO: 5161 - DNA, 893 bp, Oryza sativa
gtcggggaggacccctgggcttcctggcacaagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgacccgggttagtaatgtcgtgtgggtaaagtgtaccccctctgcagaggtcattgaactgttcgaacagccgtgcccacggtcaagcgcggatgtgaggtgattcctagcgtagttttgtttgactactgcttgtgaaattgctgttgtaaaaggggttcgatgtttgaaaaatctgtagctgatgggatcagctaggcccgggtggccgtttgaaaagttgttggcccgggtggccgtttgaaaagttgttggcccgggaggccgtttgaaaagctgttggccggatgccagctgttggccgtttgtaaaactccagttgcacctcgatattcatgcactctgtgcgagtatcgacggtcgccttcgaacttaaaatctgagtaacaacttgggtaaaactggagttttacaaaagacttggaaaacccgacacccgggtcggtgcttgcgaactaaatgaatttccaaaaccgcggaccggggaacgtaccgggtgtacggtttcccgctctcgcacttaaggaccgattccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctggg

SEQ ID NO: 5162 - DNA, 697 bp, Oryza sativa
ttcctgcgccccaaagtcggagggctcgccgggatttcctacgtcctgaacggggaagtgtgcaaagcatgcagcaatcgaaatttgcaaacctcggtgtgaagctcctgctggcgggaaggcagagagatctctgccaggtgtggctcagggtggacagggtcggtgacgttgtccacgtcagttgcaccagcgtgatgacgccggccgccatggcgactgtgccctcccctgtcgcactggcgcggggagcgtgtgcgttcacggcggtaatcttgatcaatcgcacgttgttcgccgcggccacgcccgaagtctcgtccccgttcgtcccgatcgtcgtcatctcgatccctgctccgccagttttgattagccctggggtggtcgttgttgtgcccccggcggcctcttctcccgccgcgggcacggtcgtcatggtcggccggggcgtcacgatcatcatcgccgcggccgtcttcttcttcatcttggtcttgctcgatgcacgccgcgcatccgcggcgagaccgatcacgcacccgcgcacgaccgccgtgatgtgcgccgtcgtcacccctgtttccccgctctccgcgctcagggcgacgcgatccacggagctcgtcctcccgatcgtggtcgcccaggcggtcgtgaacagagcgcggcggctgtaggtggtgtgggaagtcct

SEQ ID NO: 5163 - DNA, 422 bp, Oryza sativa
tttctctccctccttctcctctttttctcccctttttcccctctcgccggcgtcacctcctgtcgccgctttggacgctagccggagcgccagctcgccggcttgaccgcccatgtcggttcccctctctcaagccgacattgccgcccttttaaaccggtcttccccctcccttcctttcctctcccattcgcctcctcaccgttgccgccgctcccgtgctctgcctcgcctccgccgtccatcgccaagcgccgggagagccggttcgttggtggacgcggaaggggactccgggcgcgccctcttcttcctcttcctcagcccgaggccggagagattactcccgcgccgccggcctctcgtcacagcgcccctcctcttctcggtaatgtctctctccgttcttcctcctcgctcca

SEQ ID NO: 5164 - DNA, 739 bp, Oryza sativa
tgcagcctttcctcatgcaacttattgatcatggccattgcttggctagccgcgatcgccgaagcgctacgttcttcctcaagctctttgtagagagcactcatcgacttcttgttgagctcaagaagccgcttcaggttctcaggagagctctctccctcaacttcatcagcgaggttcgcatccgatggttctatcacagaatagttcctctcgagggatggcctcctgccattggcattgctttcatcggtttgcgcattgattccggggctaggagctccatcactccaagaactgtcaatgccccttacagtagacatctgtgaaaggaatgccttcacttcttgctgagtggttgaattgctgtccttggcagagattatttgtgatggccgaggtgatgaaagattggccctacttatgaaaccgttctttacgctgctgttgcgatcgacgaaaacgcgcataggcacagtagatccactgggtgctagctttgcagtcccagcatttccagaagcgccattgttctttgtggattgttcatatgttcgtggtgaactatcagattcattcacctcctcaatacccaccacaaaggctacaaaaaaaaaacacaatggattcactcggtgaacctctaaaaaggattcagttataagagaatctgaagtacagtagttcagacaagtgaacttacccttatcttttgaatgatctgcagggatttgttccc

SEQ ID NO: 5165 - DNA, 79551 bp, Oryza sativa
  unsure (1)..(79551): unsure at all n locations
tcaatcttgtgtttgcatattcatctacctgtaagtcaggcatctgtcaatgtttctttgaaaatatttagcctaaccattaatagaaacgtgggtggttacatctcatgttggatttatgtgcactcaataatgtctttctatcataaccagtagaagattcaccttgggggaaatctggcattaattatttatcgtccgtgtttgaaacgtaggccttatttagttcccaattttttttcccaaaaacatcacatcaaatctttggatacatgcatggagcattaaatatagataaacaaaaaaactaattgcacagtttgcatggaaattgcgagacgaatcttttgagcctaattagtccatgattagccataagtgctacagtaacccacatgtgctaatgatggattaattaggcttaataaattcgtctcgctgtttcctatcgagttatgaaattagcttttttcattcgtgtccggaaaccccttccgacatccggtcaaacgtccgatgtgacacccaaaaatttttttttcgcgtactaaacaaggccatagtcacttggttgtctaactaagtgattggttttgttccttttttgcatactcgagagttcaaagaaagtagcatctcagtcacctggttgtctaattgatttggttttattccttctttttgtgcaggctcgagagcttcttctcaaacaaagtagcatctcagcttgcccaagcctcaacgaagaactgacatggtctttggtacatctgatatagtcaattgttgttgtaaaattgttatagctctcgccccccttgttgtgctttccagctttgtagttttaacgtagcaatctgatggcgtgtttaatttttcaccaatttaattgcttacattaagttggcatgttgatgggtgagttggcttgtgcaaagtatttcagaatgaagaggaaaattcacagggggcagtaaatttttcgccgggcaagagtaaaattcacaaaaccacactttacttaatgaatcaggtttgtacttgctcgcgcggctgttgactttgtttgaaaaaaaaaaatcatgggccaacgtgcataaagaacaacaccctcctggattgcactattttgcaagtattgttgttggactgatcatcaatcacggtcagagcagtagctagtagtaattagtaaatccgactgaatttgcatccaatcatcaagcatgtgaattgaagggaaaaggaaagaactcaaaccaattaaagtctccatttacttttttcaatagggaagtctctaatattttggagcactcgtctacggacgagctccatgaacaaggcttacaatggcatctacctgttggactagattaaaccacgtaatttcttcctccccttcttcaagttgacttcatgcagatgcatctgatgctgatatgctaagatgcttcttgaaccagacaccaatgttgaggaagctctcaaaatccgattgtggtctgaacaaaagcatggattccagtatgagggagaaaattaggcacaaaagcaatagtacaatggcatctgaatgtctttttttttttcgaacggctgctgccgacattttatataaagcagatgagctgaaattcggatcagtacttgcttacatgtggatttcatgtatgtcgtctgggaacatcatgatcctgatctcgccgcctctttctctcagagctcttgcgtactgaaatcatccgagcaggaatagtttaaccaaatccgacaaatgagtgaagcaaatgcaggattgttaggttattaatcgagtgtagatgaatttaaagaatgtctgtttgatgtagcccgtcgattgattttcttttcacgggattgttaggttgtttcaggatctagcctttttgttatggactatttctacaacgaattgaaagtggaaactactgaggcaaatttaaacggctattgatgtacctgtaggccattagaaatggggactcgaagatctgctcctccaagaagcataagcaggggcgctttcacctgttgaaatcagcaaagtttttttttttagaaaaaaaaaatcagcaaagttcagtgagcctttttgagtagctaatcacttgatttctctggttcatttgtttttaagaacaatgacttgatcagtaagaacatttcttttttgctctttgaatgaaggcgagaacagaaatgcaccttcgaaatatgggcaattggtgatttctgatagaagaggcgaagatgatcaggtgaaggagattcagaggcatgttgcctcccttcactcccacaggccactgcataacaccaatctggaatgtcagtggtgccaatcatcagtgataggttgcagactggattacgagcagctgccaccataaatctatctggagcctgaaacaaaataacaacaaattacaagctgaacaagaaacatatactaacttctattaggattttgttcttcttcttcttttcctttgagaggctaaaatctgttaggatgctaacctgaccaatcagatgtgtagtcaagaatccaccgtgcgaaattccgatgacagctactttagatgcgtctataagtcctccctcaatgacatagtctagagctgtaaggcagtcttggacatcctgcttgacagtttgacacacatcagaaattaggttggttcatgagaaacaaagactcagagtttagctggattacatacctgagatccaacctttccaggaagtgactgcaaagcctcctctccaaaacccggtgtccctctttttttttcagatgatagtgagatgatgccataagcttaattgatcagaactgtagaaatgtttcagcaaacttaccgataatttacaataagtaggttaaatccaagtgatgcgaggaacgccgatgttttcgaatagcttgatacagatactgagtgtgggccaccatgaaggactagaatagttggtttgtgcgaactgtccttgcaggacacaaagatagcttcaaatggaagcttactgcctgcaggatataaaaaacatttgcttggtgaatgatgataagccacatatgatagtctaaaatatttgtgtccatgactataccatcagagaggtcatcagaggggttagtgactggaatttttagtatgctgaattggtgatgtgacaacaaagcctttacctgcagcagatggtaatgtgagaatgaaaaaaaaaagcctgatttagtaaattacattgttcaaagcatcaaagaacacctaagtatacttcaaattgtacaccatctaaccttattgttagctgccatcaatggattattattaacttcgtcccagacccatgtacatgtctgatccttcaatgacacttgatggccatacttaatttgaggtgggtcgatgggactgcttgacactagaaaacaaacaaaaataaaataaaattattacacccaaaataataaaatttgatgcataagttaactgattatgtgcacctagaattaccagcaagaacattgtggccatctactgcaagagcactccatgagtactctgaattttctgggcttattcttgttgcttttccactgcaggaggaattaaggaaatagcatgggatattgcaatgatttttgaagcagtagaaaggcatatgtgagcaaccttgtttacctcaacacatcgattgataatatcacttcagtgcttctccaagcagatgtcagaatcattgtacatcgatcagaaagccaaggattcgatagcatggaagaacaatacaaaccaggaaaacaaccatcttgaggacacattacaattggaatctggcacagttcagaagttaaataaattgactgcagacagcagataagtaccggtcaagacaaatctgaggacataccacatcagtgatttcgaggtattgatccattttccagtcagaaggccagttgatcttatgcagtgaatctgttgcattgtgcgctccactgtctacagcacgatttgcagatagaaacaccagaagttttccatccttgctgttgaaaataattagagattttccgtgaagaatttttctagcatggtttaaggtccttcaagaaaatacgcaaatactaatgcgggcatacctgaaccgcggaaagaaagcactgcttatgcttggagttaagttgattgctactgaagcaggctctaatttagaatcactggaaaaatgtcatggaaatatcaacttacaactgccccataagcatagttattcagagctttacattttcttatttcaacaaactagtgataaataaagtaaatttgtaaactttacaaagttacagcatgatctgaagatgggtgctcagttacttacctagctggtgcattatcaacatctgattcttcgaaagggcaaagagttgagtatagagaacatggcctattagaacagtacttgatgcctagttttctaggagtattctgaaacccattgtgctctaaccatccaacaaaaatcagatacttctgccttccacatgaagatggtggagcccacacaacttggccaacgctcaatgatcttgaaatgccttttgcagctcgtacttctccactgaatacaacaaataaacggtttcagtaagtcgtattgtcagatctatggtcaggtcaacattatgtattaattagaaggtgctgagagacctattaatgtcaaggacaaacaatgaaggtctcccttttttggagtaagtttcaccccaatcctcttcccaatccccttgccctttccagttattgcagtctttctcagaagaaccttcttttctatatccagtatcatcaaaaactggttttggttcaggtgaatcttcagcaatatatgctattaaggtctcttcttggttccaggaaatcccatgaaacctgtgccaacaaaaatagtatcatgatccagaatattgtacagataggttgaatggactgaaaagtgcaggtattatgctgtacttttaccactcatcagtataaagtggaccatggacagactgagctacatgtatctctttctccacatgtgattgatcaacaatttcaagctttgtaggggaacctttctctccattccgcaccacaagaagctttgatcccgatggagatggtacgacagccgacactccatccatttgaatagggaaaggagaccattgaaagtccagaaggttagtaccatttctcataatatgagaaaacaaaatatattttctcttgttgtttgccagtaggtttgtttggctaatcgaatacattgctgtggatctgtcttctgcaaacatgacacaagagttgctttacgccacttctggaaaatagtaaaatgatgattactaatgaggtataatcgaaaatcatccctaccattgttggtctggaaaacccaagcaccgtcaatgctgggagcattggtgaactcttgaagtagtttcgactgtgaagcgtattcttcagatgccagtgcatccattcccaatggattgtctttctcaaagaagattcaaatcacttgtaaggtcggttggaaagacacaatctactgggttaagctaaatctgcattgtcacaaaggttaatatgctgaggaagctgaagggaaactcaagaatatagtatgttaaacaagctgcagggaagctcaagtatattttgttgtcaattccactgataagatgaaaactgagaaacctgaattcctgacttcaacttcatgatgtatgggtatacatttcaatgccaaaagagcctagaggttagagcacaccactcaacctatatcaccttaactctttcataattcaaattgcagttacccgtgaaaaatttcaggtactaccgtactaagactcagatttcatacactttaatgtagttcagacacaaactattttttaatttatacttcataaattccattaacaactcaagaacaacagtcccaattgttcatcttgcaatccatggacagatttgacgttgtcaatgcaccaattcaagaaaaaatattgaatcacttagacaaacaaaacatggaaacttctataatggctacctaagattaataaaatgaagtatctttcattcttccttcccaccaaaatccttttctggagaactctgacactaaatgctttgattttcatgtagtacaaaagtataaacataactaaaaaatacgatgaacactaaaaaatattaaatcctggatgttaagtctgggactagttctactaacaaaatcagattcttctggaactacagcaataatcaagaggaccagactgagtgcaggaggaaacaacttaggaccaacaaaattcagcaagttagaagcctcaaaacaataaaatcagattataaatcgtattagcctttcaggagacgaaggaaaggagaatacttacatatatttttctgcttttgcagtgaagtgcaaatggagtctagtggcagagtggttgatccaagactgcagttgagctttaaaacatcatcagtccttagcaacgatcccaacaaacctaacaacaaacaattggtgaggatcagatggcatcaaattttggttttctttttgtgtcaggtctcaaagaatgggcccaaaataacaaaaggaatcttaaaaagttactaatgatcgtacataccaccatagacaatgagacaagaggaacccagcaataaggacaaaaggttgcgtcaggtccgcatccacgaagaaagcatcgaacagcacaagaagcctttgcaataacttatattgttgtcctttttaaaatcgtatgaaacaacaaagctctttgtaccatctgatgaaaatgagattatccagaaggcaacttcaagggatcttgatgcaaagaagcagaagttacagtggtctcaatcagcatttccatgtgcctaacttgaactgaactttcatgtatttttttctcactgaaattcaaaagaaattatgatcccattgtttcctaaaaaaagataaaaataaaaggaatgcccaagcccaacaggctacaggacagcatcccgtgaactagaagtacttcaaagttcaaagtaaagcataatctaacatcacatatttgtaatccatagttccgtaccacgagggtaaaattttataaccaaatgcatttacattttcaagaattatcccagtacagaaatgttacagcaggcttaatttattagaatgccaacagaaccacgtttccttgggctgctttgacccaaattacaagcatttattaagcaaggtgagagtgtggtaacagaggcatgttgtttatttgctcatgtgcttcttgaaccaaacacctatattgaggaagctttcaaaatcagactgtggcctgcacaggggacgcaaggttgacttagtcaaatgttgcaacacagaagacactgatcggggtaacaaaggtaaaatgattaaaaagtacaactaacttgtcaaggccatgcatatcttctggaaagacaataattttggtttcaactcccatctccttcaaggtccttgcatactgcatatgttgcgattatgattaggcataaaccagcatttgtaaaagtgaaaataaataaatagatacaagcagtatatagtggaacaatatgaatcatatgctttcactaatggttttcaggaaaattgactgaacttgtctacgcaaacaataacatgaatgcaacattgctactagtaatcatttcacaaccctttcatcatataaaaatgaaacagaagtgcataagaaattacctgtaagccattagaaacaggaactctgagatcttgtgctccaaggagaaaaagtgttggcgtgctcacctgcagattttcttaaactgtcaagaaaagattactcaaagtcctcaaggagcaaatttgcatgagggaactacactttcttcctcaagcatagattttgtaaaaggttaagtatgcagaatctacatacctttgatatatgtgatattggtgatttctggtgaaattgacaaagatcatcaaatgaaggatactctgagaagcagtttttcccttctttcccataaatctccacaaaacaccactcaggtatgtcagttgttcctaccatcaatgataaattacatactgggtttcgagcagctgctgcaacaaaagtgcctggagcctgcagtccatgaaacataaggtcaacagaatccaagaagacctgataaatagaagaatccatgtgctattgcctgtgcatcatgaactcttattgtcttgtatgtatagtcataaagaaactgtatagacctatcatgaactcttattgtcttgcatgtatagtcataaagaaactgtatagacctagttcccacatgcagcagtagtttctcactatttttgtcaaggaaataattatattctaaaatcaggaaatattcttgagaatatcacatgtgaacttcttaatcatgaaaaggtaaaaacagctcggcttacactgcagtgaagctttacttccaagaaaaggaaacaaatgctgatcctaactcttgtaagaatgtttttctaggatattattctggacttaagcgttgcaatgtaatatataatttaatagctaatataaattggtgtcatcatttttttaaaagaatttttagctgtgcactgctacagagctcctgaaatatccaagtttagctttgagcctttaagttcactgaccataacttagtgtgcttgggtacttatattaaacttactactctcttttacaaattacaacctccctcccaaaattataagtttacagcacatttctcaaatataagagtttcatatagaccaatacacattatcaaaagacactgttcccaattatgtccaaatgagtatatacagtttacaacaagaattgtgctagattatttgtgcaaacgattaggcacaaataattgaatccctaaaggaaatataaactgcaaatgtaatgaataattgcatagataaagaattcagaataacaaaggcatgctaagaacctggccaatcaaatgagttgtcaggaaaccaccgtgtgaacctccaacaacagctactttagatgcatctattaatcctttctttataacaaagtccaaagccgtcaatacatcattcacatcctgttcatgagtattaaacaattgtacgtaatgacagttcatataaaatttctggcaacttaagaaaataatcttaaaacatggaaataaatcaacaacagtgcacctgagaaccaatatttccaggaagagattgtagtgcttcttcaccaaagcctagtgaacctctaggcaacagaatggtgtgtacgtggacattaatgttagtgtttaatatgatatatttccaaagcagaattcagaaaggacagggtattttaacctagttcaacagaagaactactggaagaaaaaaaaataaagctcacctatagttcacaacaagaaggttatatccctgtgaataaagaaatgctaacgattttgaatagcttgatgggtaaacagtgtgtggtccaccatgaagaacaacaattgttggtcttgttgcagaatccttccaggacacaaaaatagcctcaaagggcagcttagcacctgaatcaattttataaaatataaaaatttaggaaggggagaggatgtgagtattctactaaagtacattttcaaacattaaaatgcaaatgaagcttagcatgcatccttaaggatgcaaacaaccaagaagagtattctaccatgagctttgagaactttcttacaaatgcattttagtgttgccttgagtaaatgcaacatggttagattttgtcgcagttcagaatatatcagcctacaagtactagacagtacagctgatctcaagaaaaacatagcgtcaactgaagaatgcagtaacagaagtattcaaaacacaaggcaccaaagagtaccaattccaggaaaaaaaaacagtcagaggctttttttttcctcgaatgcaggagagctgtctgtcatttcattaaagaaaggagctttgggttgtacacataccatcagcgagtttgttagaagagttgctaatcgggattttgagtatactgaacttatggtctgctaatattgcactgatctgccaaacatacatcacagaaactgttagtactttacactgccaaaatttttgtcagtgtttttggggaaaagttgaacaagcaacgcattttttcagttataccttatcagaaggactcggaaaaggagttgcaatttcttgccactcccattggtttggttttccagtctgacaaacctcagacccatagtatatttgaggaactgtaataaggctgcttgaaactggaaaaggtgggaaaggcacatgaatatgaaatcttatccaaaggaactatgggatacaactgtaacttcggtacggaattacctgcaagaatattatccttgtctagtgcaagaacattccatgaataatccgaatcctgaggactaactcttgaaacttcacggctgtgaagaaaataggtaatttcataaataaataaactttatagccatatcattctaactgatggataaaaatgcttgtaatcacctcacaacatttacagaaagtattacttccttacttccccaaatagaagataaaatcatagtttgtccatcagtaagccatggattcctaagtatgccagagcagtacagaccaggaaaacaaccatcctgagggcacatcacaataggtacctacataacagctaagacattaagaacttgatatcggatatgcagagcacctataaaaagaaacacaccattataaattttaccctctgaacttcgttcttttaactgaaattgaatttagatacttcaataattaaaaaaataattgaagttccacttcacaaagtccagaaatacatatctttaatcaagtatagccaacaggcaaacaatgtgctcaaataaacactggttagatttatgtatttttccaagccatgactttgaagctatatataaaaggaagccatctaaacaaaatgatcgattaaaaaattaacaagtaaaggaaaggcattgttgtaccacatcagcaacactgaggccctccaatttcccatctgcaggccagtcaatcttatgcattgaatttgtcgcattgtgtgttccactatctatagcactctttgctgagataaacacaagatactttccatctggactgtacaataaagattccatatcatttttgcgacgcattgttaacattcatctacatgcatcagctaccagtactaagttataatctagacatgaaaacttcaattgtagatgtgcaaataaaatgtattggtgttgcagtaaattaatatctactgagtcaatccacaggattacaggaacaaggaaataataaagacacctactcatcagcccaaaatgctccactttccaaattcactcccatttgaattatgattgttcaaatatttaggttaaaatacatgataacaagcatgaacaatcaattgacatgctttaagggaatttgattaaaatattttaaaccatagaagaaaaattacgcctaacaattataatgcataattaaagaaatacggctaggatgtgtagcttgtacttcttccaatataatagttgagacatatggcctaaactgaataacagtactgagcaaagaaaactgaatgcagtcctacctgaatcgtgggaaaaaagcactgctcaactctgatgttaacttggttgtaggtgcagtttcacccttactgacactgtacaataaacagaaatgacatcagaaataaactttctattttttgagacatgatgcatacaatccatttagcatttgtctgctcaggactaggattaatgaggaaaaaagagtgaaaatatatatggaagattttttttccttgaaaaaaatatgctgctacaattattctgagagaagaatttacagtgtcacacgatcactagaaaataactaaaatgtgacaattaataccttaatatgttagaacaggaagcctacaatggtgcatagttgaaatagaactgaataaatattgtcatcaaggacaggtgttctcacttaagtgatggcttatcagcttcttccatgaaaggatcaggaacagcatacagagcacaaggtctgttaaagcagtatttaattccaagtttccttggtgtcttttggtaaccattatcagatgaccacgccacaaaaaccaggctatgtgatgatgatggagcccaaatcacttggccaacacttaatgttctcggtatgcccttcacagctcgcacttcaccgctgcaatgaaactattcctcacaaaattgcagtacttttaaagctattttggattcaaccttcagaacaaccagaaacacaccttgaaatgttgaccacgaacaatgcaggtatccttttcttggaatacgtttctccccaagtttcttcccaatccccttttcccttccagctcttgcagtctttttcagacgagccagccttcttgtatcctgaatcattgaattctggcttcggttgaggaggctcctcagcaacgtaagctactaaagtctcttcttgattccacgatatcccttcaaacctgcatttaagaaacatgaagtacaaaaagtggcgaatggagcaatctctcgtccctaattacctctgtctttcttccaaaaaaaaacccactaccacacaaaaaactaagaaagttgttctaaaagaggcaggatagtttaccattcgtcgacatagagtgatccatgaacagattgtgcaatgtgaatctcgttctccaactgacaggggccccaaacttctagttttgtaggggaatcatcctcagaattccgtattagtaaaagttttctcccagatggcgatggaattactgctgaaactccactcatttcgattgggaagggagaccactggaaatccacagaatttgaggaattttttgagatgtgggaatttaataggaagctcctctttttgtttgccaacagatctgtttggccaacagaaactatcgccctagatgtgttttctgcacaacacgagaagaagagtaagaaacctaagttcagtaaaaccagatagcaataacagcacataccagtcttggaattgaagatccaagcgttgccaatagtgggaattttaacgaattcctgcagcagcttggactgggaagcatattcatccaccatggagacatccatccccaaaggcaatcctttctcagtggctgcttctgaggcttgtgtggtagccatagctgttgggtgcgatgatattctactaatgctgccagatggagtcaatgaggttaaatcagcattgccagaaaagatgggtcaagtgatcactacataaagcagaccaagaatttcgagcataagacttgctactaggtcctcaacataaaaataaaaataaaacaatacatattctaagaacaaaacaattgtgcgtcattacaactgatttcttttcatcgcgctgtccccatcatgtggcactttttttttttacaatacaagtcattgtcttagcactatcaaaactattgcctctttgcaacaattcaattaattcttttgaacccaataaagcaaccacggcactgaggctaatagatcactgtccactgaataaaactgattttacattaatacagcaaactaagaactagccgaagtggacaagacatattatctgcagcaatggtcaatcacatgttatgtaaattagtaaattacatccccagctagctagtgattcatattactccctccgtttcaggttataagacgtttagactttggtcaaagtcaaactactctaagtttgactaattttatagaaaaaatagtaatatttttaacccaagacaaatgtattatgaaaatttattcaattgtaaactcgactcctttatctttatacccaaaaaggagacccgcacgtacggttttcagggggatccggccggccggtgcccacccgattagagggactgagaaattaattgagtacaaaacttatcttcaagctttgagtgctattccttttatgaaattacaccgggaaggaattgagcaagccaagtcatttaactcactccacttaagattgaacaaccccagtcagtgttggcagtcttcctataagataatcatctttcctttgttttgacattcgtttgagttctttacatgtacgtacaattacagctcgtcttacttctgtctgatctttctagaggcattttgggcactgcttctttgattacagcaacaataacgtcaccaatatgagcatatcagtgattaccagctcctaagattcgaatacatatcaattcgatagccccgctccgttgttatccgctacattcaaaagggtctgagtgagatggatcttggaagtctggtttttgattggatagtgatctcgggcacgagtggttgatcttcgcgggccgtgaatggccatggaaaggagtattgatgtcaatatgttcgatcgagaagattggacgatgaaagacggatcctttgtggtttgaataataggctgtggtctcgatattgggctatgggctgattgctttctatatgagcctcttgtgattgggctctcgtgggcggattacccgatgtgtactcatcttccaacaaagaggagaggacagggctactgttggtccacgcatgagagctcctctgtgtctttccggaaattacttcgactcgcaaaggtgaaaccagaggagattcagaggcccagttgagaacagcaagtgtacaatcaatcggtttccgctccttttctatccaatttgtttatgtttgttctaattacaaaagagaacaaatcctttatttttgcaggccaattgctcttttgactttgggtttttcctatgtggataggcatcttgactttgattaagtaattgccatgcaggttgagtatagtggaaggcattagcaataacctgtggcctttggttctggtaagaacaatgttggatatcaagaggtctcaaatcgtttgaagtaagttacaacttataactggaagttgataaagcgaaggggcaattttggaataatcgtagcgcgctagcgcggctcgcttcgcttttcgacgcggagctcgctgctgtcgaagcctgcttcaaaactacagggcgtgcgttagcactacggcttttcagcctccctttgctggttccgaactatcactgatcccagaaccttcaaacctttttcttttaatctcaggaaggctttctcggggagaaagcaggttggggaactggttcaaatcgttcattcgttaggatgcctcagctgcatacatctaaggagcaacgttcttctaggtcctcttgcatttccagatccgcatgtaaaaccaaactcaaataaattcgatccttttcagtcagaggccgctcgggagtaggaggtcgtggactcgcggattctccttcctccgcgggaaaaatttgggaagcccttctcggctcttgcctggcctggagttgaagaaggaactggtagcacttggatcagaggaagatcggaatagcagacgagttgcagcttttagtattgttcaaagcttggatgccgacgacattctaggatgaatgtagacccatcgggcagggataatcattccggtcctgggagaggtggcggcatcagtctgagctgggggaagccagccaattgaatcactgaaacgaccgcaggaggcgcaccctaagcccagcttctcggagctgctattgcgaaatacggcttccttaatatcaaaatttcaacaagggggctgggctgctcgccttcatagaaaggcctcgggacgagggctccgttccctctgctctgctgcccggaggtatagatcgagtttttattttccaaagtgcttcctccggtcagcagaggggagcgacttgtcccttcggaacaactacaactaacgagttcttctaccccgaaaagtttgaggcaaatgaacgcatttttgcccgtcgtctccgagctatatatcctcgcagaattctggtcattgaatcaaattaaccttaatgaataactatcctcgacgaggacagtgaggctatagtactgactatgcataggactacaaaggttcaaagacaggatgtattcgacccttggatgtgatcggcaagagaaagaaggaattcctttggtataaggaaggaaatcaaacgcgttgtttgagaaggggtgcagcagaacgatagagactccatttaacttaggttgatttaatttaggccggaggcagacctaagtcaaggtaatccttctttgaaacactttggtattgctttgacgagaaagccgtctagcacctgtagctggcttgcttcacgtcccgctgtttgcttacgagtttggtagcgagccgaggcagacgtttgtagatcttgcctcgaagcctcttcacagttgatagcatcatataaatttaatgaaactatgcttgtgttgtaaatattactacttttttttctacagagttagtcaaattcagagtagtttaactttgaccaaagttaaaacgtcttatgacagagagtactgctcaatttctgacttcaccaaccaccaggaaatcaaacaatccacaacaatctcataccgctgggtgccatcctaattttcagaaaaccatccccattaaaggaaaaaacagaaacagtaacagaggcgcagatggctcagtctcacacccgaatcgctaccggaccaagcaatcgctcgaacagataaaagcgatccaaaggaggacacacctgatctctactaatcctcctggagaaatccccccgaaaaaaaaaaacgacacctcgtgaactcgaagagccccgctcacctgcctcgccacggggagtacccgctggccggagcagcggcacgagcgcgcggggacgacgaggagggcgccgccgagaggagcaaactcgcggcgacgacgatggaggagcgggagtagaatctgggagtgagactgagacccgtggctaaaaccaccatcggcttgggtggattcctttgggtattgggctcttttcgggcctctacttttttatgggggtgcagattcttatccttttcatatgcttgtctcaaagattaagccatgcattctctcggtcaaataaaatacaaatctactctctctataaaaaaacaaaattgaatgcgatacataccaggacaataaatctggacatatgtatatccagattcatagtaatagaatgtgtcatatttaatactaggttaatttttacgagacggaaggagtagtacggaatataacacaatatctagattcgtagtatcaggatgtgtcttaatatgtactaggtttgtttttttaatggacggaggaaatacactattaggaaaatcacatatactatctccgtccataatatagtaacctagtaacttatttagattcatcatactattatgatatatttcaaccggtactaaattgctatattacagtactatgagatggagaggatgtgtcttaatatgtgctaggtttgtttttttaatggacggaggaaatacactattaggaaaatcacatatactctctccgtccataatatagtaacctagtaacttgtttagattcatcataatactagaatatatttcaaccggtactaaattgctatattacagtattatgagatggagggagtaacacattcctcttgctttcttacatgtttagaaagcttctaacagctacaacttcttataaaatttaaaacttttttaaatagtccagtttctcatccaaattataagaagatgtagttataaaatctagaaaatgaactataagctagaagctgggttttccagactctcataagctagttactaaccagttgtttctcaaaattttaaactcatcacatagacactaagtactccctccgttttactgatacacttttttttaaaaataataatcaaagaataggatgagactaaataaaagggagttgccattgattatgatgaggaaatagatagagcagcagctctattatggataaaatttaaatgctagaatagttgtattatgagatggaggtagtatgttttaaatatcggaattgctaaccttctattatgtcccgattcgtgatgcactccttctactctaactctggcgaccggcggtgactcgatgagttagggtttaagcctttagggtcccgggttgggtggggataggaggagggttgggatagatggaagagaggagaaatcgctgggcttagggggataaccgtgggagacgacggcctagtggtggacggtggttctaggtttctttacataataaacatgcaaattatccatctgattatcctatggaagattgatacataataagcaaacggaaagatcattttgtaaatctaatggtttgggaaaatacctcactgttttgccttcgatgcttcctcaggagcgttctccttgcatcaatttgatcaggtcatggatggagcagggagacgacaccagaaggattcgaattagaatctccttttctctggcagggccggcaacatggagagaagagggtttcaaaaggtaacgagggaaacaaactcttccccatccacatagacgaacagtctatctaggcgctcgggaatcccgggcattcgaccacatgatggaagtatggaacgaccgttaagatgtactagctcctgcagagctagatcattaagaatgagacggaagcggcccatcattcgccggttaaggttggtgttgtttttcttggtctcgatagattagattgaaattggctattatgatcccaggacagacacgatgggctctaatatctcggatttcatagagaaaacaaattatatttgggtcagtttgcgggccatagacgatagtaatctagtggcacgacccgtcaacaaaggatagctctgtcgtgaaagataacgggtacgcctaatgggcaatcgatcaccgtggggatgggatagcgatcagattcgctccccacctccccccttcctccctcctctggttttcttttttggcaccgcattactttcatattttagtaaatttatacagctaaagtttatacacctaaagtttacacatctaaagtttagagactaaaagtttataagtcaaaagtttatatatccgattcaaatttgaatttgaattcaaatatttttttatatatagtatttctatacatctaaagtttatacacctcaagtttatagacctaaaatttataagtcaaaagtttatatacccatttcaaatttgaatttaaattcaaatatttttcatatataagtatttctatacacctaaagtttatatacctaaagtttatatacccgattcaaatttgaatttaaattatatctgattcaaatttgaatctgaattcaaatattttctctatgtagtatttctatacatctaaaatttatacacctaaagtttatagacccaaagtttataagtcaaaagtttacatacccgattcaaatttaaatttgaattcaaattttttttatatatggtatttctatacataaatttttctaacttttgttttttaaaaaaaattgtatggtttactgtagtagaaagaggagaagggaaggaggaagggggagaagagggaggagtacatctagtagtataggggagagggtgggcgggtgatcgctaggcgggtgggggagngatcacccgcccattagcatttccgaaagataactggccgagagagaggtttttgcaagaaaccgcactatttacttctacaggagagatggaatgacgaagccgaattggtcggctattaatttatatcctagcagcactgcctccctccccatcgagcaatctacaagggtttctcaaaagggcttgtgcttgtgtatcaagaagaaatggttgcctcttatatttgaagaccccacagagttcatgctagtggggaaattcgtaccttaactgtgacccgctatcgcacgcaaatgcaattcttcctcattgccgcttggggcgcgcgtttgcgatcaccccctacaccattaatccgtatttgtatcaattatatgtaaccgttcagaacaagaatagagtaataataatatgtggcatacaaatatttatcaagagaaaactacacactagagataatgtttcatttaacttaggtcctgacaataaactaccgagtttgtattcataatttgtcacgacccaaatattttttttgacagtctgtcgtatccttatatatatatatatatatatatatatatatatatatatatatatatatatatatatatatatatatatatataagtccataaggatataaggcaagatgtaatatctaactatcacaactagagcttggacactttcaacaatggttccatttatttttcaccagctacattgcataatacatcggttgattcgcttaccaacttattattaccaagacgataccctatacctagcatgatggtatgtcctcttgtatgcttctaaagactaagtagaccacgctccccattaggtttgcatgtcatcatttccctcggacatctcgtcttgactagtttctgcgcacatcaaatagtaaatatatgagtatattacacatactcagcaagattagtacatatagctatatagatgtttttaaagacagaaaatactactacccttagatattaacaaccgataaataatagaagacatttaacatagtaaatgagttaaaaatacactgcagaggtattaaaataatcgtcataatatcgttccttcaatccattttctcccccaattagtgataccctaatctgagaatcacgccgctgaattccctagttgtgtgaggcattcctcatctcacactgatatcagccgactcgatatcgttgtttcaggtatcggccgtctcaggctaagtatcactatcacgttattattctcactgataaaatcatcaatccattattcgtgtattaataatatttactgttagattgttagtatcaccatctcaatgtaataatggtaagcaaatttagttagagatgattaagtaaaatagttgatgggcgtagtcttgcctagttttctatcgttctacccgtgcgtttcgcctagccaaatatgcaaatctttgatattaattaggccgtgtttagattccaacttttttcttcaaacttctaacttttctgtcacatcaaatatttggacacatgtatggaacatcaaatgtggacgaaaaaaatcaattgcacagtccgactgtaaattgcgatatcttttgagcctaattacgccatgatttgacaatgtgatgctacagtaaacatttgctaatgatggattaattaggcttaataaattcgtctcgcagtttacaggcggaatctgtaatttgttttgttattagtctatgtttaatacttcaaatgtgtgttcgtaaatttaaaaaaaaaattagcacacgaactaaacacagcctcaatatataaattttcatgcatgacagctactaatagaagatagctagttgatgtgactatgctaaagggacagaaccaacaagtactagtaggtgcttccatgcatgcatgtagctgctgttagccagagtattagtcttttcactaatatattagtatattttttacactaatctatctattctatagctagacatcaggtgtttattctagccatgtactcacaaaaaccaaaggacaatgttccatacattaattaccgggaaggcttctactagctctaatcactcaactcatggaccttgccacagccagcgcagggaaaagtactactcatgagacaagagctgtaggatcacgtacggcttaaatagagcagcttccttcagtctgaagcggacatctgtccaaagccatgatgatggagataggattcaccctctctcttccttaccctagaagatcctatccatcaaccctcagtgatatttatctgtcctcctccccaaaaacaattcaagaatgtatttaaggtcacgtatcgaacagtctcctgctgctgctgctattattattattgttgttgttgttattattattattattattattattattattattattattattattattattattattattattattcactactacataatttcatagatgaacataaaccaattcagatggttctaatttctagattcaaacattgtctgattacaatatctagtatctcgataccgcggctgtcaaggttatggataccacatacctaatagtagtcgactacatctcggcaggacgcaccacgtaccatgtcttatacggaaactaacttcagatatggagggagttccggataaggaaagacaaccagagttctacatggaaacgacaagggctactcggattgtatccatattggtttccctagttctacttagacaaggggacacctatatgggtataaatacaaggcccctagaagaagaggggacacaatacacgggacaacatacaagccaacatacgccaagacaagacgccggatatcgacttcagagaaaggcacggctagtcccatacggtgtctccagatactgtcaggagagacgaaagcgctatctctgatctcgccgggcacggattcgaggaggaagactaccctgtcatcgactacgagtcagacattcaaaccgccatgtcgacgacggttagataggctaccccacatattgtactggtgtgattatggtgaataaaagcaactccggctccggccaacaggatgtagggttattacctgacaactcagggacccgaacctgtataaaaatccctgtctccgtctcttttacctcagtctcgcgtatatcctagcaccgacgatccccatactatgtaaataccagaattgcgacatcaaacgtcgacagtagcgcgccaggtagggggattttggtgcttcagggtttcgacgagatgagtttaagagatggattctccaacaacaacctactcgacgacttcggttgagagggagatctaatctgaccagagtacgtgccccgacaagatcggaaccatcatcattaactattcgatccggcgagatcgaccaagcttcaagatgtcgccgctgcggagaacaacggttcaatgttgtcgatcgtgaggcctcggcccgattgattactttgagaccacgtcgccgccaaaaatctaatcaggagagtgctcccgcttgagccctgtcctcgtcggcttcgtgttgattctcgatgacacacaagcacatgacgaaaaggacagcgaaactgccctgtatgccgctccactcgcatgcaccaggctaactagcgggcatccattaatctccttgatttctactcggaatacaaaccatggcagaggacctaacgtcacgctgttacagcgtgtatattttggtcttgctgtcaatttgtctacatgcgtgggcacaaagccaaagagccacgtgtatacaggagtaaccaccacagtactcatccacggttgcttcacttgtacatgtgcagattatccaactacatcaacagaggtaattagcagattgaatttttaaattaatctactaatttcgtagatatatccggcatgtatctacaaaagtacgtaatattttatatgtaatttatcgtacctattcagatcatacagcattatcagatctataatttattatgtttacctagagcatattttttatacaatatctattgtgcaagcgtccccgatgttaggccaactacggcctaacgctgggggctcgctctgttttcttctgtataaatcatgcttgtttacggtttacataatgcatgatatttacatctgcatgttatatcctgataatgctagaagatccatgcagtttttttaagtacatactcgatattatctgctatatatcttgccttctagaaaatattttttaggaacaattgagcactcgagtaggttatggtcgagtacactctattatcgagaacattatcgacaaatgcggagttatcgcacccaacctaccaacgaagaccgacgatctatctcatagcaccggccatcgctggactactcaagaaaaggttgttaacggataattcctcacgaacgccgtcggcttgatcacccgacatgattgcgaacggatatccggatatgctataagttgggtatgtgagtcatgctggccacatgagatacacatgtaataaaccaactctagcactttcattggtgttcgagagataattctacacgttcgctggttctcacaccagtatgtagcaatctctcacaccacaacttctattggtgttcgagagataattctacacgttcgctggttctcacaccagtacgtagcaatctctcacaccacgacttccattggtgttcgagagataattctacacgttcgctggttctcacaccagtacgtagcaatctctcacactgcaacttccattggtgctcgagagataattctactcgctcgctggttctcgcaccagtacatagcaatctctcgcaccgcaacttccattggtgttcgagagataattctactcgctcgctggttctcgaaccagtacgtagtaatctctcgcaccttaacttcagatggtcgaggtatgactacggcagcgtagcggtcctcgcaccatgactttagatggttgaggaacagctacaactagtcttcgaccggcagcgtagcggtcctcgtaccacgactccaaatgatcgagagacacctactcactggttctcaaccagttgatcgtagtgatctctcgtacatttgcttccagtggtcgagttacgactactacctggtcctcgaccagtggtgtagcgattctcccactacctttacttcaagtggtcgagttacgactactacctggtcctcgaccagcggtgtagcgattctcctactacctctactccaacaaagttggtatcaggtacacactatcgccaagtgttttacccagagattccttaccacgacgacacctagcgttgaaacctatcctactgtccctttacgccatcttgacaaggcctccgaggaacctaagggaacttcggctggggacgcccagagccgataaggccttgtcggatcctgtagagacaaaagaccatgtaagatctggtcatgtaagagttctcgccgtgcgtattaaccaagtcatgtaatcggaaattgagttttccaacttcacggctgggggctaggatcagtgcttgttcaaccaaggcaggtcaagggtccaagagccttctcctccgagaacgattctccaacgacaaggctagggtctagggagagtgtatgactctacaaactgactgatcaaagtcggtaagagagaagaagctcatacacaaaacattggtcggtaaatttaattcatttttagttttccatatatattataacatgtcactctttgagcgttcgctcgggggctatttctatttgatattctcttctgagtattgatttcaggaaaattctattcgacattgacgaagactccatgtctctatggttctacaccaagatcgactaaggcgagtacgacaaatgtcgacaaggctccgtcgcagactctacaccttctcgatcgctcgagaatggttgctggatctcgacaaggaatacgaaataaagagatggtgtaccagccgagatagaatttcttgatttcaatccaaattctcgattacggcaagacgggagacttagtcgtctactccgtacttccttggttgacatcggagattgactcagacaaaccctataggtgcccgcacgaggctgataagggaagtctaacgttatctctgaactcgccgagaacggtcacatgagcacgacaacagttactccagggtctacggttgagaatatgaattcgttcatttgcattgaagtcgggggctactgttagggttatggataccacatacctaatagtagtcgactacatctcggcaggacccaccacataccatgtcttatacggaaactgacttcagatatggagggagttccggataaggaaagacaaccagagttctatatagaaatgacaagaactactcggattgtatccatattggtttccctagttctacttggacaaggggacacctatgggtataaatacaaggcccataggaggagaggagacacaatacacgggacaacatacaagccaacatacgccaagacaagacgccggatatcgacttcagggataggcacggctagtcccctacggtgtctccggatactgtcaggagagacgaaagcgctatctctgatctcgctgggcacggattcgaggaggaagactaccttgtcgtcgacgtcgactacgagtcagaccttcagaccgccatgtcgacgatagttagataggctaccccacatattgtactggtgtgattatggtgaataaaagcaactccggctccggccaacaggatgtagggttattacctgacaactcaggggcccaaacctgtataaaaatccctgtctccatctcttttacctcagtctcgcgtatatcctagcaccgacgatccctatactatacaaataccagaattgcgacatcaaacatcgacagcggcaatcctgcctaaaaatgatttgtagttcaacgcatatcatttagccaggattgctatgatactatgatcatacaatactactccctccgtttcaaaatgtttgacaccgttgactttttagcacatgttcgaccgttcgtcttattaaaaaaaattgtgaaatatgtaaaactatatgtgtacatgaaagtatatttaacaataaattaaatgatatgaaaagaataaataattacttaaattttttgaataagacgaatggtcaaacatgtattaaaaagatcaacggtgtcaaacattttaaaacggagggagcatatgatatgttcgtgacactgacaatcttgatcacacgtgcgtataaagcatttgattccttttgtatgggtagattgcagatcgatgctctaagaattaaatctcggtttatctaaatttatctacagaacttggaactaccagtagtgcaacgctcatgatttcaaacttcgaaggaaagctcattctggttggctcaatttagcattgttccaattaacctcgcttttctttcaaaattaaaccatccgattctaaaagaaagttagtctaattccttgtccaaattaagagcaggtctataagcatgtttgatgccaaaacttgcaggaaagaaaaacataatgctaatagagttggatagcatttgttttgctaacaaaaaaatgtcattgccatttttttaaggctctctttgaatcaaaagaaattcatagaaattttagaggatttcattcctatagaaatttttcctatatggtcttttgaatcgaaggaatgaattttatgaaattcctatgaaatgactcttctcatacaagttttgaagaaaatttaacatgaggttgggatagaatctcatgaaaagaatcctttgaatctttatctctccttaaatttatgtgttttttatgcggcccaattaaacagtcattcctatatattttcctatgttttgcaatcatctgttttacacttacgttctaatcagaatcctatgttttttttatttctccgttttttcattccagtgattcaaaggagtctaaaaaaaaagtcccaaatacctacaaagatttgtaaccaaatcaaacaaccacatctcgccaattttttcatagtaattttagtattatcaaaatattaaaataccaataaatcaaacaacttataacttatgttacgctacatctaacgcatgcattaaactagcctaacagtgtcgatgtgttctctctgctacccctctcttaaaaaaactaactctagatttaaatttggatatgtgtattcagatttaaacctaaaactagattttttttatagagggagtactttaaaagggagccctaattggtgcctgtgcgcgtgcctccccctagcgatgcacaccccctctagtctactacttatcctatataagtaataaaaactttgtatacacgtatataaaatttatacatatgtatacacatacacttttaacggataaaaatacgtacatatataaaaaagctatgacgtgtcctcacccttggcctctcctgcacaccacgtggcatcagccacacacgacgcacgcctttgtcatcacacgtctgagtgcatattagcaatctcgctttaaaatacgagtcgtcctccactctatcctgtgcttcttttctgaaactaatcctataaaaaaatattagtagaaaataaaaaccaaatatggcaaagcggtttcgttttccatccttaatatatactctctctgtcctaaaatataagcatttttagctatgaatttgaacaactatatatccatattcatagcaaaagttgttacattttgggacggaggtagtattgtataatataggtaattttctagcgtattgcaaatcggtactagtatactcctcttaacgaataggagaccccacgtggcacgtcgagctgactaacctacattgcttgcttctgctcctcactgcgacactgcccccgtcatcacctcgccagtcgccacccccgcttctccccacaaatcgcctctcctcgccaaaatctccaatcccgccgcctctcactccgccggcgacggatcggaggaggaggcgccgctctccgccgtccgcgccccccaaggtgagtgaggagagcagtgtccgtttcgtcccgtttcgggttgggggtagtgagtcaggggcaaaagagtaaactcgcgccgccgatttcgcgcgggaaacccggagcagcagagcccgcgcacccacggtttcccttccccttcccctccctcgcgcgcgcctctctctcttcctccccccgtataccgcaagccgaggggcgtggtggggctaggtttcccctccccgcctgctcggaaggtgtggctataaagtttaggagagatggatttaggaatttcgatgtatgtatgtatgttggggggtgttcctccgtcttggggcctagttctggggatcgaggcaacgttttgctggatgcattggccctatggcgtctgggttgaatggaaggccggatggctttcttcgctcctcagcctggctcactcgatgcaaggtggatgcaagcgttgcatcagtgggtgcacgcgcgtggcaggggtctggcgtccgctcacctcctccctctcattttcatcttcccattctcaactgctctcctcttccctctctcccttgccgccgccgcctccaccaaatcccctacggtcaccaccactcgttcggcgtcttctccgatggtggactggcggccgacctcgagctccctcggccgaccccggtggagaagctgcagccgctattacatcccttgccatctccatcgccggcttcctcgccattgccggcgccgcctctcttttctgtcgccacaatcgccttctccgaccgccaggccaccagatccggcgaccatggtggcgttgagcagctaggagcagctgggagcgccggtgaagcaagtcaacgatgagattgaggggatttttttttgttttctcttttctattttcaattgagagaagagcggaggagcgcgcgtggcagatccgtatgagaggccagcgacggaggagcgtggtactggccggccggcggcagaggagccgggaacggctggcagcgatgaggcaagaactcctctcctcgacgacaatgaggaggacaaacgcttctatctttcttttctttttttttccagcgctttgcagtcaaatggtggggaaattttggtgactttttttttttgagaactcaacaaatttcgctttggtgcaaagaatgctggctgatttttaataccaatattattctttgtatgtgaaaaattgtttatacctattgtctagatttgaaatttttgtatgggatattatagaggtaacctcacccaattaaatgaagaggtaaccagactcaaatctatccaaccaaccaaacaaaatattttccaaaccgcatctctcatgcactcaaccaaacaaaatctcatctcagccgggctaaaccgatgcaaacaaccaaaacagttgcatgtgtatctcttcatctgggctagactcaaccaggatgaaagagatgagccaggctaggaaaatgcaagcaaccaaacacacccaattgttgctgtggtgtggtggatgactcaggctgggccgtggttgctctcatgagtcatagcaaatgggttgatggcgtctattcttgattgtgcttttgatgcgttcttcggtagcaatgtttgttctctagcaatagcccatggatcaatatggattaagcaaacccttgggccttccggtgctaattaaggagttttgtcatgtgtggttcacattatcaatgagattttgttttaggaccttgttacagtgcaatgagtctgcgttcaggatttgtggttggttgggatgacaaattggggaaaatgtgttacaccttagtaacagatctggtttaggatagccagataaacggtacatatgcctattgaagtgtaatttatggatgtattccctatatttccccccctattttgacacaaatccatagcttacaaaacaaccactgtatgaaacttctatcaggatcatgagcaagtttgcaaggggtcttattacctggaaatgatcaacttgtatttactttgtaaaggtcgtgttactgaaatatgaatttgttcttgaatatgtttactctctaaaagcctaacatgtcatcgaaaatatggctaccaaatgcttgccatttcataattatccagaaatttcttatataaaagtgttgctttattcaaaagcacatcaacactgattttcatttgtcacccagctttggggattaggtaaatgaatcaactttagttgtgatattggggtccatgaaagattgggaaaaattaaatatattggacctttgccgagcaaggttccgattctccctgaactgtggtagtcttagtcatctttcttggatttgtgcaacacatggattgactggttatgctgtattgtaatgtaatgtcatggactcgatttgtcctaatcttttgctaattacactatatgtattatgcctttttttttcttttcagccatgattccctgttcactgaattctgaatgtagatggttcacattgtatccaactaccataaatcatgagaaatttagttcaatcacaccttcatgtcatacatagaaacatcgatgggcattaaattttgtttacacattgcacttctaactaatttctctagaccacataagctgtgcactcattttggattgtttctttgatctgtgttcaaatttcaaatgctcacaaaaaaaaatctctacaatatctctatcatcatgtaaaaaaaactaacatatgtaatatgtcttgaatcccacaatactatacagatgttcaaacacaaatctctttcatcaatagttgttagttagtatattttgcagagagtgtgtgctagacagctacgcttgttgcagcttatgtcatggcatcaaatcattagttttttttattcattatagtttctttgctttgagttgttctactcctatatgctaacaattgaaaacatgctccaaattgcaaattatgtcagtttcaattaccatatgatttgatcaacacacacctaccgcctcaacaactttcacctgctttgtattgacctgcatgtgttctcatcggagttcttcgtcatcgtagtcttgcattagtcatcatgactgacaagttcactctaactccatttggtagtaatttttacttaaaaacagggtgtttaattgttaagcaatgcaagatccatttctttgtataggtccaaattaaatgcatacgacaaccaactccactagcaagatcggttgcgtcattgtttcatagtggtggggctgtacaagctactagtagatcatgaagcctggttgtcttcctatataaggattggtttcagatccttgggagacttgacctctgcatggtcatggaagttatgtgtatagtggcagtaccttgtgtagtgtctcgtgtatcagatattgtttgatatcagattcctattatcaactcagtatgattgcttgcacttagctttcctggccatccttttccgtagtatctttgttagtgagttcatgtttctatcctcactttcagacagaatctctgaacattggtttttctctcagaagctagaagataatttattttgagttcggttctctacatcttatcataatttacagagttttccattcacttttgcagtttctagctatgtttgccacatgtatatcaaatatagtgtcatgggaggaatccatcgctgctcttggaccagcaaaggtattcataacaaaccacctctggaaaatatgttttagctagtggtatctgtgaattgttaggatataggcatatagtagcatttttacatttcacattggagttgggtagtggagtttcatgatgttttagcatgcatgtttcttttctttggttgttccattttatagtgttatgtttgtaattctgacagctcaggtaagttccaaaaaagcctaaagctacaaaatacattgcagacctctgattttaatttaataatcttgaatctgatcgtaagaatgaaaaagggcagaacatatgctaaataaggcagctatctctgaagttcagtgttcttgctattgaaacagacagctcactaatacttatggtaaatttaggaattaggatattttgagtatctatctggataatagaaacaactttcttctttcttctggtgaaaaggcaattcacaggacgaaagctgcttcctgtttatgtctagcagtgagcttagttgccctttacatttggatgattttcctactagcatttagcaaccatgattgcagatgctgctagttgttaatttcagcaggtaaagctgaataggattccaatgcataaatggttgaggaatgatgcctccctgccttgtttggaggacatcatgagtaggtgaagcttgaagtgattcccttgcatttcttatgtccatcttgctggtcaggccagcttttacttcaattctaggacttgcttggtcagtcactcagttggcattaatttcatgatttttgcctctcaaatgttactgggcatactatattactatcatgtgtattcttaattctgatatgagtataggtattccgcaatgcaaaccaatataagcttctgaaaataaagatgtcagatcaaaattttactccctccgttccaaaatgtaagggtttctgggttggcaaatgctaagattaggtcaaaagaaacctttttagtcatttcagttgtcaatttttgaattttgaattgcttagattccctttccaagcatgtgattggcaatgctttggaatcattgaaatgatgggaattagtgcagggatccttgtattgtggtacaagatttgaatcctagaaatccttatattttggaacggagggagtagtacagttcacttctctcatgtactgatggtgtatactcatgttaatgctttgaccaatttcctgaaagaagattctgcgccatcttagctctatctgtttacggaatctttaatcataagttagtaaaccttttccagaacttcgtatgataatctgtctacacatgttctattctaggcacaagtttataacttctttatagcaagcaactgtgttatttctttgcaaaatagatggcattagcctatgcataagtttatgacttctttatcaactacaagcaatagtatgcttattgcctgctcattttcaaggttatttcatgctagacacgataaagttagtaagtcaatgttcttctattaccaaatgccaagacatttactcatttactgcagaagtactgcagaacttaacagtgtaattgtaagctctaacaaagcaatcgagtgcactcatgatagtcaacattttgagatttgactgtcacatttcgtgtttaagttcctttcatatgtttactagtcccactaacataaaagatagaaacaatcaatagaccaatttgatttactccaattttgtgtgcagatgatctgagaatttttattaattgtatgcatcctacgtaaatgtagggtttattaatctacatgcctccattagttgcccccttgtttttcgtctgatcttgacctccagcttcaagctccaatatctgttaagaatgcaaacagctaaaactgatataaattgatatgtgttggagatcttacataacccttaaagtccaatcttcctactagagccatatcactattacaacaaaaagaacggatgcaatggctgatcatgattttgttttatgattggttcatgcaactattgtggttatactaatatagtagattcattgttaatttatatgtgctcttgagcagttattaccgccgtgcctggggtgatctttttccttgcattgcatttccacttccattgttcaatttcaatgttctctcattgggcgatcagccctatcgcctaggcaccaatcaggacaatcagggcgattaatcgaggctgatcggttagtatataggagtgttcagcaggccatatatgctatatattatgtactaaatactctatagtctgtagtatacggtaaaaagcaagcatcatttggtcaaagaagaagaagcatcatttgctgcccatcatctgcccaaaatggaacatgggctgggctggcaggcccaaaattatatttttctcagggaggcagcccatgaactgatcgttttccaccctgataagacgattaatcgtgactaatcgtcgattaatcggacgatcagctttctgatcggctgatcgacttacctgtgcctgatcggaggtaggggagcgatcaggatgattaatcacgattaatcggatgatcagacaacattgttcaatttttgatatcacggaaataactaaaaatagcagataatctgtattgatctaaagcaaggatccatgatatacatgaatcttaccattgcaatgtgagcaacaatatgcaattgcatttgatacactaacctgattgacagcgtgctgatcttctatggtacaaccttagatcggtacttgtatatcaacattttgataacatgtgatgagcttgttgaggcaaaggtaaaagagaaggagcagggctgtacctttctccccagtacttagcctgaggttgatgccatatatatagacattgtagagcattgcaacagtagccaggaattctctgtactgtcaaacttggctggcacttgcacatgttattagttgttttagtgcatttggttatttgcattggatacaagacattttcctaataggttgtcctgcagtccaacctaatacatagccttttttgactgtttcctcctttctgccagcagaagaggcctccagatctctgtcatagtttgtttatcttggacgccaaccaatagtgtctactggtccctacatgtttatccaaattgatcttggatatgcttatataatcctagagttactgcctagatgatgacaccagatcactattattttttcttcaagagatgctactatttctttgcttgtcacagtcaacttcattatgcatatttatcatgataaatgtttttttcactttggtacttgaatttgttgcaatctctctgcaaggtttgacattgtcgcattctgttattgcagggcaatgcattgccattggtgggtggaatcaaggttggctattgtagtgaaaggcaaactagaggccctcttgttgcaaagatgtggtggatccttaactacactgcgagcctcccaggcctcaccaccatgaattgcccatctatgccctcccaacccaagccccagctcggtaaaccctcgtaagaggggttccttgttctgcacgtgcccatcgaccactcctgcaaaccgttctcctgccaaacgcggttgaactcatcggtgtttttttccttcatgggatagcactggtgatacctaactatatatatttagcatatagtttctcacctcataggaccatcctattttcgcctccattaaccggcttggttttgctgtgccttttgttttggatggtgcattgcattgtgattgcaaggttgcagtatttgccgaatgaactgtacttgaagtgctaattgatttgctgatctgatccccatgtgacacctcgtgcctgccaatttttgatattgcccttgagatgggggcactatagcctctttcggtggccatagtgctgtttataaactggaattgctggataaagtggccttattattcatcccttcctaacatcatttggcaccattgtgttgttccatccattccaggcattattttgcctatattttagagtaatatttgactcagggttgcacaatggagacatggggtagttacagtctctattattttcatattccacagggttgccccatggagttgttacagccttacaggctaagtaccactgtactacacaatgcatcttgtttcccactagttgggtttctcacttttgccatggatctcgtctcaatctcggcctcctgcctgcgtctgttctgcttgtctttgctgcaaaggtccatccatactgtcacctgcactgctctagtagtaataagatctgattcacttgctctgccactggcgaaaaggacggcactggaatttttgtaacctgacacctgacaggatatgtggactcctacgtgtttcttgtatgccgtttcaccggcagattgctctgttgctttgcatgatatactaccttgtgagttgtgactggtgcctcgtcggttgtcacggtgagtttggcatggttgctccatcagatgatgtccttagctggagaagcacttaaatccgttagaagtatagtgatgatgttggtttagatcctactgcccttgcgtgtggatcaattttagcagtagaaaacgtagtaaggtttactgggggtgaaaacggttgtaatcgatagcatctctagaaacaaagcttgatctatctgtaattgatcatatctattatttaaactgctcggtatccatattaatttccgtgatcatttttatcctgtttacatatgaaactatatatctatcgataaaaatttcacaaatacaatataatcataacataattgtattattatattataataaattacatgtaaactacatactccctccatctaaaaaaaccaatctagattgtccagataggagtgtgtctagattacttgtcatagaatatgtcatatcatatcttaggttgagctttttttttaacaaaaagaagtaacgtgtatgtaactgtttcttttttaaaaaaaaaaaaacattagcaaggggtagcatgttgctcgcatgaagtggtccctcaactgcgtgcactctgatttttttccttccccatcttacccgaatcttagagtaaatctaatgtctcaaaatttgacaatttttctctagaatatttgtcaacatatatatagcaaaatcgaaaaaaattgatgtcccaaaatttgacaaattttctccagaatatttgtcaacatatatataccaaaattgaaaaaaaaatgatgtccttggttgcaccaagaaattcaaattgggtaacagtctttcttctttgggtggggttaaggccaagcatagaggaataagttcactttacatcttatattgacatcgagtttgaattacatcctcaaatcgtaatactgaaaatattaaaccttcatcttttacaaccaggttaaataagatcctatggtagtatagatggttgtcttgactgacgtgacatcctagtaaaacaaaacatgtggggtccacatgtggcatcctagtaagggcagtagcagtgcgccctgtgattttggcgaacttcacatgccacctagatgaagaaccgcattagccacatactactttacaatgcaagttacctatagtgggttccactagtatctttttttcactttttatctccctttctctctcctttcctcctttccccattgcacagcttcctcctttccccatcgcgcagaaaacggcgggcgaggtggcactggggcggcaccggcactagggcgacaacggcggcggggcggctagatccacccttcctctcctcccccgaagcagcggcggcgttggcggcgcgacggtgccagagaggggcgactagatccacccctcctcggttgaggctgcccctctcctctcgccatgccggcttctcccatctccggcggcggcttcttccctccccccttgccttaccctctcctctctggtggcggtggatcgagtaaggacgaggaaaagcgcggcagccatctcaggcgtcgagtcgagtggagctggagggtagcgggcagctgtggcggcgctacctctctctccgtcggtggcctctcccctctctagcgctgctcctctctcccctctttcccctgtggtggtgatggtggcatcggggaagagcggggaacaacggtagtgccggcgacctgcggagccgggggcggcgacgagccccacgacggtgccactcctgtctcccctctttcccccggttcctcccccggatgcatagcccaagctattcccctccctccccaacactctaacaaatctgacgaggaactcgtggctaactttggctctccggacttcactttgttacgggagtagcagatgtggtatggaatccatgacgtggaatgttaggattgaatggtacatgtatacagttatgcaccgtgaatggcctaagtgaacatccacggttccacctatccctctcttcccgcatgttggagtactgaaatgggtcaccaaatgatgataccccatctgtccacgtctattaggaatgggccgttctaggctacatagtacacacctagcacaaagctaaactaagctaatgatggtacacagtagacgtttgcaggccatccggcccattaccgccgtcccaaaatacttatttttgagtttttattaccaattatcttgtttagaagattatataattattatttattttatttgtgacttactttattatcaataatattttaagtatgactttctttatatttacactaattttttaaataaaacgaatgatcgaaaattgaaagcaaaaagttaaaacgacacctaatttacagagtcaaaatgacatctaatttggtacggagggagttacaaaaatacgctttaaaacttacaaagcgtatcttatggcacctcgagggcccaaggctcaggcggctccgcggctatgcgccagcgccacctatgacctatacccgccgatgccacgtcatgcctcaccgaagcaacaaagcctcgccttttgtctcctggctagccccacacacggccacaccacgcgccccgcctcgaagcaacgcatttgatttccgcctcgtctcgtctcgtctcgtcacgcgcccccgcgccgccgcggaagcctcggagcagcagccatggcgacggcggcgaccctcccctcctcctcctcctccgccgccgccgcggtccagaccatatcccgcgtcctctccttcccccgccgcggcggcgggggcttcctccacctccgccgccaccccctcgcggctgcggctgccgccacccggggccggggcccgctcctccgcctcggcccgcgccgcccgttctccgcctccgcctccgccggggataacggggccgctgcgggcggcgatgggggtgggtgcgactacgactacgacctcttcaccatcggcgccgggagcggcgggatgcgggcgtcgcgcgtcgccgcctccctctacggcgcccgcgccgccgtctgcgagatgcccttcgccaccgtcgcgtccgacagcctcggcggcgtcggcggaacgtgagtgaacttcgccacccttcttcctagttcaagtcgcacacattgttcagtggtaatgtttgtttggaattcggatggtgtgcatggtttgcttctgattgtttgtttaggattatgatttagtagtgaggagaggattgaacaatttcacgcacgatccagtgctctgttatgatcaacgaccactaggagtctactctatgactataagaacagattcttattcaccattcctggagctcatgcttaatttcagaggcttttgtggtattcactataatgttgttcaatatatgtgtagagatgatgatatgagatttactattagggttacatacttacatgaatggctctccatatacgcaagtaacaaaaaagttagagagctctgtcacgatggctggttgttatcaaccagttagccttacgcgtttccagcttccttctatatctgtaatttgcttatagcgtctgcagagtgaaatgcttagtatctataatgtgcggatagcatctttcttccatttcatatccaattgcaaaaatgtgcaagtaagatgttcagtttttccatacttcagatgtgtgcttcgtggctgtgtcccaaagaaactgctggtgtatgcatccaaatactctcatgagtttgaagagagtcatggctttgggtggaggtatggcactgagccaaagcatgactggagcactctgatgaccaacaagaatttagagttgcagcgcttggtgggggttcagacaaacatgctaaagaattctggggtcactataattgaaggccgtggaaaggttgggacaaatttgtaaattgggttaagtttgcatatacagttttgttgaaaggatcaatgcagcaatgacagtgttgatatactacctgttcatattatgcaggttgttgatccacatactgtcagtgttgatggaaagctttatactgcaaaaaacatactcattgcagttggtggtcggccatccatgccagacattccagggatagagcatgttattgattcagatgcagcattggacctgccttcaagacctgagaagattgcgatagtaggaggagggtatattgctttggagtttgctggcattttcaatggcttaaaaagtggtgttcatgttttcatccgacagaagaaagtactgagaggctttgatgaggaggtgagcaagtatccattagaacaataatttcgtttttgaactgaagtgtgtcaatgcgtcatgccttgagttattttctcattccatgtggatttgtaggtcagggattttgttgccgatcagatgtctttgaggggtatcacatttcataccgaagagactcctcaagcagtaatgaaatcagacgatggcttgctgactctgacgacaaacaaaggaagcataaatgggttctcacatgtaatgtttgcaacaggacgaaaaccaaatacaaaggttaatattatgccagtcatttccacttttctcaaccaagtttgttttgggggcatacatttattttctggatacacatcttcatacaatccatacctttgtagaatttgggtctagaagaggttggggtcaaaatggacaagcatggtgctattgtggtatgtgtatttaaacaaggttctgtgtattctacatagattctatacattatgattctatacattatacataatctaacattttctcaattattagatgatcattaagtgataactgaaattcttggtctatatatgttatcctaggttgatgagttctctcgaacctcagttgattctatatgggctgtgggtgatgttactaacagggtgaacttgacaccggttgcattaatggaaggtggggcattagcaaggactatttttggcaatgaacctacaaaaccagattacaggtatgcatgtatatgtatttttagtgtgtatatacatatatatataacatccatataaatttgtattgatcttgaaccttgcgattttgatgcttcatgttcccttatttgtgtatacaaactgattgttcttggtgagcattaacaagaattcaagaaatgctaaattgtgtaccttgtaaacagttgtcattttgtgcacattatgcattaattatctcttgtggcagtagtgcataagttcaaacacatccgctgccccatccctttctttcttcacaattcaaaatgactaacaaatctgatttttttttgtcaagttctctatttaacattataattcaatagtagaatcatgtacactgtaatttggcataactgttgtattaaactctttgatatgcatttttacagtgctgtgccatctgcggtgttttcccaacctccaattggacaagttggactcactgaagagaaggtattgtaaacttacaaacttgttaacttgcaaaaacacacgagaaatttaagtaaactatacacttctgtaggcgatcgaaaagtatggagatgttgatgtctacacatcaaacttcagacctctcagggccactctttctggtctacctgatcgtgtatacatgaaggttatcgtgtgtgctaatactaacaaagttctaggagtgcacgtgtgtggtgaagatgcacccgagattattcaggtttgtgagttctttatttaatatttagccatcattttgttcatgtttgcctaatatatttgtggtgtacattactatgacagggtattgcaattgctgtaaaggctgggttgatgaagcaaaactttgatgccaccataggtgtccacccaaccactgcagaagaacttgtcacaatgagaagcccgactaggaaggtccggagagatgctgtggatgaggtttgatgaacccataatttacagttacatactccttgatataaatattacatagtgtacagaaatactgaaagtataggctcatctgtagaactgcctggttcataaagtttgtttccttatgtttattcttgccttttcaacttcaggccaaaatgaaagatgaggccacaagtcagaagtagatacacctgccctgcataaatgaggtaatcatttggagtaagggttttttctttttgaaatttggatgataaattttgtgaaacaatcgctaaattgacgatgatttttttctgtttattgcaccatctgcttcattaacatctttggcagttgtgcaactagaatgattattttcggttggtcattgtatgagcacctaaacaagtcatgaattggattatacatcctggagacaaatggcaaaactgtccagacatatcttttgatatttgcgattttcttttgagatgtttgtggtccacaatcatcatcttctgaaacattacaaaggaccactaaaataaatctttctaaatttccaccaaaattatctgagaatttagtttgagttctattgccatgagctacctaactatgatgtagtttgtgttgcagtctgaccagtcgatttctaaccgcggaaacaacagacagatatcggtatttcgagcagtaccagagaaatccaacccacgattgcagccagtgaagaacggagatgagttacagcaaatggctagctatctcgtatattgcatggtttataagttcattattatagaaaccagctcaagttccttttatttttttggcctaacatgttactgaaagaaatgcttcaggtcccggtcaaaaaaaagaaagaaatgcttcaggatgttgatagtattgccgcatgaaattttttgattaaacaacaaatttcttgagtaccttctcctgaactattgactggtttatgtacatgtgatccgtggatcaagcatccatctattttgcttccagttccagatatccagaggtatattatataatatcactgtgccgttctgaatgtaaatcgtgactgcaagttgtaacccattcattcgtggtgtggtcctacacactaagctttttgttcctgcttttgatgctactttactgctttgtgatctcctggtcgcaacagcttgcattcaaggatgtattagtaagggtatgtttgctgcagcttctttcaaaatcagaaactcattcaaacaatctagcttttgatttagattttaagaagccatagttgtagaatctaggaaataaactagaagtcacaagctaaaaaacctagttttttttattcttagaagcttagctaccaacaagcttaaataggcctaaaacaaggtgcggtttgaagttggacttattctggtgacctggtcagcaaaggtgcttagaaggtgccttgttaagctgattaaaaagtgacgcttttgttcgtgcattgatatttctccatgattttctttgtgacctgaacacgacaccttgctgcacgatgcttccaacggcagatacgtacgcacactcgttgggatgggatcgtcacctcggtgtttccgtttcattctgggtcgatctggcgtcaacatgtggcgtggcgacaacaacaacaaagtcgtcaaaacctaggagcataataacgaggaaatcgctcacggctcctccaacagccgaaccggttctagcgaaaattcctatgtttcaaattcactttaatccattggactacagctaattaggaaaaagattaatgagtgagcttttatatttatatccttactatccctaaactatcacggtcgatcgaattatacccttaaatcacaaaactagacattcttcatctataactatgcaaactggacaaataacccccccggctcaatccatggtggttttaatcctacgtgcgcggtagttttgatcctacgtggcgtgcgagaggatcaaaaccaccgcgaattgaaccgggggttatttgtccgatttatatagttgggaggtgaagaatgtctggtttgtggtttaggggtgtaattcaatcgaccactatagttcaggaggccattcatattttttcctttaatttaaaagcacacgaaaaaaactacgaaaaaataaatctctaaattaactctaaaatcacttttaaaattttaaattttgtctacggctcataagccaaaagaaagacggtgcatagctaaaatctcttgtattgaagggatagaggaagtttgaattttagttcggagaaaaatcgttctttggaattttagtttaagaaaaattgaggggaaatggagaaatgactcccctgccccttcttctctctcctcccatcactcatcactcgcctccactccactctccatccctctctcttctctctctctctccgccggcggaggcagaggcaccgccggcattctcccccgcaagccccgcctcgcctcctccccctccccgccgcgcgccgccggcgagctgcccctgaggcacacggcgtgtgcggcctcctcctcctccccttctcccccacccctgcgcggcctcctcgcgcgcacggccggcgcagcaaggtccggagacgcgacgcggccggcctcattccactcgcctccatccccggctcgaatcgaacccccaaggtactcgttcttctcccgtagcactctctcccttcctccctccccgccgcttcatgagccgtcgtggcgtggatttggaaatccatcccgacctggattgactactttgcctccaattaacccattcagtttcttccgtatttcttagtataatagtagttttttttttgaaaaaatgctgaacccccacgccccacgttaggtcggtttattttaacaaatttggtggtttacacttcaacgcttgtgctaatttcttggcttgctaattaattttcactaattattactgcgttcttcatatgctaatcatttgtagcactctaaatttagggggtacccgatttcttaaggtggacgcatgtcttactgtgtgcagcatgccatttttttttttgtgtgtgtgtgttttgcagttgaacaatgactgctcagaccaagaagaggggtggcggggagagcgggaacggtggcgctggcttgggccttgctgccttcatcgccaacggcgaggatctgggccctatcgtccgccacgcgttcgagtccgggaagcccgagtccctcctgcaaggcctcaggagcatcgtgaaaatgaaggaggttgagattgaggagctctgtagggtccactacgaggagttcatccttgcagtcgatgagctccgcggcgtgttggttgacgccgatgagcttaagggtatgctgtccggcgaaaacctgcgcctgcaagaggttgctagctccctgctgttgaagcttgatgagcttcttgagttgtattcagtgaataagaatgttgaggaagccctagggatgttgaagatctgtttgcaagtcaccagtctgtgccagatgtgcaacaaggacattgcagaagccaggcttcattctgctttgaaaagtttggagttgattgagaaggattttctgcaaaatattcctctaaagcttctaaaaaaggctgttcagaagcaaataccaattgtcaagctgtacattgagaagaaagtttgcaatgagtttaatgagtggctggtgtatatcagaaggacagcaaaggaaattggtaaggtttcgataagccaggcatccttggctcgtcagaaaaatgagggaatacattcccaacagagggaagcagaggactgcagccgtattgggtttgacgagcatgcttatgccttggatttggatctcataggtgaggaggaagtactggaattcgatcttacaccagtataccgagcaaactacattcacacatgccttggtcttggggaaaaattccgagaatactactacaataacaggcttatgcaacttaatttggacctgcaaattcccacgacacaaccgttcatggagtctcatcagcacttccttgctcagatagctgggttctttattgttgaggaccgtgtccttcgaactgcagatgggcttctttctgatagtcaggttgagacaatgtgggggacagctatttctaaggtcacatctatcttagaggaacagttctctcgcatggatgctgccaaccacctcctactcgtaaaagactatgtcactcttctgggtgcaaccatgaagaagtatggataccaaaccacatcattgcttgaaattcttgagaagaatagggacaaattctatcaacttcttctttctgattgccggaaaaagatagatggcatcttcactaaggactcatatgagcagatgatcattaagaaggaaaatgagtaccacatgaatgtttcagcatttcaacttgaacccattggtgtagttccggattttccatatgttgcaccattttcctcttcagttccagatgcttgccttatcgtgcgctcttttattgatgattctgtgaactacttgtcatatgatcctatgatggacgcctatgatgtggtgaaaagatacctagacaagctcttgattgaggtactaaatgatggccttctgaatttgatacatggtggttgtttggagattacacaaatggtgcagattgcaggaaatattgccattcttgagaagtcctgtgacatgttcctctttcatgctgcccaactttgtggtgttcctaggcgtcttcttgacaagcctcattccggtttgactgctagagctgtgctcaaagcctctcaaaatgcagcgtacaatgggttaatagccttggccaattccaagattgacgaatttatgttgcttttgactagcatcaattggacaccagaggaaactccagaacatgtgaatgactacatgaatgaggtcgtcatctatcttcacacgttagtgtcaactgcacagaatgtttttccaagggaagccctgtacaaggtggtttgtggggcattcagccacatctcggactcgataatgacagtttttcttagtgatcgggtgaaaaggttcaatgctaatgctgccgcaggtattgacattgacctgaaaaagttagaggaatttgcagatgataaattccacagcactgggttgtcagagctgagaaaagaaacaactttcagagattgcctggtcgaaattaggcagctcaccgatcttctgctcagcaaccagccagagaacttcatgaaccctgtaatcagggagaagaattttggatccttggatcataagaaggtgtctatcatctgtgacaagtttagagatgctccggaaagcttatttgggagcctttcaggccgaagtacagtgcaaagtgctcgaaagaagtccttggatgtgttgaagagaaggctgaaggattttagctgagcttagccatgttgcatcagaaaataagttagtgctcccttgaaaagactgctgccaagtggtggttagcctttttaagtttcttttaccccttgtaacctccgtagttcggcaactctatatggaatttatgtagctgtcatggtttgtataggtcaattttgactgttattatgggcagcacttgcattctctcttcaaattatgaacttcgatggcactagtatactaaatcactgagagaatcaggcctaagaatttgatctcctgaatagttaagttctcttgtttaagatgtaatccgtctatagcatctattttgttttcttacagtgttaaaatgtttatcttaagagcgttaaaaccgtgaaatctgagaaattttgattttccctcaactgttgccgctattccaaatcataaatatacttaatacttagcacatgtcagatcaccaggtataaaccactggcacagatggcagagacattcatttcatcaccaacatgatactaactaactgcattcacatgtcatggaagaatttgtaggttttgacatcaagtgcgatcgctctgacggcgccgatgcatgccagagctccgacaatggagaacaagacagcgacagcagaggtgatcaccttcacagcatggcgtaatcctgggttttcaggtaacttcccggccttcagaaatgccagtgcaggtagcacaaagtccagaggggtaaagccaacagctccacagactgacacaaagtccccaaagaatggcattgctgcagagatgagggtgatcaccaccatgtatgcagaggtatacaccagcctccacatccttgctctgtagcctgcgtctttcgcctgaatccgctgttcaaattgcgcgaatgtcggcctgcagtatatcttggtgaagatttacagttactggatagtctgtcagagtgaaaattgtgaaaaaaaaaagaggttactggtgtgttacctgaaagcaaccagtgatctgaatgactgcaaatagatttgccatcacaattgtccatcttggaaaagtcagggaggacaggatgtagggctgtactcctgagccaaatgcccagtacccactgaatgccagggtccagtaggacatgacgatgatcgagtacgccgtcgacacgcctttgtacatgttcatcctcaccggttctcgcacagagctctgaatttcagtgaagttttggagttgagtggacactgacagcatgaatctcagcataatatcagatattcacctgaatttctggcagcattgcatccccaaatgagaatgctattgtgcccagtgcattgaaggctctgaagatctttgatgcagcgcttccttgcagactgtaatcaacttccttccgatcaatccgatgccctgcattaggaaattcattctgttcattcttccacatcttcaatttccagaaatcttcagtctgaaaagtgaagatatgaccagattttaccatcataaatggtgacaccaatggctgtccctgcaaatccaatggtgctagcggtgcaggcagcattgacccaccggagtgagtggatgtcaggaagctgggagagtaacagctcgaatgcgccgaagagaatgatgaactgttgcagggtcatggcgccatcatcagtggtgtggtagtgcttgtacacagccttgaggctgctcccagctgcaatctggattgcaatgttgtttccaattgatgccacttgctggaagaacgacacataccagtaaccccagggaccttcagacaaaagcacagatttttaccatcacttgaggtaaatttgcaacaatttctgcactgctaagtatattactgttacaagtagatcatcaaaagtaaatatttatggtgaagaatctgtaatcccatttactatcgtttggcaactcttttcctgctaggctgctactcagaaatcttcttgtgacacagtacagtaagatcaaaagtacaattttgtcgtgacaaaaaaaatggtgatgagtactaaccaaagatgctctttgcaagaagcttgtagctggtgtgcttgtctccattccactgccacagtgaggcaacaaccaggctagaacaccatgtaactagtgttcctgtgaccaagctacaaacacctgtgctcaaacaacagttagctaattacaaattactcaaatcaaacagaagaaaaaatcatgcatgcatatgaactgagaaactttctgttcatggcatttcaggcaacagagcaggagaagctcaaatatcagagaatccatggagaggatgaaacaggatgagtaaagaagcaccaaccaagaggccagccaagggaggcaagagcaaacgggaggggagcataggccgccggcgtggcgatcgtcgtcgccacgtggaacgccgcgtgcctccacgtgcctctacctcccgtctccgccgccgccttctcgacgtcggcgccaccgccctcctcctccggcgtgccacctctcgccggcgacatgtggaagtacggtaatgctattactggctcactagcaccaccctttcatggctttcttggaaagcaaagctgcttgtatatatcttatcagtctataccaacttatacatgggagaagattcagactttcagagtggcacaagaagaaggaaggcactccgattagctcatgtcatatcacatcctgaattggccaaaacgctgtcttgagagagaagagaaaggccagaccacacaattttggaaatggaatactcttaaacaagcaaaagctagaagactatattcctatgcaaacatgaggttaagagtaatagtgtgggagatttgctccaatctaataaaaagtatctcaaggtaccggtacttcatggtaccaaattgtccgtttccgatcgttggatcagcgtgatgtatcgggaccttgaggtactttttgttggactgtagcaaatctcatagtgtggataaagaaatcaaccatgtgttacatgaagtggcatttttgtgatggttattttaaactcaaggccagcatgcatttgggacaaaataggcaagcttgcaattttaaatctaaataaatgcaaagtcagctcgtgtgcgggaatacaggttgttcacgttttagtacgaatttgactagttttcttattattattgaaaaaatgttctaattattggcttttgttttttttcctggaaatacagtattggcaagtggatactaatttttaatgtgaaattagttggattcagttcgtcaagagagttatatatgacgaagaggacagataatcacttaatcagatgtgatgcaaattgtacttcaaaaatgcaatttcagtcaactctatggaacaattaaataaacataacatccccgcaaaaaaaaaaaaacaaagagaaggaaacagcgttgaaataagagaagataataaaatggaggatggatacagtgctggaaagaaaatatttggagatgttttttttcctactactttatacagtatcctactctctccatgcccatataattatcatcaacattggtcatatgtaaactttggccattcttatttttgcaacacatttgtatatatatgaaaacataagatattatccaagcatgttgcatgctaaacatgaccataccacaattttcgttcaacaaaaaaaaaacttgttaattatcaaagttgcaacgatattggtcaacagtgactagtactatctccatattttaatgtatgacgccgttgactttttatccaacgtttgaccattcgtcttatttaaaaaatttatgtaactatcatttatttcgttgtgacttgattcgtcatcaaatattctttaagctggacataaatattttcatatttacataaaacttttgaataaaacaaacagtcaaacgttgatcgaaaagtcaacggcgtcagggagtagtaaataggaacggagggagtaattgttgaaatttctgagatatgcagtccaaaagctcgggagttgagactaaatggtctgcaacaatatgcaagataaggacgtaattacttcaagccgtgaaattcagatttggatcttgacttttgggcaacaatacagaaaggaataaaagctcaagtggactaggttcaatctaaaatagtagtttgctagtggcggatgacgaattcctgtggaaataaccggccactcatatatgcctgggaaaatagcacaagaaaatcccatttgcaattctctcatcaggcatcacacaatcagcaggaatggaaaaagaaatttaaacgtatggagaaaattaattggatgaggcagaaaaccttgcatttctgaagcaaggagacattgattaatttgatatgaacactgtatatattctactagttaaactcctcttttgcaagaaccgcaagcatcagttacatctacagttacaaacttgctcctaacagcaatcacatcgatatagaggagatgcctttgtctgtttcagtaatttactgaagcagtgacagaattacagcaacagggggccagcctggtcaatgaaaacttgaagattagtacaaggaatggaagttttttttgtcagtgcatgctccttttcctcatttcagatgatctttcaccgacatcgatttctagacctcttcaatgctgctctaacaagaagcaccatgaaggtctgtagcactacatgagaagagctgcaagaaaaggttaggccaaagttgtcaatgatttatggttaagcagagcattcatggacaacatttgcaatcctataattaaattatataaagaaattgaatatcaaagaaatgacaagagggattaatgtactgagaataacgcaaacatagctaaaacctgatggtattcagcaatggagcagaaagaacctaatccagatccatcttttgacatacagatgggccagaattattagtgtcacttatcagtgtatgaaaacacttgcattaattttgcatcaattatgaatgtgcatttccttggtagctcctaccatggatatatttctagaatcttctttatataggcttctgttttatcaggttacatgtttttggtaaatcaattactacctcataaaatgataaaatccttccgtttttttttcaaaatgttaaggaaactttaaaataatagctcactgctatgaaatggtagctagaataattattacctcatgaccagaaggtgtgaaatcaggggggaaaattatctctgagttgcaattcttctcaactctagtaaatggctggctatcgcctgtacacactgcagtccatcagggctacaccttagggagtttaacacatgcttaagaaactcctgatcagcttcaagtgcctgcaatctcgtatgcaacagtgagacttcatccttaagatttgcatcactcgttttcccatcctctggatgagaacaagaacagttatccttatggttctgaacagatttgtttccatcatcttgctgatcagaagttgattcaccatgcgttggtgagctcccaaaatcagcccctcctatcaatccctcttgattaattttggcatcgtcagaagcaagtctgtttgtggagacgcagagcttatcctccaatctgcttatcgattccaaaatatacgccatttcgtcttcgaaacccgacatggtgttcttcgtgtagcccaagtcattcaagacctcaaacggcatgtctgtttcattcattatgccagcgatatcatgtttcccgccattgaattgttcattctggactagcctcctgaagttctcaagctcagcatccatgtcaagtaattctttctccctctccgtaagcaagtcgtgaagattctgaatcgcttcgtggtcatgatcggcctgctcttccatcatcctcaggtattgcagtgcctccatctgcattgcagccttttcctcatgcaacttattgatcatggccattgcttggctagccgcgatcgccgaagcgctacgttcttcctcaagctctttgtagagagcactcatcgacttcttgttgagctcaagaagccgcttcaggttctcaggagagctctctccctcaacttcatcagcgaggttcgcatccgatggttctatcacagaatagttcctctcgagggatggcctcctgccattggcattgctttcatcggtttgcgcattgattccggggctaggagctccatcactccaagaactgtcaatgccccttacagtagacatctgtgaaaggaatgccttcacttcttgctgagtggttgaattgctgtccttggcagagattatttgtgatggccgaggtgatgaaagattggccctacttatgaaaccgttctttacgctgctgttgcgatcgacgaaaacgcgcataggcacagtagatccactgggtgctagctttgcagtcccagcatttccagaagcgccattgttctttgtggattgttcatatgttcgtggtgaactatcagattcattcacctcctcaatacccaccacaaaggctacaaaaaaaaaacacaatggattcactcggtgaacctctaaaaaggattcagttataagagaatctgaagtacagtagttcagacaagtgaacttacccttatcttttgaatgatctgcagggatttgttcccnnnnnnnnnnnnnnnnnnnnnnnnnnntctcagaaatcctatgcgcattgcgcgccttggtgaatggctccgaacagcaagaacacagctgcctggatttcgatctccttgtgtcaaccacatcattcgttgctacagtgcatcttttgcagagatcatcacattgtgcaagattgttgtggctactgcagtatgccagagatgatatctccgacctatgcgcggcgcagaccaaatccgaagagaaccatggcttcccatgaagggcatgatccatccttgtgcacaggatgcatggcatcttgagcttgtggatgcgcgccaacctcgtcgccaggtaggatgctcctgcggccacatggagcaggatgatcaagcaaagctcgctgcaagcataagacagcatggaccagaatctcctccagaagtcctgggatctcgcatggtttttcgcagccatggatgatcaatgtgcatcaaaaaaatcacatgaaaggttcctcaatgcagcttcaaggcaaccaaaatcacactgctgaatcttggtttgatgatatgggagcaaatgttgaatcttgatttggtgccaatgcagattgcagcaccaagaaaaggtgatcttcacaggaagctgtttgctcagaaggtaaatggatggagcgttggtgctgccaatgcccacctttcttgcagaaagacaccaatatctgattgttcagacaaaaaaaggaggaaaatatgagcaaggatccaaaattttcaccagttataacaggggaaaaactcctgaataatcttgagaagaaattacttgcagcgcaattgattacatgtaacatcacagcattttcacattcatacaaagattgttccaatgatttttcaaggaattttaagaaatacataacagggtgattgaacataccgatgctgaatttttctttagaccgaaaaggcgtacagatttgtgtggaaaatctgaagaaagattgggggaaaatgtggttcttggcaggaaagaggaggcaaaaggggttccttctctctctctccctctctacgcagggacgaagagaggagagagaaaggaggaacagaatggctgccttgctctcctctaaacccggcattttccccttgtaatgtctgaagtctgaatgtcaggcgagagattcaagcatggccacacatacaaaaatagatcaatgcaagctatgcaacacccaagcatccattgacatggcagcagcttttaacagtcaggtcacacatcagcagttaacaaggaattaaaagtgaattttagtttgtagataacataatgcatgttgtcatgtaatacaaactgtctctcaaacatctgagggcacatatcttgtacatcacttaccctgaatccaccaaaaaattgttgtcctataccataatctcagacttctaacccatggatcaaggtctatttctaactcatggatcagagtcaatttctaactcatggatcaaagtctatggctaaaagccaaagaaaaagaaaatattagatacaagtcttgggggttcaaaaagggggcgcatattaatcatctgaggatggatatcaaaactttctgggaatgtactctcgcggatttcctgtattgccggtgtagggactatgtgcagaaagagaactcttgggaactcagtaggtcgcttgcaggcgaggttctgtaaaacagcttgctctgcgagtgagtgaagtagttggaatatctggctctggagatctcggtgctggcaaatgtgatggaatgaagtcataactgtgatcaggggaagcggcagcagcttcagccatgaagttctggaaaagaaaacgatggtcaggagagtggtagggcaacattgatatttttaaggcaaacgtacaagcgtggaattcatcttacagcctcaggctctcagcacaatagtggtaaaactacagaaaccaaggtgcaattccaaaaagcaaaaagcagtcccggtagcaagtggttgaactttcaagggtactgagctgctattcaggtcaaagttcatgcatatcaacgaagagtctagaacctgatacaccaggacagcaaccagcaccctgattttccatacaaggactgggctagcgagcattagatgaatagcaatatgtggtctgtttgcggaaacatggaatcttatacaattaattagctgtccagtaggtaaaataagattgaaaactagatattgaactatatttacaataaaggaaaaattggctactctagaaccaattttgcctacaataaatggaagcaatacccacaaaagagaggattgcagtcatgttgtgtttttcataaaacagaaatagaaccttgtctaaaagtaaagaccagttatgtcaacagaaatgcaatgaacttacttagactagtcatttcatcagaagtaagtacaacaacaacaacaaaattataaaagctgctgctacctttatcaactgctctgcaatttgaacatctgttgcagcacttccagtgatctcaatagacattgcactgtcatcaagatcctttatcacgacgcttgatccgctggcttggcgaatgtaatcaattcgtgcaccagttgggccaattaccgcttcagcatagaaaattggaacttgcatcttcattataacctgccaagcagcccaccgtccaaaaatgatagtaaatagtgttgcgcagacaataaaaacatgtcagcaaacaagaagtaaataatgttgacaggactaattaaaacaagtcagcaagagtctatgataaaaaccatacaaacctgagaagtgactgcaggagattgactagttaacgaaggcacaaccacatttggcagttcttctggagcgcatgcagaaacacggcagtgttgaaggttttcgacattagttgaaggatacatctttaaggatggagatacttgccatttatatgcagaaacagcaggagatgggggtagttcagtagcaggtgatggagatacccttggtggatgatcatcccttctgtacaaagatatccccgagtgtggatgtttttccattttagttgattgatatgtctgcctcagcggatgtggatgtgcctgttttccatacacagatataagggagcgtattctttcaacagtatctgatcgaccaattggtggagttgcttgccatccatatgtattcaggttgttatgcaaacataattccattggagatgataaatatgcttctgcttcatgcccataatgtggaggtgtgactgaccgatatctcccaaaaaatactggtgcttcttgtctgtattcaaatatgtcagcatgtgtaaagttttccattggataccttgaataactagtatcagtccatgggtgttcaagttgaaaagcttcagcatatagggagtaatagcctggactagcttcgtgcagaaggccctcatgatggtcactgtagtggaatgggggcatatccacaggtgagattggaatagacacctgaagaaaatcattcctcagaattaaatgttgcgaggacaaaaatgtactgtgtcggtatgctcaattgctcattaaataacaaatgttcaaaatagtggcaacttacatgggggtcaaacagtgggatgacacttcgatgaaccaggtactttctcaaatgacaagcaacaagttccaatgcttgatgcactcttgcaggcagtccccaaatttcaataatcatatcatcttcaagtgcaacaggtggcaagtcaccgtctacatagtcaagacatgatggaatgagtacttattaagattatatatagaaggctggaaagtgtaccaaataatagcagtttaatcttgaaagtagtattagatactgaaactgcatatcaccaaatggaactaatataataccatttaggtcaatcataactgaaacttttgaatttaaaataaaagtgcaacccattttatccaaatgatggatgcaatgaaacccatgcgtcatcgcattaaacagatgttgcattttgtagttttgatgaagtcagtgtcaaacgcagagctaaaatttagaggcgaggaaggggccgtggaacaacactaataaaaaaataggattcagaaggatggtttgcatatgttttaccagatcaccatggcatcaatgagattaaaatccctccaagattttatttgttgtttcatactgccatttgtgcgggaaatattgctaatatcacttgagaaaaactatgtaatttagtttagccatatttatgaatctagtaatagatgaacgataaatgcaaaataataatcaacggatcaactaaaatgctactctgtatgttgcaatgccgtggccattgcttggttactagataatttgaccgtgaatacatagcaggcatgatgggctgaaagcactaggcccggggtccccaccttcgcgccccctgctccatccgccatggatgaagtcatgcttaaaactgtttcttttcattgcatccatgggcaatcattgtgttattgttgatattgcttgataaattcaaagaaataagttaattagtcacataattttcatgccatatcagaatcctttaagtgtaaccaagtcctagttcattatgtatattaacttctctgcttgctctgtaactatttaagtgagtgacaaaagaaagagaaagatcaattaattcttaaaataatatggttgatccttttataggatggtccctaacaagaatctctaatgaaaaaggaaacaaacaatctaatggaatggaaacatagacaaagatagcaagtagggatatctaatccactaattatctctcgccagtggtccgctttcaacggatgtcatgttggacgggccgcataagtacggaacactggccataacaaatactttcttaacacataagaaaatatggacacctgacaacatgtacatagctacacgcaatattaactattcctgcatgaacatattttttcacaggtacaatctcagcttataattaaccagcaaaaacatgtttgacagaatatgctgatgtagtagtccatttaattccttgatggggctaaaacatcactgcatgcttaagaaatttagtttcaatgcagtagagtcaccaagcaacatgagtaaccatgtgcttcagtaagctgaaattcatgtagcttatagatacactagtgcatcatccaaagacccgcatctgtatatatggagagttggagaccactgatatcaaatttatcaatagaaggaactagtggttccaagaggtgcatcaaagtaagaaagttaccaataacatggatgttggttttagaagctttcttgatataattaatcactgaaccctgatcgccaataaggcttgctgcctgttcacttggtgtaagaatccgtgccacaactatattgttatatctcacatctaaaccatcatcattgattatacactcatatactcttagtagtgcatcaatagctggaggttttggctcatcaggttgttcctttgcaaaaatgattaccttccaataaaaaaaattgaaagaaacaaaattgaggaaattattgaactaaacataaatgatgcccatatttttatgaatcacaagctattgcaaaaattatgttgaaaaagaccaacttatatagaatccaaagtacaaagacaaaaaaaaacaatataggaggttatatttcagttaccacaaaagcgattggaagtcaacacaacatcgtaacaggacaacattctaaaagcaaagaaaaaccatctgcatccaggataagtacattctatagtccacttctggtttgctagttgatacttgatacgttagccagatcatgaatcattcatacatttctctgaaagaaaccccgcagtattgtttgtggccaaatgctataaaatttaattgcaagcactcaattaagatcatcattgccaaaaagaaaaaaaaatgctagcatactgcaggcagaaaaggaaacagtattctagtataaatagtaatgggaagtcaaggatgatcaagaaaaaaaataatactactaaatggagaacttacagctcgctctgcagcagcaaagtggccacctattactcggacgcaggcttttgtttcctcacacagtcttctaagcctttctccactgtgaccaattactgcgccaactttagttgcaggaatcagcatcctgaagacactcgttccaggccaaccaggatccctattttcgccagccgaacagttggtaccaccacactcttcatcatctgtagcgccttgttctaccattctccaaatcacttcatcctcctcttgccttttagttttgctaaaagctacagtaacctctttcttatcacaatatgaattcatcccagcattcctggtagcactgaatcatcgaaaaggataaatagtaatgagaacaatctgaatagtgacattcctacaatttaatgatggaaccaagtaaaatttcctggcaaaatcccatcgaatatcaaccccgcagtgagcgactcaaatcaagagctcaatcaaggcttgcacacagacgcagtataacaagcctcaatcaccgggatcctaacagtcccacaaacaaaggaactgtgtaatctgaagctcaatcgtagcaaagaacaacctgatcagcttagcccctggtacagctctgctcccaagtactaccaagtagcatcattgcgcattgcccgaaacgaaaactcgaaccaagcccaacacggtcaccaacggagaacaactcgctatagcgacgccgacgcatcaaagcatacaaacaagcaaacaaaaaaaaaatgaataaaacgaaccaaccccctttagtgccttaagaactcagagcgacacatataaccccatggattagaccaacaagccgtacacctcccagctcgatacccaagtaagtccccaaccccgccaaacccagcagaaatggggccggcgatccccgccccgcgcggcaccggagcacggccgccgccgctgctgccgcatcgcttgcatgcgcgcgagcggagaaaaggtaggagagagagagagaggaggaggaggaggagggggagagagctagggacgcggagatcaccttcgcgacgcacggcgtcggcggcggcggcggcggcggcgcaatggcgacggcgacgcggcgggggcggagcaaggagagtggggttttgtggggggaggaggaggaggaggggttttgatggccagagcgtggaacggaacggaggaatgaaacggaaaaaagaataaatgggccgtgttggaagtgggctttctagggccgaaaagaggatgtaggccttgcttggatgggccagaattctggcccatacagttcaggccttgtttggaacgggcccaatctgtctgtcatgggctaaatttaaaggaataagttcacttcatgaccctcaaaagtgatcgaaacctaatccatgaccctaaaccacaaaactggatatcttgacccccaaactcttaaaaccggtgcaatttgactccttgggtggttttggagggcggttttgctgacgtggcgcatacgtggcagtattgactcggtcttctttccacgtggcgcttaagtggtattagaaataaaaaatatgcgtggtacccattagtcattcacacacaaaataaaaaattgtggggcccactgacatgtgggccccacatgtcatcctctatctccctttcttcttcctcccttctctctttctttctctttctcttctctccccttcgccggccgcggggagcacgggcgactggagctggagcggcggtgggcagggccaaagcagtggcggcggcgggcgggggccagagcggcggcggtggcggcctcaccatcgacctcgccaagtggagagaggagaggagaggagagcaggtgagggaggaacggaggtggtgggttacacgagaggcggcggcggcgcataagggccggaatggagaggggagaggcggagccgtcgagctcgtgttgtcgccgccgccggtgcctcctcccgcactcacaatcgcccgcacgccgccaaagctaccgctcgacctgctcgatgcctccgccgtcgacgtcccgcgtcctcctgcgctggagctgatgcgtgtggagggacagaggagaagaggaggcactggactacgaggtcgcacctcctcgcgacgacgatgcgaggatggatgcggggaggtggtggaggatggcggcgaggagctctgatcccggcgatgcagatggatccgaagctgtagcccgtagaccaccgaccccccgctcgatctcgtcggagttcgagttcaagaaggatacgacatgacagttatctattaattaggcgtagtttgttagttttcttttatctttaggaaagtgtgtttagtgtccgataagaactttatcttttcctttttagtttctttcttgtccgacaaggactagtatctccctatgggtataaatatgtacacccggtgtcattgtaatctatcaatctatcgatcaataatactctcggcgcatcgccaccctcttccctgaggtttttacttatcttccggcggaacttgggcacctgacgcagggctgcatcggctttcgatctccagcgaaacctttgttgccatcggctaaatccaacttatatgtatatgcaatccctacaagccgatgcaacgtccaaataacttatcggctagcaccccgataaaacattagcatgaacctatcggcttaacaagacttatattatcaacaacaatctagtagatcgaatctaaccgatgcagcacgagattgtatatgataatctaatactcaatgagccgatagatctgtctaatgtgatggatataacaaatctatttagaacaacattatgattgtagagatatatcggctaagacaggagatcagacctaactgaaacagtcccaactaaaccgatgcgtctctaaacacaatgcaattagagatagaattgagatatcaggtaggcaaatatatcaaccaaaccagagcgatccaagagatcgaatcgatgcagccttgaacaacaccaacgtagccgacagattcaccagggcccgacagaacgtaggacttaccccttcgctggagattgaaagccgatgcagccctgcgtcaggtgcccaagttctgccggaagataagtaaaaacctcagggaagagggtggcgatgcgccgagagtattattgatcgatagattgatagattacaatgaccccgggtgtacatatttatacctatagggagatactagtctttgtcggacaagaaagaaactaaaaaggaaaagataaagttcttatcggacactaaacacattttcctaaagataaaagaaaactaacaaactatgactaattaatagataactgtcatgtcgtatccttcttgaactcgaactcttctagataagcttcctttgattgatccgacgctaccaagaacacgacatcgtggagacttgactcccatctgctgattctagaactttgaagccgatactgactctaaaccgaaagtaactttgggcttaccaaatttcactgttaacactaggtcaacaccgccacgtcagcgaaactgccctccaaaaccaccaagggagtcaaattgcaccagtttcaatagtttgggggtgaagatatccggttttacggtttagggtcatggattagattcgggtcacttttaagggagtcaaagtgaacttattccaaatttaaaacatgttaaactattgttattattctagttcactccaaagcaaagaaaatctgtgtgcttaacactaataaacagataattttttatattgttatattttctgagtataaatggaaatagagaaaaaatatttgcttgatgaaaaagaaataatttttgtattgaacctccgataccaagaaaacagaaaaacttgttagtcgaaaatatttttgtgcagcatgcatgtccaacatcaataaaaaaagggggcaaaagagaacattaaaaaatgcaggaaaaaaacacaaaaaaaagggccaaaaggtgatctttgttgttacagctagcttgcaggtcgcctcatggtcagtttcttgagtgttaagcttggaatcaaaacaactcggcatgcaaacgcaatgcaaagggcaaggaaccaaacgctttgcttgcgaataaaatcatcagctcaggtcagagccctgcatgcatgcagcactactcctgaaagacatacacaaaatgtttttaaactctaattagttaactgcaaaatttctagtttgttcactggctagtgatgtgttatatgcttaatcatgaccgagaatatgcgtaatcatcgcttaattttcataaccagccaattgactttctgctccctgcttgcagttttacaaatccagttgaccatccacagaatcttggttgcgaagttcttctcctctgccttaatctgcatgatcattaccaagcatatattactcatttttcagataatgaggcatatattactcatgattaccactaaggcagatgcacctcatgactgaattccattgccaagcatatattgctcatgattaaatctcctaattaagtatacatacagtgcactccttgacacaattgcacataaaataacccgaaataacttaaaatcagttgacagtttcgtgtgttgggtgtagaagtgtagtgtgaaagcagcaagagagagcaaaggaagaaagaagcatgtgtaaggctgtggaaaagcattgcagcatcgatcatttgctgcatatatacgcaggtagctagctagtatataggagaaaagctttcttcttcctccattcttcagttcttctctcctccattaatttcagttcttcccctcgatcatcttgttgagaggaatgtcgtctggcctgagatcgtaccacagtggtgggtacacgtggacggtctcggaccaggcttcattcccctcaacaactcgtcggagtagaggaagaagacggacagtgatggagctcatctggacctcctctgatatccttttgcaccagcaacaatcttcgtcttgccctgtggtaactggtaagtactctcttggttcttccaggcatttgcacatttcatgcgatgatgaacagatgaagcactgagtttgatgatttcatcttccttaactcgtgaagcaatgacgatactagatcaattggttggaaaggaaatcaattcagacaagctagctagctagtagcatcttgatcgatcactactctcttagctagattgttttaattttatcagcagcttcatcaaatcgtcatcagcttttcctttttatctagctagcaatcacattcaccactctcaaaacacaaagattagtttaattatattagcacatttgtagattatatgatccactaacataagtgcttagccatctatgatcactataatacataattggattttaaatgaccgttgtttgaagtaactacaattgatctagtttgaaccgaagtggatgtagaggatgtagaacctcgaaccacctcatgtattgtcagtgtaggggaaatagtcgtagcggtgaagacaccagcttgatcccgagggggtcgccgacgatcacttgcagagtagcggtgaccttttggtctccacctacactgtctcataacagccgtacgttctccctctagcactcaactgatcagataaggtttgaggatttttagggagaaaatgatcgtggagagatcatcatctatccatgacaccggtctcccctattaatatgaaggtaagggagatcgggggcaatccaaaacatggaaagatttggcgctaccaatcaatacgcgtaatcatctaattatgaaaatattcacaaattaaatcacattaatcccacatgcgaagggtagaaaacagccgtgcgtgcggggatttcctctcgatttccatgccgagagatataattttccaacgacattaactactgcaggtagtatgcttgcggctctgcatgcatgatcagctgtggtgtcgtcgtcgccacggatctttctcttactatcatggaaagatcgcttccaagattgcttcgcctgctcgcacgtgtgaagcccaagaatccagctttgcttgctgcccctgttgcagcctgcagatgattaccgccgacacacatgcacgcatgcagttaggtggcaccactgacgacgacgcaaagccaccatttcatcaattatcaccgtactgcactttctgctgtgtgatatatagtgttcatgaaaattaacctggagatcgaacaacaagcttctgagaagaaattttgaatatttctgattctgtctcaattgaaagctactaggcaaaatgagtgataagtagtagcaaggttgttaattaataggatccccgatcgtatattgtaagatatcctagctagcaagccgaaacaattaatctcgtgttattctatttgtattcatatgctgatgctaccaatctcgtgggatcatatggttgtagtatctcattaggatcccaatcatatgattctatatgtaagtactatatattaataaaaagtggatcgaaaataatgtgaatagtaaaaaggtcaattaaatttaacaaattaatgttataggctttaatttttgcaatgtattacagatcttttataaaaaatatgcacttttgtaaaatccgaatccgataggatcctgatcctatgattcaatgctttcaggaaaaaatgacctatctaagaatttagtgagatttgggattatctttctttgcctccttgggctgtcatctactcctctagcttgctatttttggacaccattcatatagaataatttagtgagatttaggatctatagtccttttagcatgtattaacggggtatattcacatgtgtatacttgtggtgtagacgtgtagtatgtgtatgtcttgcatgattgggaaaaaaaactcagaatagcatgtcaagaacatttatatactgtcctctgagccggatccgacggcgccaatcctggccattagctagatccagtgttttgcggggtcaaaaaggggcgacagagacttgaaatgcggtggtcatcggtgaggaagagttttagtgaccggcgtggaagatggaggcgacgaccgacgggaagaagatggaggccatctatcatccccaaggcatccctcaagcactatcgtttgtcccgaggagaggccggaggctagtgaggagaagggataggaaagcaactatcgacgttgcatggtgggtggtgatgacgatgacggtggtcatatggcgacggatgatggctaacaacagtagagatgaggacgattcgtgaggcaccaagcaagcaaatgagaagagggaggttactggatcggatgtgtgaccccctctccccacactgcaccaactcatgcatccccacactgcacctgctcatcctcgcacttgtacgcgctcagccaagctctaaagtgaagctcaattccggcttcctcttgggcctggctagggagtcaggaggcctttatatgcatgtgcagcgccaggccttgtagagggcgcgggcaaccaaacatttgacaattgcatacgtggatataagttaggcttgatgtaggtaaccaaacacgcccatatgcatgatgtgacgctactagttatggttgataaagaaaatgatcgagaaagatcaatttgcgctgtgactttggaaagtaaattaatgattagttctaagaccttttaacttgtaaccttgtggggacgatgctacgatacctttgtggttacttagtttattaactagatgtaatttggatagaaacgcttttgtgatcggatttatgcatgttagctcttttgagcatcacctgtggtcatttcaattggtaagacttttctggtctcttgatctcttctttggagtcttcgactcttggtacataagtacattgtgagcgtggcttcaagtttgagcaagctagctctccgctgtcacgaggattgcacggaaaaaaatcatttcacaccttaaagtttattatcacataacttatatgataccatattacacatatcaaatatgtaaagttattagatgtgcttgagatatagagaaagaaattaaaaatccaagtgtgaatttgtgctggacgtactatatatgcgccaatggattttcagtacaccctttggtcataatattataagtttaggacaatatttggtccattttttttaaaaaaaaattgataatcaacaataatttgctaattctcaataaaaaagtatgtgtagatttacgtttaaaagtattgtcaaacttattgtatttaaaaatgatggttaaattttcaaagtttaatcaaaccttattctaaataacaaatatttatagccggatggaatatttgggaggaaaagtatactgtggacactaaggctgtgttcttcccccattttcccaacccacctctctcgttttccgcgcgtacgtttttcaaactgctaaatgatgtgatttatgcaaaaactttctatatgaaagttgtaaaaaatcatattaatctatttttttaaaaaaatagttaatacttaattaatcatgcaataatacaagcttcgttttgcgtgccgggaaggaggggttcccaactctttctcccgaacacaccctaggatcctaaccaacaactaagaattattgtaactaaattttgaacatatgatttctgcacggattttatagaacttaatctatttttataaatactatataatattcctaaatagaatagtaaactaacgttatacaatagctataatttggtgggcgcaccactaacgtgtatatttagtgagtgacaagaataggggctaatgaatgggtgcgtcaacagacatatagattttcaatgttaattcgtaaaacataataacaatggctaggctaacttgtggttgacaatatttgataggttgtccaatggtatcgattattatgtatgattttttacattgcaaaaatcagataaaacacaagttgtaagtaacatttgaatattcataaaattttgttgaaaaaaaattaggatttcaaaattttacaatatataacggttttacaaattaggagagctttagataaattttacaatatataacggctttattgaatgcttattcattttttacatatgcctataccggttaactagccagcgccattttctacttcttattaaaacaaaaaatcgcggtgaaaacgatcctaaaaatgcaggtttacctgggagaaataggcaaaggcccagaaaattaaaccctgggccaatatgggccgtccagatcggatccaacggtagcgaagcccaccacaatatctactccccacttctccagcccctctcgctccgggagcaaacggcggcgacgcttcgcctccctctccggccgccgccgccgccgccgcagcccatggcgtcgctgctccgcctccaggccctcgccctgaacctaacggcaccccgccgcctccccttcctccctctccgcgtcacgactgcgacggctccgctcgccggccgcctctccaccgccgccgcctctggcagctcgccggagtcacctgcctcggaaccggtgacctctccgtctccattagtacatcagcttatgattttctttcacttctcttgcaaagttttctcacgggtggatggcctcagtatgtgtgggcgtggggggtttcactgtgtgagtgcatctcagaagagctagaaaaaaaattggtattttcagaacaacgcattggtttgggccgtagaactaaaatcataggtgatgtggaaggtgtaattttggtttatgagtattgagacatttagcaattgttaagataagtgtgtttttcatgcattactatgtgccaaattgcgagcggatgttcttctaatgtttgagcaagcataaattcgtacctgtggaccatgaggaactttctcagctctcaagtgaaataagagctgttgttcggaatgttgctttttatgcaggtgcttgtgtcttctactcttctgtatgaactggagaactggagtagaacgcaagaatgctttcgtactgtattttgtggggaatatgtacatattggtcaattagattgtccatgactatttcatgatgtctgttgttgatctattacaatcttcaggatttggattccgggctgtatcttgtggcaacgccaatcgggaacctcgaggatatcaccttaaggtatcagcttttaatctgttatggggtcaatctgcaaacatttttgtgtgggaaaacacttggtcatcaagctgacgcctacgaaatatcttctgaattttgatgtctatgtcataatatctagtgattcataagggtataccagggtaatagaactgacagtggtatgccgttttacttaaaaagaaaaggcgaaagtattgggacttgtctgattatacaattgttgtaaactcttaacaaaatttgtgaataggcaatcagctgattagcagcacttcttttagaataaaagaggaaatagagcaatgttctgctaaaatctctacagggagaaaaaaaaactttaattgtttgatagcacaattagcatcagttattattattttttatcaatcccctttactttttaccatgaggaaaatatcagggagggcatgctttctgttctgcacaaaaaaaaagaagaagaaaaaggaaaaacaaaacatagttgttttggctgaaccttgaggctcctccatgtagtaataggctgtaactggagcgtgtgctcctttcctgaaacatgctcctagctttaagcttggatggtccttgctgcagggcattgcgtatcctcaaatgtgctgatgtcatactatcagaagacacaaggcattctggaaagctacttcaacattataacatcaagacacctcttgtgagttaactgcattctaatgtttttgttcatgaatcacaagtagttgcacatttgcaccatgttgtgtgatgagtgccattgaacttagtctaaactgtaaaccttgcagctcagctttcataagtttaatgagcgtgaaagagagcctaatatcttaaagagacttcatgaaggggaagcagttgcattgattagtgatgctggtactcctggaattagtgatcctggcatggaactggtaaatcacttcactcctttgaccattcatacttgccaatctgtttgaatagtacatcctgctactctcttaaaccatgaataaacaaataggcaatgaatagtgtctaatagtgaaatgccctgcaaataacaatattattgaagcacattctacatgtgctatcagttagttgacactactcaagttagcagtaacagcatcagagactgttctttttaaagcccgatgctgcttctagatgtgtgagatgttaagcatgttgtactgttgcttacaggctagactatgtgctactgagggaatccctgttatccccattcctgggccgtctgctgcaatagctgctctttctgcatctggtttgccaactgatgaatttacatttggtaataaaatgattatgtacttactttatttatcaacaatgaacaatatttgttgttagttctgatatttcatttctagtggggtttttaccaaagcatgctcgatcaagaaaagaaaggcttgaaatatctgcctgtcaagctgccacacaaattttctatgttcctccccatggaattcaccaatttctttctgatgctgcttcatcatttggtgattctaggtaattgatattctgtcacccatgtatatcattgcttattgcatgatctggaatttctttttgtggaatttgtagtagtattatataaacaactgaaatactgcactctatgctgcatcccatttgtatgtggtgctaatgtgttatgcatgcgttgttgatctttcttttgtttatgtattgatattcaggtcatgtgttattgcaagggagataacgaaattacacgaagaggtaatcaacaaatttttactctgtttatatttcaatcttcaataaaatactagagctgtttcttcaaataaaataaatatacttcagctggtagttacagcagatggtatatcccacccactataagcaggtactcttaacttgtagtgctgtcatttccagctttacattgctgaacctactgcgaagtgctactggtcagattctacttggtattgactctgaattaagaaactaatatgcggtcttgttcatgccaatcagctatactgaattgtttgtgtattatctgtagaccaagctgtacccttatattctacatggtggactcataaatatttgtatttacttattttctctttgtagtcctgaatttgacatacatcttgtagttttggcggggaactattggtgaagcaaatgaagcctttgcaactcggcagccaaagggagaaattacagtgctcatagagggaaagttaatttcagctgatgaaactccatctgaggatttccttgagcatgaactcagagaattgatgacgcagggacatcctctgtcagcggtgtgcattcaacttagcttttgatgcctttcaagtcttcagcaatgtttcggttctatggttttttgtttttaagaaatacacacaaggtactggtcatacaatcatatcttattttctttaattctgaaataatgtttttctaatgtaggcagtgaaaatggtgagtgaagctacatcagcaaagaagaaggatgtttatgccctcgcattaaggttatttggaaaatgagtaaaatgcgatgttttgctctcatatggtaactaaactttcagaaaccatgaaggatgtttggaatgtgtcatatttttcagtccatttgaacatcgcggatatcttattgcctgtgtgcgtgcgcagtaaatagcctattgggcacgtccaaggccagggccactcactagcaaaggcagctttctgaagatgggaatagcaatggcagctttctgaagaactagctgattcaaacttttgaaagaggtgatatttggggaattttcagaaggtaccattcaaatttgctggaggatgatgctgttctggcgatggaaaaagtcttcgatctgtagcttcatcgttgtacaacagaagcttcgctgcatctgcatgacaagctatagctacctggttaggttaggcggtaagttagtatgatcaccttagattttatcgcaatagttatcgcagtgtatacattttgtcttagattcacatttatcgaaatcattattatggagctaatgggccgaatccgtcgtgaatggaccactaaacaggcctccgtaaatgagctaagcctgcgttctttccttggtgctgggaactaatcttgtggaacgttacattaacgcatgattaattaagtattagctaacttattttataaatggattaatatgatttttctaaagcaactttcgtataggaattttttgaaaaaaaaaaggaaccgctcaacagtttgaaaaaagtgtggaaaacgagagaggagtcaggaacaaaaaagacacaaccttaattaggttcgttcagtaaattagacataaagatgaccattccttcaaggaaattgctatgtatatgacccaactgtccaactcacttgcgactgaatttgatcaacggttgtaaatgggtacaatgatataaacatgatttcctttgattgatttatggttgcatgtttctagttgtataattgggttgtacatatagcagtattcttttttcaatgggccaaaaatgaatttgcccacggaaattaagtccactttgagtcccacgaattagatttggccactagttaagggagtcaaagtgcacatattcctttgcccacatcatttccttgaatgaattcagcccataactaaatttggcccttctccttcgcgtgcatgtattcggcctattcatcaatcaagcctactcttgaaggaggcctggaggagcggttctgtcaggccaccaccgagagccggatctatctatataacacccgacagatttttgttataaaatcacacagatttttctaaccaccaaacggccaacttgctagccaaattaaaaagcaacgcgtatagtgtagattaaggcgtgttaatccaagccacaaaactaactacttgtcagcacatatactaaaggctttttttttaaaaaaattacaccctaattacactatacttacatttgtaactatactatagtgtaattacagtaactaatatgtaagtatagtgtaactaatacataattatagtgtaactacactaaaagcttttttaaaaaaaattacaccctagttacactatacttacacttgtaactatagtgtaattatagtgtaactacaccaaaatctttcttttaaaaaaattaaaattacaccctaattacactgtacttatgaatgtaactacagtataattataatgtaactacaccaaaatctttcttttaaaaaaattacaccctagttacactgtacttacgaatgtaactatagtgtaattatagtgtgactaatatgtaattaatatgtaagtacaatgtaactaatatatataattatagtgtaactaataatataattaatatgtacatacagtataactaatacagtataactaataagtaagtattgttttggtgaaacaattagttgctccttcttgctcagctggcaaaatatttcacgttcaaagcatcagatcatgggatcgactcccacggaggttatggtagtcctttttttggttgtaacggacagatagcacaaatcataatgcaatttggacggtggaaaatctgggagatttctaacaaaaaatttgtcgacaaatttttagcaaaaccgccgagagccaggcgtggtgcgggctcacccgtagcaacggggacgtcgtggcggacctctgcggcacgctcaaccatctcctccgcctcgcccccgcccaagctgtcgcactactggagctgggaaagttcccgtgtgcaaccagatgctaccgtgggtttaacaaaacacccagtaacttaccgggtgtaggactaggaacacggtaacgtcccaacaatatcgtgcgctaccacgaaacacccggtaacagagaagttaccgtgtgggaccacctggagcacggtaacatgactgaattccatacttccgttttcactccgttggcacgaactttgaattttgttggcacgcactatgattttgttggcggcaacggagcggaatcctcccgcctgttttttcgttttgacatacgggaatgtctaacaatttcaaattaaaagaaaagtttaaaaagtataaaaaaatgcatgaaaattgtaaaatgtaagggaaaattatttatatcgacactctcaaagatagtagagtagtagacaatacaactcgcaataatagggtatctataattcacaactcactgtacacaatatttttacggataactgaaaattgcaggaaaatattataaaatctaaaaaacacataaaagttgtaaaagtatagaaaatgaggaaaattgtgaaaataaatttggcatgacgtgtgctacaatctagacactcccaatatagtagacgataaaattcacataatacaactaattttgatttattattattagattgaatttcactttacgctaacttttattaccgatgttttctctttggatcatccttttaaccaatatttttattttggattggttaatcttacccactactaaaaggcattttccatatattccaaaacctttttttcgtgtggttgagccgtccatttgcccaaaagtgtatgtgaaaatcgctttccacatgggtagcgcacctgcatgccaaaatcagatttttgtgtgtggatggacgcaaaaataaaaatccaaaaaaaaactcgaaaaccctagctaggtcatcgttgcggtccatcaccgcttgtcattgtcgccgtcaagagttctttccacatgggtggcgcatctgcatgccaaaatcagatttttgtgtgtggatggatgcaaaaataaaaatccaaaaaaaaaactcgataattttcatcgttgcggtccatcaccgcttgtcattgtcgccgtcaagagttcatagacaagtaggagataatgtacctgtaatagccctcccttcagaaccgcgtagcccagcccatccgacgggcggacccacttacacacaccactcgacttatatttcttcatcgcttcgtataaaagggttaacccggaagtggcatggttggagggaagatgccttgtaaattggttcaactcgtgctaaactagtaaggtgatactaaacatgcgcacacagctcacaggagccacataggccaaatcctaattgggctaggatgtcacagtacccaagatggctcaaatgattgagaagagagccggatggttaaaagtgcaagaaaggtattattatcttttaaatagaaaggcaacgtcagttgtgatcgcactagctagtcaagaccaacagaactagatgaaccatatcctggcttgattcccatgttctacttggatagggacacagatgagtataaatacgaacacaaaaccacatatcgttttggatgagattaattgagtaggttataattaggatttcccacctgtgtgttgttctcggtgtgacttcaagcggtgcacataaacaagtagtgttattacccactctgttaatatacaaacacatgatattgtttggaacaattgcaaacaaactaagttttaataacaattatatataatttgaatatttaagttctcattaaagggatttgtacagaaatcgtgtgaatagtattatttttccaagcaaaactgcttgtaaactgtggtcgaatggatttaaatcggacggcttagattcatcaacagatatggctatatatagaacacttcaaccctagcaagccacctctgacccactctggttctccaccgaaccgccgccaccccccttgcatcaaccaaataatatgttcctagctattgtaactttggctattgctttaactgacatgaaccatgaattgcttgtatgctaattattaattgtaacctctttactgaaatatatatttatgttggaatgtgttgtgctcttgtgtgcttgttggtggtttatattgtgatggaaataagctctgatggatatagtaaacaaattgcaaatagcatatatttttttttattaacacatgttctcatagcgggtgcttcaaacacggtaacgcaccacatgttaccaggtgtgaatgaatcacggtaacacaccaaatgttaccgtgtgtgaaggacactcggtaagccaccgttccgttaggagctccgttacacaagagtacagctatgacggctgccttaccgcgggagtgagcacactcggcctgagttttggccttcccgtgcgcataatcttaaaacacccgggaag

SEQ ID NO: 5166 - DNA, 1801 bp, Oryza sativa
cgctagcagtgtcaaagtggttgtgcaagtcgtgtggcgagggcgatgccactgtgttgcttctcccatgtcaccaccgttggctctgcagggagtgcgagcccaagctggacgcttgccacgtctgcctcgccaccaagaattcctctgcttccatccgcatcgtcgtgtctaccacgcccaggtcatcgccgcctccgtctacaaggtggtgggcctctaggaccacaaccccggcgccaaggtgctcaccgtcgccatctatgggctggaggggaaatgaaagggatgtgaggctaactactgggtcccacattattttctatccttgtttgtcatgttggcatgccacatagataaaagtgacaaatagttaagaaaaccaccatcttagaggagaaaaaaaactttaaattaggtatttggataattgcccagcctaaaagtgttggtccatcacggtccatgacccaaagtcggccagtgatatgaccttcgtgagggccaaattcccatggcgatcgaccgttttcaccgcaaaaaaattggtaaaaatggcaaccacttaatttcattgtttgtttgtttgtcattacatgccattttctaatatgtgacataacgcacaaatcacaagatcgatggacaaaaggaagtgaagttaaggggagaagagtgcaataaacgaatcggactcgacgggcaatgaatcttcaatcaaagtaagctgctgctaaaattaatttttaaagcgaaaatttgcagttcattttgccccttattttgacagcgttagtttttttattgctaagactaaatatatagaagttttattattgttaagaccaaatatataaaagttttaaatacaaattacttttaattgttataataatctttttttacatcttcctcactctgattttccctccaccttatcgactttctttagaccaaccgaacgccgccgccgcaagaacagcagcgccaaggccagcagcaacgccgccgctcccaacgtcagagcgacgccggagagatcgtcgtcgcaagccctcgcgtacatgtagaacgggggcgaccactcgtggccgcggcggatcacggggccgccgccgacgtagaaccacggcgacaggacggcgagcatccgccgggcggcgaggacgcacgacgccgccgccaccaccgcggcgctgccggcgcatggcagcggcgacgtcgtcgagccgcagatgagcgtgagcacggcgagtacgacgacgacgacgacggcgaagacgaagccgttgctgcgattctcggctatggactctggcattttggccaccgcgcgagagatcgatcaatcgtggaattaattgggatatcgatctgatgatatttttcacgcggcggtgaggcacttaagtagtataacgatgatgagtgatggagcggtcaagctcatgtggagtcgtcgtccacgcttaccgttgaaagcttcagaagttcagagcacttatccttgtatttggatttttttcacataaatataattttgttattttctttttctttttgtaagtctagataaaattaacttggcaaaatttgctgtaggacactcaaaaaacttataattggctgggagacactgcaaaaacgtgatacggctgatgcacactacaaaaattgtgtaattgggtataggacactggagccaatattttataatttcttgtcaaaagagggagaaattttttgaatagcgagattgtccctggagcgaccttgcttcacccgaaatgacaattttttt

SEQ ID NO: 5167 - DNA, 14700 bp, Oryza sativa
atcgtcctcctagtcgtcggtggtcacggcggtggcatggagcacgaataggaggcagccgtgcgcgagaccggcagcagtggcgaggagtgcgagcaggaggcggccgcgcggggggcagtcggtggccacgtcgatggcgtggagcgcgaccagcaggtgaccgcgcgtgaggcggctgcggcggcgctccgtgttaggggcaatttcgctattttgaaaaatttctcgcctcttttgacccagtagttataaaatattgcctctggtgtcctatagccaattacacaattttttagtgtccatcagccgtatcacgtttttacggtgtctcctagctaattacacttttttgagtgtcatgtagcaaattttgccaatttacttagacgcatgttatttacaggtgtgtttagttccttgcgtgtaaagtttttgaagtatatacacgcacatttgaagtattaaacgtagactaataataaaacaaattacagattccgcctgtaaactgcgagacgaatttattaagcctaattaatctgtcattagcaaatgtttactgtagcaacatattgttaaatcatggcgtaattaggctcaaaagattcgtatcataatttacatgcaaactgtgtaattgattttttccccgcatttaatgcatcatgcatgtgtccacatttgatatgacgtttttgtaaaaaaaatttgatatctaaacaaggcctacgtcattacaattattttttttttaaaaaaagtctcgtttgttttttttaaaaaagtatttcttgtagaagattgatctttagtaggatgatttcgacatcaaagtttctaataaataaacaagtaacgttttggttattaatgcataataataaaggagcaagtttggagtaagtcgaaaaaatatacgaaacttagtgtttccgtcttctcattttgtatgttattgtttctcagtcattagttctagagtctacatattactctaactctaaatatattcatatggatatatataggtaggatttcttctatcactaaaaagatgtcatcccaatttattgtatttgtatcatattttctatattccttttatactctctccgttttatgttataagacattttgactttgatcaaagtcaaattgttttaagtttgactaagtttctagataaatatagtaataactgaatatattttcataataaattttgtcaaggttatggatactatatatctaataatagttgactaaatctcggcaggatccaccacataccatgtcttatacggaaacaaccttcggatataggaggagatccgcataagaaaggatgaatagagttctacatggaaacgataaggactactcggattgtatctatattggttttcctaattctacttggacaaggggacacctatgggtataaatacaaggccccctaggaggagaggggatacggaacaatagatcaagacacaagatcaacatacaagccaacatgcgccaagacaagctgccggatatcgacatcggtgataagcatagttagtccctatacggttcctacgactaccgtcaggagggatctagcgctgtctctgatctcgccggacacggattcgaggaggaagactactctgttgtcgactacgggatggttttatagccgccaagtcgacaatagatagataggctaccccaaatattgtactggtgtgattatgatgaataagagcaaagaccggcttcggctaacaggagtagggttattacctgacaattcaggggtccgaacctgtataaaaatcctcgtcgccatcttttacctcagtctcgcatatatcctagtaccaacaatcctcatactatgcaaataccggaatcgcgacatcaaacgtcgacaaatttgtctttggttgaaaatgttactattttttttataaacttagtcaaacttaaaacagattgacttcgattagagttaaaatgtcttgtaaactgaaacggagggagtattatttacaatacatgcacaaatatcggtgtgtcgtgcgcgtacgcacttcgatgtacctagtatatgtgattatagcttttaaaaagaacatcaagctcttttttgtgtttgatgtaatgtttcatctgcaaacgtggtaatatttaacaattttgattacgaactttgtgaggcactggcagatgaatatctaattaagtcgacggcgtacacacggtctactctatttacctcggtcaaattatctttacgtgtacgttgggtgtgtgccagatatatgactatctacatccgaaattgccaagcggccaaacttcggaagagcgagtccgatttgtgatagaaaaaattctatgtgaaattaccatgtactctgtcattttcttatactcgctcggtccctctccctccagttataagtatttgactttttgggataagatctggtaaagtctttggagggagtagtccttgtcccaacaaatatggtaaaccgcttgattataattacttttacattagtagtacttcctccattctaaaatataaggcacaaccactcttagcccaaagatcaagaaacaattattatcatcccctagtttagattaccctaataaatataatgcatgcatccaatagaattagtgtagtgaccctcgtattctacttccggggtagaataccggtctacggctcattccttagtaagaaccaacttaccaagaaatgagtacaccagagtagcataacagaaacaactgtagcgaaaaccattaaataaaaactaaagaaattagcttttgctaaaataatcactaacaataccttgctattctatatcttcgtgaccttcaactctcagttgatgtagagatatggaacgagtctttgctttgatcttgatcaatcatgtagaacatttcttcacctaattgttagctcaacactacaaggaataatatatataagggatgagtacgaatggtactcaacaagtacaactatagcaatccaacaaatacatgcctataattcacctgcataatatatatatctccaaatcccataatcgaacaagtagttttatgcaagttcataaaacagtgtagtaaaaactcatattaagtaattataaaatctattgcatataaggcaccacaggtattagaacctccgataggttcctttcctgccgcgttcgcagtttctacccgaaacagggagtgtcggagtgacatatcataattcatatactctgcagaggtgtgtcgctgtacccacagacgccttaaaccttttaatgcccacgcctgtcggcgcttgaagcacacttcatggtgtatgctggcaaggctaaggtcacaagcttttcatcaatcccatctgtcaattatctctgcaggtgattcccgcaacaacggcgaatcatgtgatcccgcaacaacagcgatccacatcatctaatcggattctgcaacaacggcaaccctcatcgctaggccacgctcatgggattcgcggaagtccttaagcccgcaggataaagccattaagaaagaactactaagctagcctgttccattccaggtcatgtggttgccacgatcgctacggcgcttgaatgccatataacagttgttgtttaaccttatgatgataaatatatgtaactgaacccccaccaccatggcaagttcagaacacacctataatatgaccgactgctccaccagtcaatccaatccatcagcatatttattttaatcatagaaagtataatttaatgcaatgtgatacatatagattgcaattacgaaaatagaacaagagttggtcaaaggtgttggacttgcctaagatacctgaaatcgaagacgaataaattaatgaagaatcccaagaaatccaagataaacgccaaactgaaagaaacaataaaacacaactaaatacgagaatgtttatatgaatgcgatgcacatgatatgcctaaccttaatatcatagctaatctacaacactataggttatccactctcacctcaagactcaactagatgacccatatgtatttttaagttgaatatggttaaatatatttgtatgttttgatttggtaaagatctatgatttatataacataatttagttttggactaaaatatttagtgttaaaacaaacatcattgcactttttatttttaaaagagtaattattttaattgaaagaagttttactttacttgagagagatttatattcaatagtcattaaattcaatagtacacatatatacagcccacatgtcaaagcctaacagaaaagcccatctagaccaccttcttcctattctctctttctctcgttcttcttcctctccctcaccctctccacgagatttttgacaataagccactaaatatgtgcgcctttgcaaacttaccacccaatccgcatgccttctctaatacactactaggagtgctaattttttgatttcatatcactttctctcttttccatcattttctctttttctttttcgttttctgttgtttccttctcttttcggactcttttacccctggccccacttgtcagggaaagggatacagagagaaggggatcgggatcgggaaggggggaaggggaggcagagcgcgtgctggctgctgctctgcctctctcgccatagagatcaaaatggcgtcaggagcaggactgcaggacgcctgctgccctgctgttcctcttctctgagcaggatagtggcatactcccttcgtcccacaaaaagtcgaattctaggggagggagtttgtcccacaaaaaactgactcctgcgcacaaaacgagaaacgtcgtctcgagcacatcgatgggcccatggcctctctctcctcgcgttcagttcacaccgctcaatccttatcctctcccacccagcggttctccccatctctctctcctctactcctcagccttctcccgctccaccatcatgtggcggcggacgccgcctcgacggcgggggcggcggcggcgacaggcggacgcggcctcgtctgcgggggcggtggcggcaagcggacacggcatcggccgcggcgacgagcggacgcggcctcatcggtggcggcggcaagcagacacggcattggcggcagcggcggctgcgacgacggacgcggcctcgtcggcgacagcgaccagcggacgtggcatcggtggcggcagcggcaacaggcggatgcggcctcctcggcggcggcagcaacgagcggacacggcctagtcggctgcggcgaccagcggacgcggcatcggcggcggcggcggcgaccagcggacgtggcctcgtcagggttcttgctagttcatgcgtcggggttcttgctagttcttgtagtatctctttttctctgttgttggttcttctcggctcttggttcttctatgttcttggtacttgctagttcatgttcttggttcttctatgttgttggtacttgctagttcgtggcttcatgcacgatccagatggcaaaggtggaggcttgctggtttttggtgttgatgcgtttggtatttggcgttgtcatcaaatgcaggtgacaccattactcagtgatgcatcgacggcgaacatccggtggtgggatgcctgggtatcgaggaaggggctgggaacaatttagtgttcacagagatttttttcaaaacaaaagtgctaatcatggttgtacttgatgggggtattttgatctttcaccgcttggactaaaagtgcatcgggcttctaggattcgatattttatgggacggagggagtatattgctgcatataactgctgcatatattgctgcatgtattgtatatatgtgtattcataaactgttgctccgatggcaaaattttgacagcatgtaagcaaaattttgacagcatgtaccctaaattttggcaacatgtaccttgcaatttgtagagcatttgacacaagtcaagaaagcacttgacatagataaaaaaatggtagcatgtacccataatgcacatataaccatttgagaacaaacaagttcaataccaaacttgagaatatcatccagattacataaccaggctctccacccagcgccgccgcttcccaggcagtgccgtcgctctcccttgcgcctgctgccacaccccactccggcgacccttctagccaccgccccgcaaccgtcgccggcctgaatcggtttcttggatcctcgcttctctgcccctaaactaaccccagccgccggtctcctgctactgcagccaccgtggagatggccggtggaaacacaggcaactccggtggctgcatccctctgctccataggtgagctacctattccatcctcccgtctctgatccctattgtgatatactagtgtggtgtcctctcttgtatggtgttgttatgtaaattgtgatgtactggtgatgcttgtgaatttgtcctaatgattcacttgatgatgttatacttagggttgtatttactggatctagggttctagagaaattgggttgctaagatggatgatgcctatatgttcatgatgaatgaatgctgacatgaataggtctatgaattgcattactaaaatagaaatcactctagcatgattaaatccttaattatgcttatgcaatgaccatcgtgttggaaattaatttgtgttcttgaaataacaaagtcaaattggatttgactactagttggtcaagttggttgcttgttgctgcttgaagtttctagcacaaattagctaagcttagttgtaaatgagtgataatgggctatagaatacacaagtgagttgtatgctttgttgtgttggcatggaaggatacaaagcaaattttactagctagcaagggtgtacactgtattaggtagtttcattgctgcttgtgcttggcaagcagcatgtgtgtcttggtagcaagctagttttgtgttgttagatgagctgtaacatgagctgtaaaaacatgctactgtagcaggtcggttactgtagaaaccgacctaaaagtcctataaaaggacatatactcctatgtaaatggtgtctagggcttatgtaatatatgaaaatgtagcttctttgctctactctgttctcttgctctctatcttttccatgagtgatttagatccttgtattagaaaaagcaacaattggtattagagcctagttcaggtgaggcatagatagagcaagatttgagagttcaagcctttgtttttaagttgggcatagcaggagcaagaaagtggtggaggtaaggagcacgcccccgatgacaccatgacaatgctgtggagtggcacctatcgtcatggtggttgtggcagtgaggccgatggcaacaacttgtgagaagttgagatggtgtgcggtggtgtgtgcctagtacggagcatgtggctccatgatgaggtgcaaaccgcatgttgttgaaccgtcatctcggtatgtgtatgtagttgattccatatacataccagctagttgtgtgttagtttttgtgaatgtgtgtccacaagaagatgtgtcaccattttgaattgggattgtagagttaataccatggtagatgagtctgggaagatgagaagttgagtcactgtctagaatcgatggaagatgatactccggatcttgagaagatgtgacgccatcctgagttaagagtcccctgattcgagtccaagagttgtgtccaagatattgaggtagatgtgctcctcgtcttgaattggattcgagagttgcgtctagggtgagtagtagctagtttgtgtttgtagtcctatattggttccaagagttgagtccaggacgttgaggaagatatgttcaccgttctgaattggtgccaagagttgtgtctaggacaacgtgaatgtgtgttttgttcaagttggcaagtcgtagaagcgacagactacccatcttgaagttgagggagtttggcaagtcgaagatgtgaccgactgactgaatgagtatttgttcgaggcgtgttaagttgcgtcaccgtctcaggcaaacacatgagtcaagttgaagatgtgtcctactgactatcaagtgtgagcactcatcaagtataaagaagcgaccggagtaaagtgaagatctcaagaatacaaattaagggggagaatgttggaaattaatttgtgttcttgagataacaaagtcaaattggatttgactactagttggtcaagttggttgcttgttgctgcttgaagtttctagcacaaattagctaaccttagttgtaaatgagtgataatgggctgtagaatacacaagtgagttatatgctttgttgtgttggcatggaagtatacaaagcaaattttactagctagcaaaggtgtacactgtatcaggtagtttcattactgcttgtgcttggcaagcagcacgtctgtcttggtagcaagctagttttgtgctattagatgagctgtaacatgagctgtaaaaacatgctattgtagcgggtcgcttattgtagaaaccgacctaaaagtcctataaaaggacatatacccctatgtaaatggtgtctacggcttatgtaatatatgaaaatgtagcttctttgctctactctattctcttgctctctatcgtttccattagtgatttagatccttgtattagaaaaagcaacacatctaaatattaaaatttgttacaaactaataaactaacatgatcagatccttatgttgccatgctgaatagtaatctagaggattaatatgatttcattcatacatgatgcataatggtagtatcacttgagggatttaatgacctagaaattataaatcttcatcttgatgccaaagtatacttactactgaaatcacagttaaataatggtgtttatggtattggtcttagcaaggttatgctgatcaactactaaagtttagattctgatattatgctcttctctagatgacttgctgtagagacccataagtttaggtttattcgaactaaagatatacctgtgcacttgctatccagagtaatcctatacattcagtatcactaatattaagaactaatgcattggttgatttttaaggctgctaatgtttctcacagtggaatacgatttatattgattactccctccgttttataatgtaagactttatagtattgtccacattcatatgtatgttaatgaatctagatatatatgtgtgtttagattcattaatatttacataaatgtgggaaatgctagaaagtcttacattataaaatggaggaagtaatacttacagaactaatatatgccatgctctaatctagaatcatttgccctagatgctctgctatagagacttataactctactcattaattctaactatttataatttcaggattcaccaaacaaatgcatgcgcagctgtttacctaaatgcatttacataatgattctagaaaaactaaaatgtttcttgttactaaccccaaataattataaactaacattaacctatttacttatcagttaaataaaaaaatatttatgtcctactagttacacctcctactctacagctcaaattgttagaattttaatagttactctcattgagaagaggatggcacttaggatggggcaattttctggttttctttattcataaactcaaagccatacctacccgagggaggttggatacatatatatagccatagctggctgtaagcctattgctgcaccctagtctaaaattcgaaatttgaataggatgctgtcctagaaggcatccaaactgaataaagtataaatgaggcataaaggagatgctaactgctgttgtcctactaaccgcagctgtcctagcaactgaaagtatgctaaaggagtagatgctgtccttaaaaggtgaaactacccaaaagcaaggaagaaccacgaccaaggactacaaagacttatccttcacaaattacttaattttcttgttcatattctaatggatgcaaatgcaactcacaactcctacacatactagtatatgcatcactcaagaatcatgccatgatatgattgtactttcatttcaatctcctgattacctgccatgattttaggtgactgatatagggaactctggttctgcagctactcttctggactctgattcaagggttctcctgatggaactctgatttctcctctttgagctgaagcaccacctgctcctccagaaactgaaacccctctcttcttgaagctcaggtacctcctacttgatttgcacccttgctaacgatttttctgatttcttgttcttgctgattttacctcctgatccaatttacaacagttgcctgttctcctcctttcttcttgtcctgcttctgctgttactgatccatcttgtttcttgagctgaagtaccatctcctcctagagctgaaatcactgttcatgcagaaccgaacacccctacttctccttcttcagatttggttcatctctctctttctctctaccaagttgctttactgtggatactatggttgagctgtggtgttggtgaggtgtataatttctggttgaatatctctttatctccctaacctctactgatttctagtcaagactgccttactccagttgagattctactgcttgtactgttgttcttcatagctgctactcgcccctaatgttgctgccactatggcgatctgccgctgccgctgctgctctttgcagtagaaaatggtagtactactactgctgtgcctactgctgaatgtcattttcaatcttactaataactatataagaaatcctgtcaaaattttagtatggtaactatgctaaattttagtaaggtttttttagcattaaagtgaacagtctcttggtatcgacgatacagttgcttggttggaatgaatggtttcacactgaactagttaacttggtggaacttaaccagtgactcacttacttgttgtttggtggctgcttccttgattgacacctcaccatgacatgttcggtggattaattttgagaggtttcactaatttacaatttaatggaaatctggtgaaattggaatacttagtaattttgcattctagtctataagcttttggaattttggaggttactccagagttaagggaccgattaataattgccctagaattcagggagttttatgcaaaaatggataattttggaatttggcttgagatggctcggtttacgggcctgttcactttaatgccaaaaaaaaccttaccaaattttagcattaccaaaatttcagtatagttgccaaaattttggcaggattttttatatagctaccaaaatttgacagcaaactaaatgtagccacttttttagcaactttactaaaatttggtaaggttgaaaatggcatcaaagtaaacaggccctacatcttttgtgcccctatttggttggatgcaaaatttgtagattgagacaacacaaaaattcctttattgctactacaactaaagttttaaatatgcaacctcctaaatagaaattgtgcggtctaaaatcatataaacatttcctaatacatttaatttctccttttacttgaatgcagagcgtatgagttcagtttgtatttataagcaccatgtatctgcacaatatatgagatgcatacgtataagatttataatgaatatgtgtacacatggatgtatgccagtctgtatatgtatgtacgtaagtacgtacgtacgtacgtatgtatgtatgcaacctataaccaaatagtttgtgaataatttactatagtttcagttctgatttctactgtgcatgtatacctagcttcgtgacaactaatctacgtatagtttgatcgaaactaaattatcccactcctcaacagatttagtctaactaacaataaatcaatgatgcatatggatatgacttgataaataaatgacaagaaaacgatcgaaatatcatttaagatccataatagaacaacaatcaacatatttataggtcctagccagaatcgtggctcaatcaataccgctctcagccagtgtgatcaagtcattagcgtgattaatactatagctaaatacccaagatgttacaattagagatcttaagggtggaggatttaaaaaagtaataatttaatagagaagatgtcctagttaattgtatgcaaacatgcatgccttatattatggaacacctaaaaaaatagttgtgttttatattatagaatggagggagtatataacaatgatcttgttcactttgatgccattttcaaccttaccaaattttggtaaagttaccaaaaaaagtggctacatttagtttgctaccaaattttggtaactatataagaaattttatcaaaattttggcaaattttgacaactatgccaaaatttggtaaggttttttttggcatcaaagtgaacaagtctaatgttttactaatttttaagtatagagagagatcgcttacatatcaggtacaactgcaaactgcataaagcataaagcataaagtcagttgatcaggtctgtttcctacggccattttctaatgtcatataaactgattcatgcatgcacaaaagactgatcgagagaagtacggagtaggttggaaatttcggacctcggaaatttcggtcatttcagtcaccttcgatacgatattacttcgaccaaaattttttcatgaatttaggtaatatttgttcaaatttaactaaattttgctcaaaattttggaaatttcggaccaaaatttccgaaattttcaaaatttcgggatttcggccctaatacaaagtcctcaaacgacagagtgaaccactacggaccaaaaggaagtcgtacagtaaataaatcaaacggcgaagcaaagcccctcactcagaatataattactcgtcatcagaacagaaaagtaaaaaataaaaaataaacccagttaattaactacagtgaggcctcactccgattttaattattaatttactgcctgcattttcgactcgccgccgatcgagacgtccactgatcagctactagtagcatgtaggacgccgcgagaacagccactagcagcgccgccatggccgcgccggcggcgaggaggtcgtcgtcgccgcgaggtgggctcgcggcggcgcacatttggacgtaggacgccgccgccgccctcgtgagcgcgccgccccgccggcgcggaggaaccacggcgactgcagggcggcgagcatccgcggcacgacggtgatcgccgccgcggcgacgaccgccgcggcgcgtgacagcgccgccgccgccgtcgtggccgcggcggggaacagaagtaagtagacgacgggcgccggcggcgatcacgagggcggcggaggtggtggtgctgatcacgtcgcgattcttggctagcgacgacgaagctgccattaatttggagaagagaagcacacacacggggagagattagatcacaggaggtggaggagaattaggccggagaggaggcgattgaggaatggaagatcaaaatgtgcgatgatcgatcgatacgtttgctgcccctcggtgaggcacttaagtagcgatgacgatcaagctcaactcaacgtcagacgcatacctttcaaagttgcaactcataccaactccgtttatttaatatgtgatgtcattgagttttttataaatattttatcattcgattttatttaaaacttttatatagatataaagaatttaagttgggcttaaaaaacatttgacaataaattaagtcagaataaagcaaacgatacttacataaatttttaaaatagaataaatggttaacgtttaaaataatcaattgtgtcatacgttaaaaacgaaagtggtactccctccgtcccgtaatataagggattttgagtttttgcttgcaacgtttgaccactcattttattcaaaattttttaaaattattatttattttatttgtgacttactttattatttatagtactttaaacacaactttttgttttttatatttgaaaaaaaatttgaataagacgagtggtcaaacgttacaaataaaaactcaaaatcgttatattatattgtaggcaggagggagtaacagctaacgaagacgctcggaaaatatgcttatcattgtattcatcaagtgtcatttatatattatatatatattctagcttcgatcgaccctttgctaattgctatcgacgactagattactcttctggtccatgcttatctttcaaagtaaacaccattaccgtcagatctaacatttttaagctgatagatgcaatgctactgctccgtgtgttaacgtggggggtccaagttcagctatattataaaattttaattcagtcacgttgttgacctgggtcaagttaacgtttagtactttagtagtgtcgttggttgcaattctatcgtgcgtagagtggtgcgcgggtatatacgtgccggatggatcgccgaaactgcccagcaacggccaaagcttgag

SEQ ID NO: 5168 - DNA, 332 bp, Oryza sativa
gggaacaaatccctgcagatcattcaaaagataagggtaagttcacttgtctgaactactgtacttcagattctcttataactgaatcctttttagaggttcaccgagtgaatccattgtgttttttttttgtagcctttgtggtgggtattgaggaggtgaatgaatctgatagttcaccacgaacatatgaacaatccacaaagaacaatggcgcttctggaaatgctgggactgcaaagctagcacccagtggatctactgtgcctatgcgcgttttcgtcgatcgcaacagcagcgtaaagaacggtttcataagtagggccaatctt

SEQ ID NO: 5169 - DNA, 568 bp, Oryza sativa
gtggttgcatttttaccaatttttttgcggtgaaaacggtcgatcgccatgggaatttggccctcacgaaggtcatatcactggccgactttgggtcatggaccgtgatggaccaacacttttaggctgggcaattatccaaatacctaatttaaagttttttttctcctctaagatggtggttttcttaactatttgtcacttttatctatgtggcatgccaacatgacaagcaaggatagaaaataatgtgggacccagtagttagcctcacatccctttcatttcccctccagcccatagatggagacggtgagcaccttggcgccggggttgtggtcctggcgtatcacgttttcacggtgtctccaagctaataacacttttttgagtgtcatgtagcaaattttaccaattcacttagacgcatgttatttacacgtgtgtttagttccttgagtgtaaagtttttcaagtatatacacgcacatttgaagtattaaacgtacactaataataaatcaaattacagattccgcctgtaacctgcgagacgcatttataaagc

SEQ ID NO: 5170 - DNA, 416 bp, Oryza sativa
ggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatg

SEQ ID NO: 5171 - DNA, 755 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctattt

SEQ ID NO: 5172 - DNA, 3722 bp, Oryza sativa
gcaaaaatttactatgtgaaagttgctttaaaaattcatattaatctatttttttaaaaaaattagctaaatacttaattaattatacgctaatgagtcgctctattttacatgcaatacagattagttcccatcagtagcaacgaacgcagaaggggacggccattcgctgccagtgtaagataactataattttgtgttaacgaaaaataccagcgaagatagaaaaccccggtaattttgattgtttgggagatgcatggattaccggtgaaaatatgtattttccaaaaaaaaacagagagagagatcatgatagctacctagcaggaaaagagaactcaaaattgatcaatttgtcaaagcgtcagaaataataatcaaaatagatcaacaagtggaagggcgaacgaacaccagtagacgccgtggaagtgggaagagtggagtgctcattgatcggccttgttggctgaggactcctgggtgtgggctcaatgggagtttctccctcggttttaattttttttaataagacgtatggtcaaacgttgtgcgaaaagttaaaatggaggggtactatttttctacgcctaatgggccttctccaatagatttttatctaaaaactggctcatccaagcacatattgtgttggttcatcttgaaatattacatggtggtatttttcacctgttttgtgcaaaatattgagctttagtgcagaccctaaagttttttttttcttaaaaaagtatcatgcaggttccaagtcggtagacagttagattaatttttatttagataaagcccatgtttgactcttagcctctaaactagagtataatgcgcgttgggatagtatttctgataaaccttttttgtccccctaaagcacaagagaattgcgcttcatttcttttagaagagaagaagaataaagaggggaaaatgatcccaccctaagagcatctccaacagatgtacaaaattaaaaccccacatatcctatattggggacagaaaaaaaaatatttgacccaaaatacactcctttaaaagatgcctaaaatattggttcccaaaattttaaaatttaccacatcatcattagtgggccttctcaactaattttctaggcgctcgctaaaatcgcgcgcgagcgcgtggtggaggagatcgcaatgcgcgtggaggactggacctggtcgatcgtgatcctagtcgcgcgggagatcacgtgtgagcaagtataaaccagggaacgacggcgagtgagagatactcaaagcaggcaacggcagtgagctgcaaggattggtgacagtcacaagcacttgtgcgtttaaaccattctagcacaggttgcaaaattttgctaacaattctttgttatatttcctttttctcacgtttctgatctgacaatgtatttatggaaaaatcttgatttgatatgatgaataaatatttagaaaaacgaaatttctagctgatcattctacatgacagtgtcattaatctgcaggttagaattataggcaaccctcatgttaggattttcttctatcaatcatgtcttttttatatatattttgatctgacaatgtcgctaggtgaaaacttatttagttgtgatgattaatggttggccagttgatttgatccgtgatgagtcgtcctcgctcctcagatcaacggcttgtggatgaatcatccgacatgatgattttttttggggggcgcaacacaaaacctgcatagctattggcactttgacaatgcaccaaaacatggtgggtctgtgatgggacatgaagtggttgatcacaacagagaagcacgtcacttgagattataccaatactatttttctgataatcctacctatggcccagttttattcagacgcaggtttgtattaagcctattttatttgatcgacctttattatatgaatagccaaccatttatgtctgcgcaggaatagaatgagcagacataaataatgaggcataagtaatggagaaaaaaacagagacatgctcattctattcctgcgcagacataaataataaggcatacgtatctattcatataataaagatagatcaaattaaattggcttaatacaaacctgtgcctgaataaaactgggctataggtaggattatcagaaaaatggtcttggtataatctcaattgacgtgcttcttcttttgcgatcaaccacttcatgtcccatcatagacacacagtgttttggtgcatcatcaaagtgtcaatagcgatgcaggatttgtgttgcgccccaaaagaaaatcatcatcgtcggacgatgattcatccacaagccgttgatacgaggagcgaggacgactcatcacggatcaaatcaactggccaaccattaaacatcacaactaaataagttctcacctagcgatattgtcagatcaaaatataaaaaaaaaacgtgattgatagaagaaaatcctaacatgatggtcgtctataattttaacctgcagattgatgacactgccatgtagaggatcagctagacttttcgtttttttccaaatatttattcatcatatcaaattaagtttttttccataaaaacattgtcagatcagaaacataaaaaaatgaaatacaacaaagcattgttagcaaaattttgctacctgtgctagaatggttcaaacgcacaagggcttgtgcctgtcaccaatccttgctgctcgctgccgttgcctgcttgactatctcactcgctgttgctgactggttaatttgtacttgctaactcgtgatctcccgcgcgactaggatcacgatcgaccaagtagtccaggtccagtcctccgtgcgcattgcgatcgccccctccgcgctcgcaggcaattttaacgagcgggtagaaaattagttgaaaaggcccactaatgatgatgtggcaaattttaaaattttgagaaccaatattttaggcatctcttggagaaggattgtattttgggccttttttattttgggctgtccccaaaataggatttttatgtttctaattttatatatctgttggagatgctctaagaggcagaaaataaattccatgttaaaaagtctaacgaccatacagaaccaaatggacgaactaagcatcttgggcgactgaccggacaagaaagaccaacacagttatttctggtaaacattgtacgctcccggtgcatacaactcgaatggaggtgatatgggcatacaacccaacacagttatagagaaaaccaaaaatcccagattccatcagcccaaccaggtcgatcggcccaggaagagctcaacgcgtacggcggcctgtgactccgtcaccctgtagtatatccgagaactatggcctgttaaactttgctctaggatcacctaggttagatctaggtcaggtggttctatttgggttgatgtttgaacaatagagattgaaaagggagagggtttagatagaccgaccggttgaggtgttggaggatgaagaagcgtcggccatcgtcgtcgtcgtcgcgtggttgtcgcggatgcggcgccggtgaggttgacggcgatgatggctgcggtagtggcggtcgtagatgtcccggcgatgaggcgtggcgcggcggtggcgtttcccgtcactggctgcgccccctctcgatcagttagggtttgtgggg

SEQ ID NO: 5173 - DNA, 5893 bp, Oryza sativa
tatggcgctcagtgtgacgggggcccaccagctattggactggccgcccccgaacaggggcggtcaaggtccgttgtgccgttgggcccgacggatgggagatctatctaacattctcccccttgatctcactatttcttttagctttttctattccatcacagatttgtaaatagagcatgtttcatcgtcacggtcaatcaccgatggattcgacagccactatacatatctctattcagaaacagatacttttacttttgggccctgtagtccaggattcataaggcttcccttaaacccatgccagctacatgttccttgaacatgttgggtggtaggcctttcgtgagcggatccgcgagcatcctttctgttctaatgtgctcgagactgattgtttgatcccagactttgtccttcacaacatagtactttatgtcaatgtgtttggcagcaccacttgactgattgttgtgagcatacattaccgcgggtttgttatcgcagtataactttagtggtttcttaatactgtcaaccacctttaaaccgggtatgaacttctttagccagttcacctgccccgttgcctcatttgcctcatagcatgctataaactcggcatacatagtagaccctgcagtgatagtctgttttgagcttttctatgaaatagctcctcctgccaaggtaaacacgtatcccgatgttgactttgtattatcttttcaaagtcaaaatctgaataccccactatctggagtgattctgatcttctgtaagacagcatgaggccttttgttccttgcaaataacgcaagactttctttaccaatttccagtgctctgggcctggattactctgaaatctgccaagtaaccaggtaacaaatgccaagtcagatcgtgtgcacactttcgcgtactgtaggcttcctatagctgacgcatatggctttgttttcacttcattgagctcatactaatttctgggacattgcgatgccccatacttttcgcctttcactataggagcaggtgtcgcatcgcatctgtacttgttgaatttcttcaacaccttttctatatatgccttttgagaaagtcctaatgcatactttgttctatctcggtgaatctctatgcccaaaacatatgaagcctcaccgaggtctttcatgttaaagtttgagaacaagaatttctttgtttcctgcagtagactgacaccactactagccagtagaatgtcatccacatacagaattagaaaaatgaatctcccattcttaaactttgaataaatacagttgtcctcgacattctcttgaaaccaaaatttctttattgtcccgtcaaacttcaaatgccactgtctcaaagcttactttaatccataaatggatctctttagacggcatcccatattttcgtttcctttcatgacaaaacctttcggttgcgccatgcatactttttcctccaaatctccatttataaatgccgtttttacatctatctgatgtaattccaaatcataatgtgccaccagtgccattataatcctgaaggaatctttacaagagacgggagaaaatgtctcattgtaatcaatcccttctcgttgcgtgaagccttttgccacaagtcacgctttaaacttttctatattccctctggagtcatatttggttttgtagacccatttacagcctactgttttggctcctttaggaatttcttctaaatcccaaacatcgtttagtttcattgatttcatttcatctttcatggcttccaaccatttagatgagcgagcgcttctcatggcctcttcatatgaggtgggatcatcctccacatgcgactcttctatattataaacattatagtcatcacggatagccgatcttctgactctttcagaccttctaggggcctccacatttggcacatcctgtacctgaggctcttgttgagtctcctgtactagcacattatctgtttgaggctgttgcagttcctcctatggtgtggcaactatttctgttgaatcatgtataacaggttcctcattttcattcattgttgctataggagaggtaacaacaggtgctggtaccgcaatgacaggcattgtaggcacaacatcagcaggtagagagaagaaaggttcctgagtcgacggagcgggtatagacacccgcctctcctcaagatcaatttctcgaactaccgagctccccctaatcatttcgtcttccaagaagatggcatgtctcatttctacaaactttgtataactgtttggacagtagaaacgatagccctttgatattccaggatagccaataaaatggcagctgactgttttgggatccaacttcccaatgtttgggttaaatactttagcctctacaggactcccccacacacggaggtgagctagcgagggtactcttcctgtccatagctcatatggtgttttgggcaccgatttgcttggaactctgttgagaatatgaatggcggtttttaacgcctccatccataaacccagtggtagtgtggagtagctcatcatgctgtgcaccatatccataagggtacggttacgcctttcagctaccccattctattgaggttcgcccggtgttgagtactgctactattccattctctagcaagaaccttgcaaaaggtccagggacttgcccataaggcatatgtcgaccatagtactcccccccatggtcagatcttaccactttaatctttataacatgctgattttcaacttcaactttgaatatcttaaatttatccaatgcttctgatcgctctttaattggataaatataaccatagcgggagtaatcatctgtgaatgttacgaacgagtcatagccatccacacttttcacaagaaatggaccacaaatatctgtatgaatgatctctaaaattcctgcgcttcgttttgcaccctttttgatgctctttacaaattttcctttaatgcattctatgcattgttctaagtctgagaactccaatggacgaagaatttcattcttaacgagtctctcaattctccccctcgaaatatggcccaaacgtcagtgccataatttcgatgagacatcgggagttcgctttcttttcatgttttcttttgtcaacgaggacacaacattcacattctcagaaagagataacacataaagctcgtctcgcaacacagcaagaccaatacatgcattattataccatagttcacatttgccacttccaaagcggcaatcatatccatcaaaatctaactttgatacacttattaagtttctttgcaaagaaggaacataaaagacatttcgaagtaaaagtgtgaagccattcgcgagctctagaggaagatctccaacagcttcaactttttcttcaactccattggcaactctaatggagctttcacttctttgcatagtcctcgtcgaacggaatgcctttaaacaattacaagcatgaatagttgctccagaatcaatccaccatgtagatctagagtaaccaacataatgagattcatttacaaatgtaataatgttctcatctttccttgccatgatcattttcaagaagtcaggacagtctttcttataatgtcctatcttcttgcagtggagacactgatctttctcaacagcgaactgttgttgctgaggtagatgctgagactgtttagcttttgaggtgggagacttgtggttctttttcttgttatctttaacatagttaattgaaccaccatttgactctttgattctctcctcctcttgcacataattagcgatgagcttttcaaagttccatttctctagacttatgttgtagttgataataaaattgtcaaactgctttggcaatgaggccataaccagatggaccagaaagtcatctgttatgcccaaatccattggcttcaacttggaagccatgttgctcatcctaagaatgtggtctctaacaccacctccatggtacctctctgtcacaagctgcttgatcagctgtgtagcataagtctttgaaaagccagtgaactgactttttattctttcaaggtactctgagacagcgtcacactctggaattgagcctaatattgtgggctcaatcgtgttctttaccacagccaaacatttcttgttggctaaggaccatttcttttgttcaatgtcatacgacatgacgagaggagcattgtccctctgactcttttgccagtcagcatctgactcattttcacctttgataagttcaacaggttctacaggacatggggtagtcaacacccagtccacctctcccatgataaaagcaaggtcgagttttcttttccattctgcgtagttatctccttgtagggtcggaatatctttaatgcaacccatcaaggagtagccacctgaaataatcatgtatggtgagaacaaaattaacattaaaatattacgcattaagcctacatcaccgttgggcagaattagacataacacatataaccataactataacattgcaattatcaacgttggtcagaaaattacaacatcatagcacataattaatgttcctaaaattaaattctcccgttggttcgaaatttaattttagaaacactaattttcatcaatttcatctatttgtagcagaagatctatataaaaatcatatgaacagtagcaaaactctataatttactctctgtgaaaattctcccgttggttcaaatttaaacagaggtaaaacatgcaaataaaactattcaaactctattgaaatttgcatgaaaattgacaaaatttaaaaagaaaaatgctaccgttctcttttctacatttttggcccccgagggacctcaaacggacttttctcggtcggcccacggccttttggcgtgcgcgggcgctcccccttttcccccaggccgcaacatgggcctgggccaggaaaccgccgcgcgcgcgcccctcttgggccgctttcagcccggccgccgtcggccgtccgatcggctaaggtttagatccaacggccgggcgccgagatcagagggacaaaaccccgacctcagcctccggccggccgaaccctagcctctcttctcttctctctcgcgtgaccgcatggagcggcgtcgccgtcgccggcgaccttcgcgccggcgcgccatggccggcgtgcttttctcttctcttctccccccaccgtctctcgccctccacccacgtgaagtgagagagagaacagcgacgatggaggtggcggcgccgccgcgggatctctcaccggcacgcgcgtgcacccgcgggtgcgcgcacggccgtcgagtggctcttcggcggtgcctctttgcccctcccccctctgttgccggcgtcaacgacggccggcgacgaggtaagattagggttagggttttcggttcttttgatccgtgcagatcttgtgcttttctttcttttgatttctttccccgaaccgatctaatcactaggaacgctctgataccaatgttaaactttgctctaggatcacctaggttagatctaggtcgggtggttctatttgggtagatgtttgaacaatagagattgaaaagggagagggtttagatagaccgaccggttgaggtgttggaggatgaagaagcgtcggccatcgtcgtcatcgtcgcgcggttgtcgcggatgcggcgccggtgaggtcatcggcgatgacgactgcggcagtggcggtcgtagatgtcccggcgatgaggcgtgacgtggcggtggcgttttccgtcactggctgcgccccctctcgatcggttagggtttgtggg

SEQ ID NO: 5174 - DNA, 5284 bp, Oryza sativa
cgccccggcctccacccctttcatatggcgcagtgtgatgggggcccaccagccattgggcttggcgcccccgaccacggcgcggtcaaggtccgttgtgccgttgggcccgacggatgggagatctatctaacatggccaccacggtcgccagcgcaacacctcagtcacctgccactcagccggtcggctacctcaacgccggtcacaagtggccgggcttctcatcagcagtcagctccttcctcggcttcttcaatttcaggttcaaatataggacccccgtttgatcgatcgggctccaacttctaaatttaactctaagagttgattccggaatagagtcatggagctgtctaacttcacgtctagttcatttttaaagagcacatcactcaatttcactctcattttggatggagtttaaaccgtttggttgggattccgtctaagaggaaatagagctgacgctgtgccaaacgggccttcaaaaaccactttgtgcgttgtccgtacttcaaaagggctctagttgactagttcagccctagtactcttaggggtagatgtgtacgtagtgtgcttcttgaaaaatggctcagttctttatggcctacgttgccagtaatgaatatcagaaaaatcactggacaaatccgtgcatgtgtcagttatacttgtttcgttgtaagtaatataatgctatttttatccggtctcaaacactagtaccacttgttattttcagagagaggcttgatggagatcattagttagtttagcagcaactggtacccacaagtcagcaactcgatcagcgacggccaacaagaaatcaagtcaactcatactttttttttcctcgaatacacaggaatcaacttacatttcatactttagcactccgtaaaacgttgttatatttaactccgggagggaaaatatctcgtgtggtaatatattcttcaggttgttttcagctggtgctgctcggtgtgacactgtcctatctgaagattaaattttgtgttttgaaatttaagctgcacaagtggtagggcagtttcactgtcaactcaggttactgatctgcaattaacttgtatatgtgctgtctgggtttgatttggccctgatgttggggatcaggtaatctactagaaagtagacgcgtccgtgggcgcgcgtgctattataatctgtcttatttaatgatttttttttcgggcttacgaaaaaatctaatataaattgcttcctgctgataaatggatgaagataatattagcaagaattactttagatattaagtgttcaatggaaaagaatgcgagcaggttgatattggtattatggaaaaggtcgtcaccgcaattctaccacacccatctacacagcatggtccttcataaatttaatctatcttttttgcatcataaatttaatttatttcctagattttcattaataaacttgcaaaagcctaaattattgagtacttaacacgggtgatatagagagaattagatgttatatgtcattaatatgtgcgtgtgtacatccatagggtcacacattgctatacgatatttatctaaaaaatatatgcttttgattttattttctcacgttggttaattgatttgtacagttttttcgaaggtttgtttctccatgttattcagaattgtaataattcttcttttttttcatcacggtaaagctagctacatatagttttttttaggttattcctaaatgatctacatatttgtgttcatttatttattcgttatttgggcattagagtaaatggacattgatgcatgcatccatgcacacaagtatttataacccatatgcaatatcttgatttgctattggctagaaaatattggggatggtgcatgcattaaatttattgctatagtaaatataatatgagagagttattattttttttcttggtgtagctattaatttggaatggagggagtaactggttagtttggtgggctgcatcgcgtgaggccttggcccaggtgtgcttgtacgtgcgcgtgattgatttatcgcttaatccagaacagccgcgtcactgccatgtacatgacgaaaaagaaacgcaacaatccagtagtagttatttcaccgtttttcatccacgtgtcgctagttagttggcgatcaatcgaccaatcagctgacgcgaacgcagccagcattaccgagatttagatactctcgtgcgcgggagtatcctcgaaccatgccgcgccacgtggcgttggtgttcggccgggaacgcgcatggaattcggtattagagatatcaaaccttccttctaatggaattgcattcaactctctgcatgttctgaagagacaaaatgtatcactagtggcagtttaatagtacatgcagactactgactacggattttgatctctctgtctaaacctctgctttgctttgctttgcttctctgatgcttgattgaacacaaccatgcacagcaagctaaaactgaagtgccaagagataatccattgtaagccaaacaagttgataagaaactgtagtttctttgaagcatagacctgaatacttccattatattaaaaaaatgttgatacgaaatcctttgaatgagacatagcagaggagtacgatcttgatttggcaccggtcatgcaaccttcactgaaacagtttttgcataatttctgtcccattataaatatgtcattttcgtcctaatttggattgtcttagccttatcctgatacggtatcaatatgtcttagcgatacaaaattttactagcgttcttccttgtactatatgtagaacatctttgtggtccagcaaagagtaccggccggtactggtaccgctcggtaccagtacacatctggccgttcattcctgtatgggtaggatggggaatagaaattcgctcggcgctcgctcggtccttctccttccacagccgcgcctgcgccctcaatccatcgtccccacgcgctttcttccgcccccacacactttcctccgcagcccaacgccggaaattgattaatgttcgaattgctatggagagatttctttagtaaaattgatttctccttctccgccggtgcccaacgccgcccaaccctaaccccccatatcatcgtctgcgtcgtccttcgtcgctcctcggcgcaagggttcaactcgaactcgcggcgcaggagcatgtacacggcgacagcagcgcagaggataacggcggcggtggcggcagagcaacatgggagtgaaaggcaaggagagcaaatactagggttcgagcgagctgccagccccgatccatccctcctgatccatccagcagcaacgcgaagttacaataatacccttccaaccaatttgtctaggcggtaccgcatcagggacattcttggtaccgggcgttaccaaacaatcccagccgttggatcaggccagatccaatggccaacattcagtaccgccttggtaccgcccggtaccgttggacggtaaaaaatctcctatatgtaagatactttttgtgaagaaaaaagagacatacaatgtgaattttctttgcctgtacatggacattttgattttttttttcataatgtatatatatttacaaactattacgatgcaaacaggtcggcaatgccaccaagtaaccgctgtaaattataactttttttttcactggaacgcttgtctgctgtcccctactgaaactgaaagtgatctccctaattcaaaattgcagatattttcctgcaaaagatcagcgcatatcaacagcttgatatcaatcacccaccctcataaaaacaattcaacccctccaaatctgcatctcgatcatgctgacattaataaataaaccagcaactagagtgcatgcaatgtcgaacattgcttattacagttagcacgtagtactatatagtacacgtcgcgtcatcgtcgatcatggcacatataaaacttgacacaagatggtgatagccaatttcttgaagtcagtttagttatctgtattgaaaaaaaacatatattgcaagtggtttattccaaggtcgttggtgcttatccatgttgcatactaaaatatcttgatcacgcaagctaaacctactttggcatcagctatatagtttgagctttgaagctcagggatatgtaattgttgcaaacaatgcgacaatatgaacgagtctttcaagcttaatttccaaaatagaattttctgaaaatacaacccgcagtcgtataattgtcattgttgtctgaaattactctagtgctgtgagcacagagttttaagaaaaaaacgtattggatgtcatattcatatgaaatctgtatgatgttcgtttcgaaaaagaaatatgtactatgtctcaccaaattggaatttgttgacaaagatgattccacagtgttgttgactttgtttctgcatgaagcacgagaaccgtaaaataatactatttggatgggaatttcaactgctggatggtggaagtaatatgtacaatgtcctatataagtgattttgacatgactaacgttaattaattgtgtcctttaatattaagaggaagcaaatagatttttaaaataatgggtccaccaatttaaatgaaaatcaatggtgagattataaaatgccacgtggcgatctaggagcgtttgtaggagcgccacatggcggtttaggagcgtttataagaagattaatggacttttagtatataactaggaaggtagccagcacattcacgtgggcatgtattgtacagaggattaaacttttcggtttagccaatttgatcgggtatctccaaaattttcgaaattttggtccgaaattttggacaaaatttagttgaatttgaacaaatattaccaaaattcatgaaaaaaaaatttcggcagaaataatatcgtatcggaggggtctgaaatgaccgaattttccgaccatgattgtacattgcgtttgaaatatatatataaacaaaatataaatcggctgacacctcccatgtttaaaagtacttttgttatttgaatacgacacatcaggtgaagcctacgctgttcttcggcattttgctttgataatttttccaagatgtttgttaggttttaaaaatatatcatatttaatacatctgtataaataattatctatgatctctttattaatatagaagagaagttcgatttagtttggtttggaaa

SEQ ID NO: 5175 - DNA, 23703 bp, Oryza sativa
atatcatatgcctcgcttccttatgatgtgtgtgatctatactatctttttcaaaagaatatacctagttaacatgaatccaaaattttaaatttaatagtaacaaatataacttttcaaagaactatatactacgaaccatagtgcggtttatatatgtaataatatatggagaaactcataataatatgatataggatagatgtaaggccattaatgtctaagcattttaaaattgttatgaaaatggaacatgcaatggttggttcaattttagtgaaatgtaaaaaccctttttttttacgaacttattgcattttttattacctgctttattttatattttataccagatcaaaatataggctttttggatctttaaatcattgttttaattataaatatatacaacaatatttagattagaatgcatatcttgaaatttatgcatgttttgatattttttattacttttggctatataaacaggaaggggtagagtggggagctcaagccgagaaggtatgggttgagtagtgccgtgttgtgtgtatgtttgggaggagggcaaactggagggctgttttttttctattttatctaaatgatttaagtaaaaccgatgatttatttttttctcaatttttttgttatttttttaatttttaagacgtaacacattgcggcataagattttctaaaaagtatatctactggttgaaaataatggatctacctatttaagttgaaactgatggtcagatgatatttcttccaatttgtaaagttttatttttatttaaggcgtaacacgtgacgccttaagtgcgctcagaggatgtacaatgatttatgataatataatacttattttcatttagtattatggtatgtcttttttctatttggttaccatgcaaaggaacggtgtctaataaatcacgtattttcatttttatagagtgaaatatgggtaacatggataaattatctatttaattataaataaaggaaaaattcaaataaactaacattatgatttaacttaagaattataatcatttggctttctagttattgatcttttttacttagttaaaaattaggagacaaagaaattaaatgagtgaggagaggaagagagagttaaagggaagagatcgtgcgtgcatataattgtaataattatttttaccgggttgtagtgttttagttgcaattacttttttaactaaaaattgaaaaacaatttattgattgattaaaatctttccttttttacttgtcttctctagtatattcacagtagatattaaaaataggaactataatctaataatgttattttggcttattctaatgttataatgggggagtagctttttaaagcattcctcagagttaggttcattttacttttatccatatagatctaatttaattattccaaagtcagatatggtgacaaaatatgtaccattatctttctataattttataattgttcaaatggcacataaaaatcagaaaattatagccccaaagtgacatatttcttctcaaagttgatattacagtggatatgtaaaataataatgtcaaaatgtaaaataagttcatgagttcatgaaatattagttgtgtgagttagatgttatagttgcttattttttgcacaagttttgctttctaactaacatattttggaaacattactcatagtatattcattttacttttatgattgtagacctaatttaattattatgaagttatatatgatgataaaatctatattattataattattttatatgtttttataattgcttgaatggcacgcaaaagttagaaaatctaaaccaaaatggcattttttaaaagctaaattgtagtgaaatatggtcttcaactgtaaatttagttataaacaatctaaagatttacgcggatcagaaattagttgtatgatttagaagcttaattgtttaacacaaaattattgcttatctaactaataagccatgaaataggagaaggaataggtgaaaagtgaagaaatgaattgaaggaagaggaggcgtacatacatacgtttgtttttgtaaaaaaaaaagaaacttatacatacaggcttaggtgggcccgggtttaggagaggaattttttcttgaaaattaatctaatggttgtaaataattgttccaccaaatttaatgaaaatatgttttgttattttagaatttttaagaatttcactaatttattggagcatcacatggcaacttaggagcgtttgtaggatgtcatatggcgaattaggagcatttttgggaaatttaatggacttttagacatctaatctgatgttctaaaacattaatcaggtccaccaatttaaatgaaaatagacggtgatatttatataaatttatagagtaatatgttttatcattaaataatagtaaatcctattttaaatatcatcatttttttcttattgattttatggtaattccgtgcgtcgttttttccgacgcgaacagtagataagcttcattggtttcttcagttgtacatacgtaagtttttcccatatacataaatacgtaatatttaggacgattttttttaagattttgacctttctcttaaaagttttatttacgactttattttttaagatggttgtatatatttgtgttgtaaagaccttcagaacaaataaactctagactcaaaccagtcaaaaccatggaatcaagtagatatatgaattaaaaattatagcaattaatttgaacttatctaacttttgattccttttatctgaaattgattgcttaaaaataggaatagagaataggagaggagggtatggggtggacggacgtacgtacgtaggtaggtacgtatataggaggtggtggggtaagggtggggtgggatttaaatttaatataatagtctaaaatctcgggtccatcaatttaagtgaaaatggccggttagatttgatagagccacgtggcggcctaggagtatttgtaggagcaccacgtgacggcttaagagcgtttgtaggaagtttaatgaacttttagtatataatagatagatagatagatagatagatagatagatagatagatagatagatagatattgccatcttgccaaaattttggcatagccaaaacttgttaaggtttattttggctataatttaaacaagcccgaaatcaacaaatagacaaaaaatggaaaaagaaagaaaaaaacagagatctaggcaacaaggaactgaaacgtgtaaaagaaaacaattactccgttgcaatcttgatgcgtgtcccttggttgattacatcaggcatagctagatgtgtgattttacaagggtatcgattattccagcagcctcagaaagagaagcaagaaaaaaaacactaagaccccggaattatgcacgaattttggacaattcaactatactcgtgctgtcttgcataacacgcctgcattattagaacggacgtgtgcagtagagtggccactagatcgcacttttaattattttgttcctcaactgaaggggctccatcttgatctgagatcatgctcaattggtgtgtttttcttacactagcatattgcctgtgcgttgtgacaggattttaatcgatgaaaatgattattaatctgctattatcattattttctgtatacatcgtctcttaaattctactccattcgtttcagattataagactttatagtattgcccatattcatatagatgttaatgaatctagacacaagtcttatatataagacagagaaagtacatatttataattagcatatgagtcatatagcctctcacggatatcattttccttgccacaaaatatagagatggtgatggtgcggttgacatgtggaccatttggccccatatgtcctttgttcactccaataaggcagggagtttgtggtggttgtggtagattcatcattcatcaccaccactattccttttttaaactagtatagataccactatgtcaacttgccagattaggattgtactaatgtttcaacctacaatgcgacttgcccaatttcttttggatctttgaaaatgaagtgaaaccatcttcaattcaaatccatgaaaaataaggaaaacaaaaaaattgaattcagttttgtctttttgaatcaacacagagtgatcaaacccaaacagtataaataaaaggctgaaatagaatattctgtatttcaacgtgaccgtacaggttaaacgatggttttcatacgttaagtcatatctgaaaacaaatcaacacacacgataaaatgaaaactagacaaatagagatccatgtaacaaggatttgaaatatctctttaaaaaagaattgctctattgcatcatggttgtgtcccttttgatacatctggcatagttacatgtgtgattttacattggcagcaattattcaagcactctcagaagagcagcaaataataatcctgaatctacttacagagaagaggatacctgaaaaaaaaaagaaaaaaaactcaaagcctcataaaagctgtatatgcaggtgactctgatatttggcttcaagacaataaagatggattaactctcaaaaatggttcctctcaatgtgttttcctcttgcttgcaaggtgtggaaatgcaccgaggatgttgtgtgctatcaggtcctgccttgtcaagatccccacaattggagatatctgaaattaaaaaaaaaaacataagtttcatcaccgaactatgcacaaattgagttcaacaaatgatcactaacccgtattctacaaagcaaagcaaaattctagaaatgataagacactgataagacactaaatccccagttctgtaacaaaagaccaggacagaacacagattctgcacatatctgatttatcaagcacatacagaatccagagattattgtgatcttagaacaacatttacttgcattgtgatccaggaatgtagttggaaaataataagtaaattaataaacaaatacttactccgtttcaggttataaaacgctttgactttaatcaaagttaaactgtttcaagtttgactaaattcatagacaaatatgataatatttataatactaaataagtttcatcaaaccaataattgaatatatatttataataaatttgtcttggttgaaaatgttattattattttttctataaactttaatcaaacttaaaacagtttgacttggatcgtcttgtaaccagggagtaaaattcagtctgtgttttggcgctgacctcgggtccttggaacttgggcatgatgagcatgtggcggagcgcgacggagcggaacagcacgacggccttcgccaccgacatggtctccaccacggtgtacggcgtcgtgttcgtcagcgggtggaggtccacgtacatccccatctcctccggcgagatctccagctcgtccacgccgccgcacttgtccgcgagctccgccgagctgaacatctcgcgggcctcccactcctccgtcctcctcctctccggcaggaaccaccgcttcctcagcgcggcgacgaggtgcgaccggagcaccagcccgtgcagctccgataccccgggccgcggccggtccagcaccgggaacccgttgtgccgcgtcgcccggagcgcctccaccaccgtggacacgcgctccaccacctggagcgccacggcgcggggcttggcggcggcgagctcgccgacggtgaggtccttcatccacggctccggcttcgcctccaggaacgggaggcccttgaggtcgaggatgatctcgtagatgctggggttgaacgcgtcgccgacggtcttggcgatgaggaggacgaacatggtgattgggaggaggaggaggttgttggtgagctcgaggaagatgacgacgagcgacacggtcatccgcatggaccccgacatgagcgccgccgcgccgagcacggcgtataggccgtggtcgatgcgggcgaaccgcgacagcacgagcgccgtgacgcggccgtaggcggagcccatgaggatgatggggaggaagagccccgaggggacggcgatgccgaaggtgaagaggcccaggacgcagtagacggcgaagaagatgagcagcgagtcgagcctgaactcgccggcggtgcccgtggagaagatgttccgcgtcgcgtcgacgttggtggcgtggaggagggtggcgaggtcgttgtagtggccctcggggcagttgaaccgcttgaagttgccgctcttccccagcgtcgggcacgcgccgccgaacgccgggtcgcacggcgtgcacggcacggcgaacggcgtcacgtacagcagcgccgacgtgagcgcgcacacggcgagcgccagggcgagcttcgcggcgcggcccttctcgttgatgaggttgtacacgcggagcaccttgtggaggacgtggttgtacagcgcgccgaggacgccgccaagcacgccgacgatggtcaccgggaggaggtcgccggcgtggtaccggacggcgacgtcgccgacgtcgaacaggatgagcccgccctcgccgaacagaccgcaccgcccgttcctgcacacctcgatgaacccgcggaggacgacgacgacggtggccgtgctgaagaaggtgcgccacagcagcgcgctccgccaccacgtcgccacctcctccagcgcgaacagcacgccgccgacgggcgcccggaacgccgcgcacacgcccgacgacgcgccgcaggtgatcaggtcgcgccggtcgcggtcgttgtcgaagtagcgcagccaccgcaaccggaggcgtgccggccggagccgccctggctcagcaagttcgccaggcacgcgccgatgtgcaccagtggcccttccttcccgagatccagccccgacgacaccgcgcagatgctaccgatgatctgcgatgatcatacatttttttctactcgtcagtgtgtgcgcgtctgccgtttaatcgaaaaaaaaatgttgttccgacacgttggagaagtgtgacattttttttttgtgaccttgacaatgagctgcggcgcgccgaacatgttgggcgtgtcgacgccgttgaggtaggccttgatctccgggatgccggggccggcggcggtcggggcgaagacgacgcagagcatggcggcgatgaacgtcaggccgaagttgacgccggcgaaatacaagaaaccggcccagtatctgcagtagggtgacggcaaatttttcaccatcaagaactcgtcgccggcgatgaggaagaagaaggaggagttgtgggcttaacttttcttgcggacgagctgcaccatgtggagcatcttgaggccggagatgttctcgatggcgaggttgatgagcgacgcgatgacgccggtgaggaggccgacgaggaacgccatggcccacttgaggaagatgtactgcagcacctccacgttcgatcgcctcctccagtcgtgcttgaacagatcattctcgataattctaccaaattcacacatcacaaattgaaaaaaaatgcaagaacagattaattaaaccaaccgatcgagaatcaacaaatcaagaatccaagaattgatggactcgtgatcgagcacggtgaattagacatggaggaggaggaggagaaaatgctcactcgtagtcgaggctctcgatgtgggagaccttggcgccaaccatggcgaggtggctggccgttagcgtgttgctccgcttcagaagcggctgctccagcgagctcatggccgcattgcccgtgcacccggggtcctcggcgtcggtgactccgtcctcgagcttgcgctccggctcgccggcggcgagcctcgggctctgctcctcctccatggacagagctctgcttcttggagcagctcagaaacaacaagatgagatatgtgtgtgtatgtgtgttgggacaattggagggaggggaccgtttcaatgctcttatctgtggttctgcaagcaatagtggtgaggtgtcctcatataggggaataaaatatttattttgggggtgtttttgcaaaaaaaaatattgttgttttgcctagttgatcatttcacatggatttgaaattttcatgtttgattgagtttatgttggcaatttggtgcaagatagggccattggattagtctgatgaagaacaaattctttgcattgagggggcaggggcatgccctttggggagctaggaagggtttctcttttgcataaagtgaagggtgaaatgtagacagctcacttgatgcccacttggtcttggactcttggtgacaattattatttttactatggacaaatgggatcttgtgaagtggattcagagaaccatctcaaaggatgccaacaacaaagcaacagtggttgtcagtatctatgctgggttgaactttccaaaggttttggctcagatatattcagggttgataaggttgccatttgattaattagcaggtccatcctgcaaatcatcaacaattggaatgttgtcttgctaaccattctatcattctttgccaaaaaaggaaaaagaaaaagagaagccattctatcatcagacaacacttgctcttctagatatgagatgcaaaaaattcagcttctgttcaactccattttgatttgtctaataaaatttctgtccctaatatagcgcgctatgagtctatcttgctatttcacgtcaaaataattttcagtccctaagaaaaccaggttacaaagtgtcaatggagttgatggagaactaaaaaatccggttgtgccaatgcaagagttgtggtaagatgacatgaccatgaaacagaagaaatgtgattattcttatttttcacaacagcgatgcttatagtcataggtacaagttaagaaagtccaacagagtacaataatttgtgggacctaaagatgaatttcttatgtttggagacttacatgtcaattcctctaaggtttaaacttaccattctttttgtacatagcatgatgtagtgcacttttgtcttcaaaacgtgtctaatacgcagtacctgaatcactaagtatgtctcagtaataatatgtttgcatgtgtctgacaagcatcagttaaatctttgtctaaaagtatcagttaaatactttatgctctgtctgccacacgtgcttatcaggcaaaaacactgtttatgattatgatttactacggtcactgtttggttgagatccttcgatgtttctccgtagttatggtgaaagctcaagaaggcaagcatatctattttaatcattactgtatatgtccatttaagttcagggattagatcgtattatctgttagatgtgaaaggatattaattgaatttaactggaaccactgtctcgtttattcaaataagaaaactctagtattgaatagctgattatgctgttgttacaataatagtaaaattttaagatatttatttatgactaatatataattctatatataaacctgtccttatgccttgtgatttgtgaggcagcagagaaatggttggtttatcgataatcaaaatgaccagaacaaataattctttttttataagagaagatcaaataattcaattagtgcatatgaagatgaaatgaccacatttcttgtgttcccgcaaacagctgctgaagagaaaatacttatccaacgcgaaaggacatatgcttaattcatctccattttttctgttcagaatatatatatatatatagatgcttagcaaaagttgatcaagtattagtcttctaaactttatgtttaattatacgcatgtttcatacggctgcctagatgtttctggagataataaagagaccacattgacattgccttgggctggcctagaggagtggcaataattcaattgaatacataaatgtttaatctttaaactgtttttttatgacgtcccagaaaaccctcacaagaaaagataatgttacaggtcatatttattttgtttatgtttaattgttagccacgtattactatctagttcttattcattgtgaattaattatcacacagaatatttcgtcagacaaaatcaaatatgcagaagaaaaagttataatttatttggcttcagtcctatcacaaatgtgttggacttgtcattaactatgaatatttttattcaaaacaaaaaatttgaaagcttcaaatattaatgatacttgtcaccgtttaggaacttcaataggcgattaacatatatagcccaacccgtctcttcggagaaatccgataaattagaacgccacaaggacacaagaaaatggtttggattaagctatatcctttttacaaatttttgttgactctcttaggttatgctctgagcaattcatactggcatcattgattcttttctaaatgtaaatcattctagaacgcataaaaacgctatattttttctcttccaccctgcttaccaaatggaaccgctccccttaataattaaactactattttttttttgctgtagtataactgaagggcaagaaagtaatttgatcaacattctttgtgcgcgacacaaattcaaggctgattattatatatgtaatttgggggagggggtacaattcggtccatattaccttgcagttcaattcctttcttcttttccttccttttcaagcttttatcacatgaatttatttgtccatctcatctcctttacattctcctgaaccatctggaaaaatgaatcatgctctgaagataagagcaaaatgaagcttaccaactagaaaagctaagaagtggttgaggtccacaaatctgcacactgctaccactgatagcagcacacatgcagaacaaacacagccgtaccaccgtctattttgttttcgcttttgctagttgctcttctgtctcttcagggctcccaaagggacatttggacacacatggataagagctcatcattatcaagatctagtactcatttgccctttacctgttcttttctgctttgtctaggcataagccaactcacatgaaaagttagccctttaggattaaaggaagatataaacattacattgaaacaaacatggatgcatgttgtatttgggaatcaatcagccactgatttggaacatcaaaagatacaaggcatgattggtgccaatttaaaacccaattttagaaaataattaagggctttttcgttgcttttgcttcttaggatttgccttttgtgtttgagagcaagagaaatgaaaagattgagaagatacacaaaactaattgagctattagcgcacaattaatcgagtattaattattttaaacttgaaaaataaactaatatgtgtcgacatttgatgttgcgattccgatatttgcatagtatggggatcgttggtactaggatatatgcgagattgaggtaaaagagacggagacgaggatttttatacaggttcgggcccttgaattgtcaggtaataaccctacatcctgttggccgaagccggtcgttgctcttattcaccataatcacactagtataatatttggggtagcctatctaactgttgtcgacatggcggccgtgaaaccatcccgtagtcgacaacagggtagtcttcctcctcgagttcgtgcccagcgagatcagagacagcgctagatccctacagccggcctctgtaggtaccggatagggttggaccgggcatatctctgatgtcgatattcggcggcttgtcttgacgtatgttggcttgtatgttgtggcttctgttgttccatgtcccctctcctcctagggggccttgtatttatacccataggtgtctccttgtccaagtagaactagggaaaccaatatggatacaatccgagtagtacttgtcgtttccatgtagaattctagtcatccttccttatgcggaactccttctatatccgaaggttgtttccgtataagacatgtatgtggtgggtcctgccgagatttagttaactacttattaggtacgtggtatccataaccctgacaatatgattttttttcaagcaatttttctatagatattttttaaaaagtaaaatattgtttagcagtttggaaagcgactattccttttttttttcctactatcgaacgcagagaagtataaaaacatttcccaaaagttagtttttatcaccagtaatttaacttcggtttacacttctgttcttcgtagctatagctcttccaccttttattggaggatttcccgtggcattggcaaaggtagagagtcgtaattcgaagtaaatgtgtgcaaacgtaactgaaaatttgaatgccacattcctgcatgcatatatattttcctatcttcttgtactattttatattcttgatcgagagttgtacacgtctccatccctataatattgctttcatttcactactacccccataggttagcagcagcattgggtcatccggccatcaaatttttgctgaatcgatcgatctctctgaccaggttcctttgtctgccatccctgattgccgagtagaataaataattcgtgtgactcggagaaatgggcgagggagcaagcaatgtccgtggaccatggaaatgccgatgcaagaaagggtttgtgtttagttcacaccaaaattgaaagtttggttgaaattaaaacgatgtgatagaaaagttggaagtttatgtgtgtaggaaaattttaatgtgatagaaaaattggaagtttgaagaattattttggaactaaagacgacgcaagtgacaggtagtcgaagtcgacgacggatcgatgcatgatttcggcaataaaaatagtaaaacggggtccaataatgcagcgtgtgaggcaggacaggtaggcagggaggctcacgatcccaggcttccaagtcacatggattgtgaccggtgattgggcagtcaggacacccaaaaacggccttctgttgtcccaagggccggttttatccacacctaaaagcggccccttggttgtttctccgttttgccactggttgtttgcttgtttgtcgtcaatgccaccggtttgaggaggttcagctagccttcaggctttcctcatagccaaaaatgtcaatttttcacggtgttaattacgtggaaatcatgtaaattcatgtgcattcttcagattcatttcatttatgctggattaaaaataaaatatatcaccaattataagtgatggagagaaatcgctcaatagcaaaataagacggttaaataactacaagggaaattagttctttgacgattaattttgatataaaaatgttttttcaccacaatgtagtaattgtggccaattctgaagttgccactagtcgccactgataatcgagccacaaataatatagcgatgattttttgttcgccacatatatttataagtattagtgatgataaaatttatcactgataattgttacataaaaaatgacatgccgtcacaaataagtttagaatggtggcgatagtttcatcacttacgatttttatggtggcaccaaaaattgccacattttagtagataattatgattgaaattgtcactatcatgatttacaaatgtgattatttatgtggtcacttcttctgttagatctgtggcagtgttatgtcacttttgatgttttaagtggtgaaattgcttctcacctttgcatcattaattttcgctgattaaaacacgaataatagtgatgtgtttaatgtcacaaatgaatagttcgtgttcattttttatcacaaataatcattttttgtggtgagtacaacaatagaaaataagtatattttcagtgttttgaatgtacactaatataaacagtagatgtggcctcctaggcgccacgtgacagctaacttgagacatttatatttattcatactaggtgattccccgcgctttgctgcgggaattactaactaattctcaatatgttttttgacatattgataagtatattaaatatgataaaatgatagatcgatttgtcaaaatattgtgcaaatgatgtgaggggtgataattggatatgcttgcatgttgtatgcttgcatgaggttaaatatgtaattattgatagtgggtgatgatgttccacagtcaatattccaccgtcaatagattagacatcaagtgtgatatacatactcttttcattttgacttttttattagtcattctttttaaagtttgatctagtttataaaaaaaatacaataacatttgtaaaaggaaaaagtacgaataaccccctgaagtattgggtaagtatgaatttgaaccccccccgagcagctttgtaagcgattttggtctacgtggcagtccagtcagcaagttttttaataaataaaggatagggcccacctgtcagacataatattctctctctctctttccctctcaccccctctctctctctctcccgttagatgccagcggctgcggctcacgcgccggcggcagtgggcgcctcctccgccgccgtcctaatggcctccctgagacggcacaacgatggtcagagcggcggcggcaggccatgggtggagcggttgtggcggcaagccgcaggcaaagcggcggggcgaaccagtggtggcagagcgggacgggcagagaggaaggaggtgactaggccagggagcgggctgaggagggaggagaccggcgagggaacggggaggctgggagagtcatcggagtcatcccccagccgccgccgtcgtcgttcgagccgctcccgccggagtacgatgagcccaaccatactcgttgctgcgacgaccacctctggcccgatgacgaccactatgccccgctacccttccccgacgcctgctgttgctcggatctagcgcggcggcggagagaagcgccgcccgcctcctccctctcgacgcgctcgccgcatcccctccgcgggcgcttgccggcatcccagctcgtcttgacagcctcccctcttttgtcccctcctcccgccgccccgagctccggcgggcgtggtggggaaagcgagacgggcgacaggtgccgaggacattgaagatgatgacggcgagctcgggcgcggtggcggcatggcgacggccacgaccatgtcgacccaccactgtgcgcgctgacctcccgacggcccgagagagaggggtgacattggggcacttcgccgccctcgccactttgccgccctccgcctcgacaggggggcacaggcgccgtcacgctcactggccaccggccgcctttccaccacgcccgccacgcccgccgcttgcctcggccccaccactccctgccacgctcgctgcccgtccgcgcaccgctgctgctgccaattgcctgtcgacacgcgcctgagagagagaaggggggagggggaagactgaagagaggtaatgacaggtgggccctatatttttcttttattttttttgctgatcggatttccacgtcgacgccatgtgcatgtcacgtaggagcaaaaccgctcagtattgagtccggggggggggggtggtaattcagccggtatcaatagtttgaggtgtaatatgttcggttttggttcgggggggggggagagagtaattcgtactatcgcaattgtttggggtggaaggggggggggtaaaacatacttttttcctttgtaaaaaaaaagacatgttatcaacatatgttcaattttacattaaatgaaacaatttggtggtgtagatgttgttaaatttttctataaacttgatcattactaaataagtactaggaaaaatcaaaatgacttataacataaaaacggagtgagtatagtctgcactgtgctctttaatgttatctatccatttcgaaacaagggttgcaatcaattctcctatctatgttttataactcaaacattatttattcatattagaaacaaagtacatggtttatagcattggtaaatccatcaccacaaacatttatcccctagcgtgatagagaaaatgaccagagacccacagcgaacctttgtgatagtaataaagtgtggcgtggaggctttggagcacaaatccctactactataaagaggaagtcatcctcctccaccttctcgtaaaaacatctttcctaacaaaacccgtccaccctaaaaaaaatgttttctaataaaaccaaccatattcccaaaaatgaacagtccactagatctaaatcctcccactaaaccgaataaaaaaattcattgcaacagaaaacaaggtgagtggcaaaaccgacaaaaaaaacattgtaaccctccacatatgaatgataaactaaagatctctaaatggaaaatggctgaaggttgaagaaactgtttaactgagaccctccaattttttatcttggatccgcccctgatatgttgcacactacacggctcacacgggaggtgcccacatggcacaagatgatgatgatgaggcttggacggaattcttgtcggcgaattcggttctccacgtacgcagcagagagatggacgttaataacaaatctagcgagaacatgggccaatgcattatggagcttttcttggcaaataagatagttataatattccagatcggcttgtctcttttctgttctcatgtgcaagcaaacgtaggtatactaggagacgaataaaattttcaattctcatgtgcaaaccaacataggtatggtaggagatgaataaagtttaaattcatatgtgcaggtgaacgtagatattgtaggttacgtcaaaaaaaaacgtagatattgtaggagatgaataaaaattttggagcgagcagagctggtagagaatcaatggaatcgatgtgtggaaagaaaaatatacattattttttagccacggttggccacgaggtaccacgcagtcctagggccggccgcgtgtgaccaataaagatgccttgcatgcatacgtgttgtttggtcatgcggttaagccatgggactgatatgccgatgtcggatttatccctgcacggtgatacgtgtatatttttacaatttttttaaagacaagtatataactagaaaaacattaaaaatagtcttttttctctatgtgtgcatggtaatcgtcccttgggaatcgatgggtcaaccgtcggaattttatgatattttgctcccatttggaatagttggagattttaagagacacagttgatgacaatctgtaaaatactctcttcgtttctaaatatttgacgctgttggcttttttaaatatatttgaccgttcgtcttattaaagaaatttaagtaattattaattctttttgttaaatatactttcatgtatataaataattttacatatttcataaattttttttgaataagacgaacggtcaaatatatgctaaaaaatcaacgatgtcaaatatttagaaaaggagggagtaggcctttatatttttcttgctatagctcaaaagctagataagaaatgtattgcttagaaaagctgaatatttcaagaggaactgcagctgaactgcttttgagtgctcatataatcacgtccatggtattaaacagatccccatatatgatgaaatttgattttggtgtagtagagttactatgccgcattatgcaggcaggacaaatagaactgcaggacagtggtccagcaacagaagcaacgaaacgaagaaagtagcgttgagacaagtttttgcactgcagtaattctcggaggccaaaatccatatgaaattatgaatgtggagatcttcgtgacataattctgacagggaaaaatggcatgaggttccatgggctcaggcctagcccatacttcttatcagagccaggcaaaacctgaagtccagctccagcctcttttggactccacccaaaaattcataagatgaactacagaggtggaacacctcctccacctcttgaagttaaatttagaagctagagccataccaaacggaccataaaatcggagggacatgaagaaaccaattgttgagcacacctcacagtatcacgcgaagacaagaaaccgctattgcaaagtggataaacaaccaagatatacaattctatctcaacacccaccatgttgtgcactatatctagtataaagccagcccgtagcccagtaatgataaactgtaggtatatgaaatgaaaaacgtaaaaacatcagaatgaacgtgcaaaacaaagaattgaaaaacttaagagaagtatgagatgtgttgtttggatcacagcaattgggtaaacacaggaaccttgcaaaacaactagaaagtataattcccttggttaatgtatgatggtttgggtcattttggtgcttcgttacttggtttgccctgggcttagcagatgaattgaaaaacgaattctttgcaaaatgtttcaatttctatggaaactgtgaaaaagaatacaaatgaatgaatagtaccaactcctataggttttgaattcccccagctttcctaaaaaattcctacaaaccagagtagccctgaaatattttgcagcagagtgaaacccttgaagcaaaagtagaaaataaaaccctgaaatttctattctatcagcattcagtttacattcagagagatttcactacgattaataacctctgtatgaataaatgattccatgttccccaaaacacatcaacataataccagagtccctgacactgcaaaacaaaaagtactgatataccttgtttccaaaccacctcatcaacttccaagggcagattgaatagttggaatagcataaaaaacatgcatttcaaatcaccataaattcacaacttaagaatggatactgatacatgtctaaacataatggcttttaatcttcaaagctaaattgttgggtgcaactgcaaacaatatgatgacatcaacttcaatcaacatgagaaattaaaatgaggtgcagaactacaaacagaagattcaaggtgcagccgtagatgttttgttatgttaaaatgaggtgacaagtcatccataattggcaatagaagatttaagaaacaataggaattgatccaaactgacaaaaaatcaagtacaggaatacatgccctgtttggaatagcttaactcaagtttttttggactggatttttctaggtccagaaatttgcggagttggaccacctgtgagattaagcttgttaaaacaagaaattttgttaacatttgagatcagaaagaggatccttcaatttaatctacaaactctactttctatacaaatgcagtaagtagttggaaccaagccaaactgagccacagtattcaccatgacattttgatattatgcagatgatccttgttgctaaattttttatattgaattctagatttccagtataaccaacacagaatccatgaaacaatacttgagtgaacaaggggtaaatcttacaaggacagaataaaacattgacagagcagaacagaaaaggctgatattgtagatggatgagtgtttacagacaagagtaagcacaaatagtcaggaatgcttagtttacgaccttaacttaaattgatcatgctattgaaggtcatcaatcaagaaaaaaatgtcaagaaacaacactcgataagaaaacatcacaactaccttaacacaatgaatttggtttctaggtaatttctgctgaattgtagtccttagcatactatgatccattatgtgcacaagcggtaccagccactggttgaattaaccacaaaacagattttaaaagtatcaggcagcaggggcagaaaacttatcataaggtgggcaacaccaaagtgcagcgaggacaactttgtttgccaagcatctctgccagtttcaatgtcacagttgcaataattagttcaaaagctcatgcagtcatgctcttgtctaagactattaccacataccgattttctgggcaattaaagcagataacaggtgaccagcaagcaagctaattctcacttctcagcaacatgctatgtaccacaagtatgtagcatccccataatcaaaagttgagcaattataatatcatcataagaacaagtgtccacagattaaccgatcaatcaagaacatctgctaccctgaacctgaaggctactacttgttcttgccggccttcttcttacccacggtggaaggggtggcgctgacctgcgggcgcgggtggcggtcggcctcggcggcgtcgagccacttgagcgggtggcggttgaagaagggccagttcgggacggtgacgagcgcggtgaggacgaccccgccggcgtagacgagcagcatgagctggaagtccgccatggcgtagcccaccacgaacgccgccaccgccgacgccaccagcagcagctgcatcagcatctccgcgagcttctgcccctgccaatccatctgcgagcaagcacacacggggatcaggcgaggcggatcttggatggatggatggatggatcttgggtgcgctgatgaggaagaagggggatctgagggaaagaaggacggggtgcccggataggatggaggaggaggggttggttaccttgggtgattcggccggcggcgggagggggagtagccggaggagaggacgacggcggggaggagtaatggagcggatctgttcggaatgcgcggcggcggcatctacggggagtaaggtccccgaggctgtctgtgctgggcaagcccagggccattcaaggcccggttggacagagtgatgggatgggtcgtgttgggttgggctgcgctgtttttctaatcctatcttagtaaaaagtataccgaaggtacctcaacttgtcattgagttacaaaatcgtcctccaaccgcaaaaccagatatccgacgtcgcttaactaatcaaaaccggccacaataggtcctttggtggttttgatcccgattttatcctacatggcggctgagtcagtatgggacccgcatggaccccgcctatcaacatgccatgtgagcaccctctctcttccccttttatccattcctcctctctctctcactcttctcttggcaagccgatcggtagctgggaagaggccgccgagccgaggtggcggcggcgaagcggtcccgcatgggcggccgctgcggcgttgggcgtggaggccgacgaggacgtgatgcggtgatgatgctggtcctcccatcctcatccaccgcgccgccattgctgccgacgccacagacggctcgcctgctcccgtgccgccggccaccggcgagaacgtgcgaaggaggaggtggggaggtcgacagcgagcacgcgtaaagagggaggatgcggcgtgggagccgcagtgcccgtccgcacggggccgcttcgccagcggcggcgacgcagccgatgccattcgcgacctaccaccaccttgattaggcgtccttcttcggatcttgctcgcccgtgacgccttcatccttcttcggagcgacgacgggcggtgggcggagtagagggacgatgggcggtgggcgatgcgacgtgtgcccgcagggcgaggaggggctgctcgctgcggccgggcgaggagggaggcagtgcgcggtagccgggtgaggaggggcggtgcgcggtggcagaggagggaggcaacgcacggcggcggggcgaggagaggttgcgcgcagcggctgggcatcgcaggcggagcagccgacggcgtggagctgccacgctcgctggtgaactttccctcctcctgacggcaacgacgacaataaccggaggcagacctctacaccatcgacaccaaaggcgaagacgaagaggatgctgacggtagacgggctgtcacaccctgaagctcttctcccaagcccaaatttaattaataaatggtattgagaaattaccggtgtaaaagcaagagagaaaccctaattgaattaatgcaaataataaacggaaatggcatgtggaatttttcttgagttctacatgtcaaaatatgctaacaggatttttagtgaaattttcagagctctagaaataattttaccaattaaaaatgagcacaagcattatttaatccctggaaattcttttcccctttctcctttttctttctccctctttttcctaatgggccgccggcccattccctatccttctccctcccgcacccttgctgggccggccgaaggccacggcctagcagccgcccgcacccccctcctctctctctcccggggtcgccgacaggtggggcccacctgtagggcccgtctacaacctccacccggaggaggaggccggcctccccaaccgccactcccacctctccctcgcctcccgggccacgtcgcccatgtcgccgccttcccccgcgcctccccgcgcctactccctctctctcccgcccgcgcccgcgccgacacggccgggattctttttttgaatcccgccggccacaccctctctccaccccatactactccggtgaaatcgggccatttcctgctcccccgagccctctcttcccctatttaagcatcactgcacctccctctccctttttccccatttcgccgagcctcttcgtgctctcctccgccctagcgccgctgccctcctctccgccgccgccaccgccgctccagtcgccgctagcagccgctagccgtcgcgtcgagccgcgccgtcgacaccgtcgtgttcgccgtcgtgcgggccgcctcgtccacccctcctccgtcggaatccaccgccggaactcctccttcgttgcgcgccggtgagcaccgccatggccgccgccttcggctggcgttcccgctctcgatgatctctctctccctctctaatcttccctatttttgttccttaggtcctcttgaagcccgtccgcctctcgccgtccgccgtccgctgctcgccgcggcattcgctgtcggtaaggaaccccctcccatccctctctctctctcccatactgtcgacgctgttttgtcgcgtcgcctcgctttggggccgtgccgccgtgcgtcgccgtatagccgccgccgccccgccgctgtctgccgcatcgccgccgccgtccgccggtcgctgccggtgccgcgctgtcgccgcgtggccgccaggaacgtgtcgtggggctgtgtcttgtgggtacaggtgtacacatctgatcagagtaatactattcgaatagccatgcccgcggttatgggcggtcaaccagattcaccgtgattagtctcaccctagtttagtctaatggaattgattagttcaagaggatggttgggtctgttgcaacgtggtgtagcgttggacagtggatggtaaatattgtttaattattacaactgttttactgctttcaactactgtttataaatgctcgctttatgcaaatgaaccgctctagctaccctttggttatatcctacatcataccccctctttcggtatgacttgctgagtacggtggttgtactcagtcttgctct

SEQ ID NO: 5176 - DNA, 3656 bp, Oryza sativa
cagagtaatactattcgaatagtcgtgcccgcggttatgggcggtcaaccagattcaccgtgattagtctcaccctagtttagtctaatggaattgattagttcaggtggatggttgggtctgttgcaacgtggtgtagcgttggacagtggatggtaaatattgtttaattattacaactgttttactgctttcaactactgtttataaatgctcgctttatgcaaatgaaccgctctagctaccctttggttatatcctacatcataccccctctttcggtatgacttgctgagtacggtggttgtactcagtcttgctctacttttccccaacccctgagtttgagtatgcgtcagatggtgtgttttccgaggagtaggcttcatccgtgccgtcgaggatgcctgtggagtggtgttcccgctgcaatctaagtcaaggcttagctctagttatcttttattttccgctgcatttatgtaagacttttataatatttgtaagacgtggatctgtatgtcaactttatcgtttgtgtaccccggccggtcctggacgggggttttaatgcacattctacttggcatcttgggtacctacctcgccaacatggtggttgaggcatctggaggcaccgctaaccacgcctgctaggaggcggcatacctgatgatggccaggcttcgtgaccgccacagctacaccttccgcagcacggcataccgcttccaccctcgccgagcagatgatgacgacttcagtaccttccacccgacggctggcgagaacgacaccaccttcagccacatttgtgccgtgatgaaggggatggacaggatgcactctgacctggacaaggcatccaaggccttgaatgatggaaaacttgtgaggattatagccttgaaggatgagataacgcgcctgaagtaggagaacgctcagctgaggggtctcccagctccaggaggggtccggatccgcaccacgcccggcaagactaccactgcacccgtgcgcactcagcttgcgcccaggaacccacctcctccagcaccttccgcatcaccagcacctctcgcagctccagctctagctcctgctccagtgtcagcccccgtgtccgccctctccttcgctccagcttcagcctttaggggtccagccagtggcaatggaggttggttgcctgctactcccagtggcagccgcgaccgcaacagcagttccagcagcttagagccgggcagtggcgagacgtacctgcaggactccaagagccgctcagagggaccaggagacgagcaggaggacgccttcgactccactgaccgcaggagccgttccgagcattaggctcattttcagttagcatatcgttctgcttagtaattgtctgttagtttgtgtgtttaggtttgttcacttgtgggtcagtcgacggtcgatatcatatgcctatgatatggctgtcctaataaggatttgcttgctgttttaagtgttttaatttagatcagaacaattgcagtttaaatttctatttaataaagcttagttcctgagcatctactcttcccctccgtctgctcctccttcagatggtctacaccaggaatggcggccgcacagcgggtgagggcagcagtggcgaagaacgcgccgatggtggacaccccaacagcgcctccggcaatggttcgccaccgctccccgagaacccaatgcttgcacaagtgatggcccatcagacccagatgatggcggccatgatgcagcagatgtagcagcagcaccagcaaatgcaccagaggatgcagcagcaggctgatcagcaccagcagcagtttggtccccctccccctcagtccaagccgccagagtttctacgcgtcaggccacccaccttctctagcaccaccaaccccatggaggcaaatgactggctccatgccatagagaagaagctcaaccttctgcagtgcaatgatcagtagaaggtcgccttcgccacacaccagctccagggtcccgcatcagcttggtgggacaaccacgtggcaacccgtccgccaggcacagaagtcacttgggtgaagttctgtcgcagcttcaagaaggcgcaggtgccagacggggtcgtggcacaaaagaagagaaaattccgggcactcaaccagggcaacaggacagtgactgagtacctgcatgagttcaatcgcctagcgcgatatgcatcggaggatgtccgcaccgacgcagagaagcaggagaagttcctatcaggcctggatgatgagctgaccaatcaactgatttccggggattacgctgacttcgagaagctagtagacaaggcaatccgccaggaggatcagcgcaacaagctggacaggaagaggaaggccgcctagtttagggcacaccggggaggtcaccataggctgcgcttcactcccagacagcagggtggacccaccaccatgattgttcgccagcaccacccctattcttccggcaacttccaccagggtgccagtggatgtcagaaccaccagggaggtcagcctaaccgcagtgcagctccgcgcctaccaatggcaccagcacagccaactccaccaactcaagccaagaaggagaccagagcaaagccagggtcctgctacaactgtggcgagcatggccactttgctgacaagtgcccaaagccaaggcgtgccggaccaaggttttctcaagctcgcgtcaaccacgcgtccgcagaagaggcacaagtagcaccagaggtcgtactgggtacgtttcctgttaactcaatccctgcaacagtacttttcgattctggtgcaacgcattctttcatttccaagaggtttcttgggatacatggggtaagaaaagaggagcttagtacaccaatgagggttcataccccgggaaatagttcaaccacggtcagttatagcccttcagtgctaatagaaatccacaaatcacaatttctagccaacctcatccttcttgaatccaaagacctacatgttattcttgggatggattggctgaccaagttcaagggtgtcattgattgtgcaaatcgcacagtcaccttgatcaatgagaagggagaaacagtggtgtacaagtcaccagtctcaccgaagcagggaatctccttgaatcaaattaaggtggaaaatccggtggtcaccgaggagaagagtttgaggaaattggaaggtattcccatcatctgcgagtatccagaagtgttccccgatgtaacgccccgattttcgttcgggattaaaaatcattaaataatgcattttctaaaaattaaataaaagttaatcaatttaatcaagtgaattattgggcgaattaaaattttcccttaaaagatcattggccgagaatattttgtaatattctttgtgccctaaaacactctccggatttttccgtgaattttcggagctcaagaaataattttaaaagcacaaaattcattttaaccaattaaaaaaaaagaaaacaaataaaatccccctcccctcccttttgggcttggcccaagccttccccttctcttccgtgggccgcgtgcctactacctctttcgggccggccgcgccttgcgaaagtct

SEQ ID NO: 5177 - DNA, 7023 bp, Oryza sativa
tgcttaataaccactagcttagttgatgggataatacccgtattagaccttttagtatcaaaattaagctgcgtgctcgagacatctgcccatgcttcctggtcgtaattatccaactaaaatgcgactgaatggtgggctgtgggtgcatggttttgctggtcgcacccatggcagttaaggaccggttcgtgggatgccctgaaagaacttatcgtacttaccacaagccagcgtggggaacggctgggcttgtagtgtagctttcctctagtcaacgcatccaggcaagggtgggcgtgatggagcggggcgggccctgcgacagcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggtgcacggaaacgtgtcgtggggctgtgtcttgtgggtacagttgtacacctctgatcagagtaaaactattcgaatagccgtgcccgcgattatgggcggtcgaccagattcaccgtgattagtcccatcttaataaatcgacccaatacactgtagttctggtgggttggttgggcctgttcaacgtggtgtagcgttgatcagtggagatgtaatgttactttaattactcaatagttttactgttttgctcaataaaatgttttacaaccgcctttatgcaaatagccacaaaccatccttgtatccccttgcacatctgcatcgttggtgtggcttgctaagtacggtggttgtactcagccttgctattattttcccctttttagaagtgtagtgcttctgagctgaagacgaagttagaagaccaaggctctgaccctagttgagttttgcctgtggagtggagctgatgccccgctaggatcgcttttttccgctgctgctgcttttgtttcggtgtgaggactaagtgcctcttctgtaagtattttacgttttatttacgtttggaactgtatattacttgtcgttttgtgtaccctggctggtcctggacagggatttaatacacaaaatagtctggaaatttgggctaaatttctgggcgtgacaaagtggtatcagagccaacttgattataggttgagccaaatggtcaaaccctaaggacaagttttctgaaaaccctatttgcaaaatgtctcctcttgcccttcggcatttctttgcgaaatggtttttaaatttctcctccctgcccctccaattcttttagttgtcaaacctggaggacaaaccgccagcgtcatgcctgttcggaagtcaagtcgagcctcaagcttcgtgcaaagagcgaaaagatctgcccagagtcgtcgttccgcgaagattaaagaagagtttccccagagatgacctaaacccaatctgtcccagaagagtagtttcgttagcttctagatcgtgtgttgtttgcttgtgtgtaggggtatggtttgcgtcattggtggggatgcgaccatactaggttgtttgcttaagcaacttgaatcaataaaaatctactcacaacagatcattagtcaagtggtttaaggtcttatctttagcaacccctctcttccacctctcttccgccctggcagaagatggacagtgttagagagaagagcaacgatggtgtattaaagtcacagatcaatggttcagttgaaagctgcaaggtaccccaatgccagaagaacccctgctcctgattaacttttggtgtccaagaccagatgatgggtgtattgatgcaggagatgcaaagcttgatgcaaggtcagatgtagcggaagtaactccagccgcagtgtgttgaggtcagaatcagtggatcagtccgagacaacaagctaccagctgagtcagagcacctcgctctggtcagattatggttagccaaggtcagatgatggatgtgtcagatgttgatgcagcaaccacagagtccgatgcaacagatgcaacgacagtgtctccaacaacaggtacaagctcagatgcaagccggaatcaggatcagagccaaagccagtttgttttccaagagcaagcacccgcaaccccaaatagtagaccaccaagcccttagcagaccagcacagccaagccgccactaatcctaggagcaacaagtgatacctacagaaggtatgggtttcgagggcaccgataaagattctattgtttcgctagcaactgcttcaaggctacagaatcagcattagtagggcaatcaatgtcagggaatcagtgatctactttaactacagagagacagctcaattcttcagcagcgactgcagtcaatgtctcaagcatcagacttcaatgtggttatcaacatcagccatgcacctcatgctgctccagctcagtggtctggcaagaaattaatagaagagttgcaccaacagtgagaaggtctcgttcctttcagctaccaagaggattgatggttgtcttaggaacgtcatcagtcaaagttttgttcttatgggagcttcagctcgtaaccaacaaaaggacaagtcaaccatgtcagaatcacaatgggtaaatgtgctaccgattagcagttcggtaagcaagagtcaacaattgtgcacaggcctttggtgttcaaataccgtcctcatgcatagaagttccaatccagtgatatagttggaaggggaatattgaatagagtaggagtcaagcggttctttccttttcacctttgagtatgcaaaagcaagttaacatgtgtatctgcaagttacaagaaaccaagagtttcccttctaactcatcgcacttttgttgtgctccaaaacctgtttgcgagccagtaaagaaaggattaaccaatgaagtgacaatggttggatccatagcgctcgacactatgaaatctctctaaaggcagtatcaagggtattcaagtgtaaggagtaatgaaaaaaaaattcagaagtaacaccatacaaggaatcttgggaactctctactcgtggaaaccgttagagaatggtaagctgcaattacaccttagtggtacgattacgaatcatggatggttctccataagttcgaagcaaccactatgaattccagaaatcctcatgatgtttctcggaagttggcagaaattgttccatacatgggcgagaaatatacaagaatcagggtgtgtggcagagaacctcttttctacatatcagctttaccgaagatatgaatgtgaagttgttatcatcagagagtagaaactctcggcagcatcaaagtcagttttcggcagacgcccagattgcagtattttggggaaagcagttgcagggcttatagtacgtcaacccaggaagagtcaacaaaggaggatcgacgaagtgtaatgtcgtgtcaagagaaggactcttgagtttgatctgctaagtgatcagtgcttgtttcacagagtgacagctatgcaatctgtttaagcatatggtaccgaagtcaggccagaagcatgttagttatgccagcagtagaactgacggggaagtagtcaagagttagtaagatcaggagctaaatgagaatttctttatgaggagtttcctatcaacaactgagggttaagttccaagtcttgtcctggatgaaagtgcatcgtcattgctttattttgattgatcgatgaagttttctattttcaaagtcagggccattcgtaaattcgagaagtgtcgatttttcttcaaggacaatagttcaattattcccggtcacgcgaaagtatgactactctctataaggggggtaggtcgcagagatgagttttggttcacctcgttgccgtttcccttaaagattcaacccagtgcagcaagttggttagtacttgaaagagccagctgcaaggcgtcagcagagtaacactgatcccaagttgtctaattgaattcgaaggtacgccggtgaggccaggtcaaccgtttggcttaaagaagtagcatcaggaacagccgcaatccagacaaggacagaccaagccaatttcctgaaaatacttgtggtttgaatcaagagcaagtcaagcaaagtcattgtctgtgggttacggaagtcagtttcaaggttttggaaaaactacaccgatccccggtcagcaaagtgaatcctcagtttatctaattgccagcattagcaattcagtccaaaaaaaatagaagttctacgagcactagcagttctggtcaaggtcagactaatcagagtcggtacgtcagtttatgggaagcaacagaacagcaagcttatgcaggtttggttcatcgagcaatcggtcagttgaatcagaaagaggcagcatgtgtaagcagatcagtcagaccgctcgccagcaccagctttctttctagccatcccagaatctcgggacgagattcctataaggggggtagatttgtaacgccccgattttcgttcgggattaaaaatcattaaataatgcattttctaaaaattaaataaaagttaatcaatttaatcaagtgaattattgggcgaattaaaattttcccttaaaagatcattggccgagaatattttgtaatattctttgtgccctaaaacactctccggatttttccgtgaattttcggagctcaagaaataattttaaaagcacaaagttcattttaaccaattaaaaaaaaagaaaacaaataaaatcccctcccctcccttttgggcttggcccaagccttcccctcctctcccgtgggccgcgcgcctcctccctctctcggccggcccgcgccttgcgaaagtctgctttacgtcccccggtttccctcctctctctccatccggccgacaggtgggaccgtggaccccacctgtcagctcctcctcctacctctcgccggccaaccccaaccgccattaccggccacgtcccgccaaatccggtgccctcccgctcgcgccttcgcgcccaaaccaagtaaaatcggttcctcaccacctcctccaccaaatccctcacttttccccaatttttggcgccaaatcgagcccccacttcgcccacgatgtcgcccacgtcgccggccgttgccgcctcaaatccaccacgtccggccacgatttctcctccccaatcctataaaaacgatccctggagcatcctctctcttttcccctcctcacccgagcccgccgcgctctctctcgccctccccacgccgctcccgcgcgccgccgctcgccgtcgacttccagccgcgcgccgtcgccgctccagacaccgccgcgttgcgccgccaccaccgttagcctcgttgtcccgagctccatcccgacatccactttatttcccagaaccactgccgtgatgccgtgcccgcgcacaacccgagccgccgccgcttttgccgcctccagccgcctcttgctgtagcgcccaggccagctgcgcctcgtccgctgctcggtcgtcgtcttccgccgctccaacccatcctctaagttcgcctgtgagctctacctcttgtcgtcgccatcggccttcatttccagtcaccccgcatcggtcctcccctccctaactccctcttctccttctgaaggtcaagggcgaccccgtccgccctccgtcctcgcaagccgccatcgggcaattgtcgtcgctgtcatcttcctccgcgccggccgccgcttccggtgaggacctctcctcccttcccattttttcccgtccccctttcttgccgactgccgcctcttggggtgcgtcgccgtccccgtgcgcgccgctgtcctccggccgcccgccgccgttccacgtcgccggctgctgccgccggtggccgcatgccgccgccgcgccttggctcggccgggccggcttcgtgccgcgcctgtgcccctggctgccgctcctctcggccgcccgatcggctcaggccgatctgggctgtccacttggtggacgcgcacccgaggccacgtgtggaccatgtccaccgtgcgccctccccctttgagtcgctgacatgtggggcccgcgtgtcggcgccggccgccccttgctgacgtcagcgaggtccatttcctttgtaaaaataaataataattgcgcaataaatcgagtttaattctagaaattcatttaaatggctcaaaacttctaaaattgatatctaattcatacgaactccaaattgggccattcaacttgcaaaattcatctaaaattgatctctatatgtttgtttactttttatgtactattcccttggtttttattagagtttttccttgttttgcgtgccagcgtgtagttcccgtcgtttcggaagtccgcggtcgcgaggaaaagagttcggaagatcaaagtgaagaagcaaggcaagtcacacattccccttgagcatgttgatcccaatttacaaatgttttattgtttgcaaataaatatgcatattttgctaattacatggggtcatggttttacctatctgctcgcttgtgccatatttacttgatatatgtcctttgtcaacattgggtaataaatggactagctcatgttacttatgtgacctagctagaactatatgcttagccatgcttaattaccactagctcagttgatgggataattaccgtattagaccttttagtatcagaatgagctgcgtgctcgagacatctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgattgaagcggggcggccctgcgaca

SEQ ID NO: 5178 - DNA, 17653 bp, Oryza sativa
ttttgtcgagaagaaggacaagacgaggagaatgtgcgtcgattatcgcgcactcaatgaggtcataatcaagaacaaatatcctttgccgtggattgatgatctgtttgatcaactgaaaggagctaaggtgttttccaagacagacctgcgatcaggctatcaccagttgagaattcgggaagaggacattcccaagacagcgttcaccactcggtatgggttgtatgagtgcacggttatgtcttttggactcaccaatgcacctgcattcttcatgaacctgatgaacaaagtgctcatggaatttctgtataagtttgtcgtggtattcattgatgacattcttatctattccaaattggaagaagagcatgagcaacatcttcatctggtactcaagaagttgcaagagcaccagctttgtgccaagttcagcaaatgcgacttctggttatcagaggtcaaattcttgggtcacgtcattacagcttagggtgtggcagttgatccatcgaatgtggagtcagttaccaagtggaccccacctaagacagtgtcatagattcggagtttccttggacttgcgggttattaccgtcagttcattgaaaatttctccaggattgccagacctatgattcagttgcttaagaaagacgagaaattcaagtgggcagccgagtgtggcaagagttttgaggagctcaagaagaaattagtgtctgctccagttctgattctgcccgatcagacgaaagacttccaagtctattgcgacgcgtcccgccaagggctaggatgtgttctgatgcaagaaggtcaagtggtcgcatacgcctcgcggcaattgcgcccatatgaaagcaattaccctactcatgatctagagttggcagcagtggtccaccctctaaaaatgtggcggcactacctcatcggtaaccgttgtgaagtttacacggatcacaagagtctgaagtatatcttcacccagcctgatttgaatctccgacagcgaagatggttagagttgataaaatattacgacatggggatacactatcatccaggcaaagctaatgtggtagcagatgctctgagcaggaaaagctactgcaacgccttgggtattggagacatgagtgacaagttgctacaagagcttgaacatctcaacttgggaattgtagaacatgggtacgtggctgccctggaggcacggcttacgctcgtggaccaagtccgagcagctcaggtaaatgatcttgaaatagctgagctgaaaaagaatatgagggtcggaaaagcccgggacttccatgaagatgaacacggcacaatctagttgggagaaagattatgcgtacctgatgacaaagagctgaaagacctggtactcagcgaggctcatcagactcaatactccattcatccaggcagtacccaaggaggaggccggcctccccaaccaccactcccgcctctccctcgcctcccgggccacgtcgcccacgtcgccgccttcccccgcgcctccccacgtctactccctctatctcccgcccacgcccgcgccgaaatggcctgcacctccccgcgcctactccctctctctcccgcctgcgcccgcgccgaaacggccgggattcaatttttgaatcccgacggccacaccctctctccaccccccactactccggtgaaatcgggccatttcccgctcccccgagccctctcttcctctatttaagcatcaccgcacctccctctccctttttccccatttcgacgagcctccccgtgctctcctccgccctagcaccgctgccctcctctccgccaccgccgccgccgctccggtcgctgcaagccgttgttgccgagccgcgccgtcgacgccgtcacattcgccgtcgtgcgggccgcctcatccacctctcctctgtcggaatctaccgccagaactcctccttcgttgcgcgccggtgagcaccgccatggccgccgcctttggccggcgttcccgctctcgatgatctctctctccctctctaatcttccccatttttgtgccttaggttctcttgaagcccgtccgcctctagtcgtccgccgtccgccgctcgccgcgccgttcgccgtcggtgaggaacccccacccatccctctctctctcccgtactgccgccgccggtttgtcgtgtcgcctcgctttggggctgtgccgccgtgcatcgccgtgtagccaccgccgcgccgccgctgtctaccgcatcgccgccgccgtccgccggtcgccgccggtgccgcaccgtcgccgagtgcccgctgggccggcttaacccgtccgtgcgcgccgccgcgtgctgccccgccgtggctgccacgtcggcgccacgtcagcaccacgtggtgcccgcctccctcccggtccgagaacccggtccttcgcggaccggcatcccgagcctatgacatgtggggcccacctgtcggcgctgctctctctctccgatgacatcgccagggttaaatattatgcaataaatcaattaaggacttttctgtttatagtaaaatcacagtgaatcttctaaaattcatagaaaattcatccgtgctccgtttaagcccattcaagtcttagtaaatcaagaaaaatgcaaagaatccattaaaaatggttttgttctctatttcagtagtcttacagcctgtttgcattgtttgctttgtatgtcgcttagattctggctctcccgacgctccggtgtacattgagatagttgccgaggttcctccagtagcagagcaaggcaagtcatgcttgtcacttgaacatattgatcccataatgcaaatgctctattgtttttctttaaatactgaattgttttataatgttactatggaatggttacctactgtttcagccatgctatttgtaccatgctcctttgttagcttgggatataatatgaatagatattggattagggaatgcttagccatgcttaattcaagtagcacacaatgggccccgcaaaaaaaagtagcacacaatgggggaattacattaatgcatagatatcagattctagtattgatgttggtttagtgccaccattccggtgttggttaattaaaagatacaaaatggtgggctgtgggtgcatggttttgatggttgcgcccatggcacttaaggacaggttcacgggaaaccctggaagaattcctcgtacttaccacaaccagcgtgggcaacggctgggcttgtagtgtagctttcctctagctgacgcatcctggcaagggtgagcgtgttggagttcggatgggccctgcgatggcctatgcggctttcagattcacctaggcacgataggggactgcctgctaccttgcaaggagtgggggtgaaacctgaggtgtggtgtgtttggttagagggtgttatgcgaagggtcctgtcacgacctcttttcggtatgtcgtggtggcatgtcggcacacgggaacgtgtcgtggggctgtgtcttgtgggtacagttgtacacctctgatcagagtaaaactattcgaatagtcgtgcccgcggttatgggcggtcaaccagattcaccgtgattagtctcaccctagtttagtctaatggaattgattagttcaggtggatggttgggcctgttgcaatgtggtgtagcgttggacaatggatggtaaatattgtttaattattacaactgttttactgctttcaactactgtttataaatgctcgctttatgcaaatgaatcgctctagctaccctttggttatatcctgcatcataccccctgttccggtatgacttgctaagtatggtggttgtactcagtcttgctctacttttccccaaccccagagtttgagtatgcgtcagatggtggcttttccggggagtaggcttcgtccgtgctgtcgaggatgcctgtggagtggtgttcccgctgcaatccaagtcaaggcttagctccagttatcttttattttctgctgcatttatgtaagacttttataatgtttgtaagacgtggatctgtatgtcaactttgtcgtttgtgtaccccggccggtcctagacgggggttttaatgcacattctctttggaattctattcgggaatttctgggcgtgacacgggcggaggcgttgaagatgagcatgaccgcgggctccgtaccgggagccggagcccgccttccattctccagcaagcatgcagctccacgccgtcggctgctccgcttgtgctgcccagccaccgcgtgccgccccttctcgcccagccaccgcgcgccgcctccttcttcgcccgcacgtgagctacccctcctcgcttggccgccgcgagatgctccgcccaccgtccgccgtcgctccgcctactgctcccctctgcccgccgctcgccgttctgtacgagtccgggatagagagggggggatagagagaagagggggctgacatgtgggaccacatggtccccaccttttcttattttttgtgtggttgacatgtgggtcccatggttttttaattatttttctgggatccaattgccacataagtgccacgtcaataccacgtgggatgaggacctagtcaaagggagccacgtaggcgccacatcatccaacaccgggcacaatacttccgaggtaccttttctgcacggttttataagttgagggatgtgttgtatccggttttctagactgaggatgaaaaaaagactgggcgacaaattaagggacctaaactgaacttattccccctatagttcaacaaagaaataagttcacctgtcgtccctcaacattacaccgagtttgtggaaatacgagaaatcttcacccctaaattatacaaaaccgttcaatttagatcccatggcagtatagaagcctggtttcgctacgtggcatcccactcagcaaaaaaaatattaataaatatatgggacctatgtaagtgagagaaaaaatgatgtgggccccacatctcttctttcctttttctcttctctcctctcttctcatttgctttcttctctccaccacgcgcggcggccggtggcagagcaggcctggcggcgcgccgagcggacactgcagccagcgcagcgagaatgacgatgcacagagtggtcgcagcaacgggcgagcgcgcggggaagaagagggagacggggaaaggaggcggccgacacgatggcgccggcgatagaggtggagagaggcggccacgtgacggcgctggcgggagagggggagagaggcggccggtgcgaccgctcgtgacggcaggggaggcgcccagcacgggcgggagaggggaacagaagtggccagcgacggcgaggcgagagaggcgaccgtgtgttgcaacgggtgaaatctattttaatgttattattgttatatggtttagtttagatgaaattcactatgagagttcgcttggatatatatatttctagaaaatcatgagctgcagttaggagtccgatcgtctcaagttagcatgcaagtttctttaaacatatttcttacatgattcctgctgtattaccaaaagcgaacgatcttaaaaaccgacttaaatacggatatgtatttctaaaagcaaacaaagttaaaaactgacccatacacgaatgacgtatcaaaataccggcaaaaatatcttcaacttttataaaaaaaatgcccttgtgttgcaacgggtgaagtctattttaatcttattattgttataaggtttagctgcttaaaacctaattctgaacaaacatgtagctatttcatttgacatttttaaagtaataagaaactcttacacttttaagcctttggtctttttaaagctatgagacactcttacattgtttaaccaaagaggctagattggagtagcttattcggagatacaactctatataagccaaaaagtcggcttaaaaatttaagccaataagcctatgcattgtcacatccggaatttctaatcaaaattccaaacgcttacatgtgtgtaaaccctcgtccacgaatcagccgaggcacacaataacaaattgataatagagtacaattattactctaattaataagcgaataaaatgttattacagaggtagatagttcctctgtcacgcccggaatttctatccaaaattccaaacgcttacatgtgtgtaaaccctcgtccaggaatcagccgaggcacataataacaaattgataatagagtacaattattactctaattaataagcgaataaaatgtcattacagaggtagatagttcctctcaatcaataaagttctgagcagtggaaaaaaaaaagaaatagcgcaggcgactcctctccataggcagcttgaccagggctacgcctaatcatccacaccatcagcatcactgtagaactcctcctctgatgaatgattgcaaggtgagtatatgacatactcagcaagccacgcagcaaatatgcaagtgcacaggataacaaaggatggcatagtatagtctcatttgcataaatagcatttaataaatatttcagaatttaataaaacagtagagtagagtattaattaaacaatattaatccaacgctatacagcataccctgttgcataggcccaaccgttctgaacaaccaatcccagttgcacagttctatctccaaaccaggaattaaccattccaaaccaggagctaaacaagttattaccaagtacagcatcatttattatggtgagaagtgtgaaactaatcacgaaagacattgttagacccgcccataaccgcgggcacggctatttgaatagttcaaactctggccagaggtgtaccactgtacccacaaggcacaacctcaacatcatgtcaaccatgcgtcgcgatacttgacaagtacccgaatagagattgtgacaataccctctatataatataattcaaagcagtgcactgttcccggatcataatcacccccttataaacaaggtatggactccccagcgacccccgttggcttatctccgccacttcacagtctggtgctctacgatgaaccatactatacagaaagtaaagccgttgcccacgctggcttgtggttggcatggtaaatgtttcacaaccgaaaatcgtgaaccggtccttaattgtcatgagcacgaccatcaaaaccatatgctcacaacccaccattatcaggttttagttggcaaattaattacttaaccaatcatgattaaccatcatgatctatcattaagttatcattaaataatagtgaagcataagttattctagtagtgtgctaatgtttctaagcatggctaagcaatcatatctaatatctagctgaactaatatgtaaagctcaactagtcaaattataataacccacggtatcaaagaataaagtaatcaagaacaaaaagggctataacaaaacaataggttatttccacccaatgacattcaaaaatatatgcagtagttgaatagaaacaatagctttaaacaggatcaacatgctcaaagggttgtttgggatctgtgtgacttgtcttgctggccttggaactcttcaaactcttctcctgcaaatttggactctccgggaacgtcggaatctaaagagaaaagagcaaaatcaccaaaacaacacataaacaagcatgaacagtacatgtggatatttttaacatgtagatctcaattttagaaaaatttagagacttgaaccaactaaatccgagctaagatgaattagttatgaattttcaaagattaaatcagattaaatcatttatatagattttaatggaattatgacgcaataatgaattatttttgaaaagaaaaaggggattattgcatcagcggctagggtttacggtggaccgggtgcacggcggcggctcacggaaacgaacggccgaggtcgatcctatccaaaacgaacggccgagatctaatcggttcatcgcgggtccacggcgaccggcaacgatgatgtcggcgatgacgtcctcaccggcggcggctcgaacgcgcatgctcgccagcgaacgacggcgcggcggtgcaaacggagggcaccagcacgtagagggcgacgcggcgatccttaccgaggcacgaacggcggcgagcagcgaccggacgatgacggcgacgaggaagaagcggcggcgacggtcagctcgacgacgacggcggccttccaacgatcctcggcgacgacggaggggtggacgaggacggcgacggcttggcaatcacgatagcggccttcccgagcgacgacgacgaccggagcgacggcggtgctcggctaaactcgcggcggcgacggcggcgcacagttgaacgcggttagagcgctacgagcggcggcgagctaaggcgagggtggcggcggagagaggagggctcgggggtccttttatagcggctagggggcggcgaggaaggcccacggcgctagagctctaccggcggtggaaggcgaaggcgagggaaagttagggttcgggagaagaaaacgaatccgaatcaaactcaaatccgatgatttccaaaccgaattaggcgacgattccaaaagagaaaagatagaggagatcaaggggatcatttcccctctattgatttcacaggagaaggaaaggcgcggccgaattggaagggcggcggcggcgcggctcggctagggttcgggcgcgaggaggacgatgggtccgacaggtgggacccacctgtcagcggccaagggcgcgcgcgcgcgggcagctgcgggcagactgggccgactaggccgggaaagagagagagggcggttttgggccgactttcggcccaaagccaaaaggaggatttttaaaaccttttcaatttaaattattcatgaaatgcaattccatttattaaaaatacttccttggttcaaataaatcccagaaaaatctaggaactatagaatcaagcaaagtatttaataaaattttatctggcccacttttatattggaatttattatttaaaattagatcttctcttctaggcttttaaaattatttctaataattccagttaaacaacaatttatataattaaggctttttagggtgtgacagcatttagatgacattttgacttgtatatgagaaaaaagtttcgctgctagattggtttgtggatccccaaattcgagtgcttaatttggttgcaatctatcttgttcttgcttgtgttcttcgattcgcatgcagtgattagccttcttggcgaggtcaaccgggttttggcatggttgataaccagaggagacgtggtgctgccattgcggggatcagtagcgtgttcgttcagaagccggatcaagttgtgtcgtgactccgtccaaatcgactgtttaaaaatacctatcagaagattgggacctaacaccctcatcaaaatggaaaaggagggcccacatgttaggtgtaactgtccggaagctgccttaactatcaaaaccgccatgaggacccacctgtcagtgagcagaccgaagctagaggcatgttgggccggcccaggctggtggcgcccaaccagctcggtcctccatgtggacgctccagatgctctctcaatgacggttgcaggggcaaaatggacaactcgcatgggtacaaccgtcataacgaccctataaaaggaggagctcgcttcacttctcaacacactcaagcaagctcaagattcctctcatactttatattagtaatttagtgctaagtggaagtagtatagaatagttctcggagttctcggagtcttcggaagagtttcggtatggcttcagtagcttttctattctcttctgtaatactttcggaattaatgaaatactcttcctattatattttcggtattttctttagtatgagtactgctcttactttacattcgtgccgatataattgtgtgggtagcttaccagagatgtgcaatggtgtgggtttaatgtccggttcgttggttgctctatgtcatctgcagaggcgtatagaagtattcattaatgtaagcatgatgcttaggttagtaaatatcattaattgagcatatatgctacgggacagtagaggtgggccgctgatggtgatagctcagtacgtttattgcttctacgttagtatatattcctaaggcaaattcctggggagggtactcctttgtatttagccccagttgaacggccatgacaggttgtcgtaaggaactcggcaacccagggtggtctctcgaaacaccagtagggcactattagggtgtattggccacataattgtatactagcaaatgtagagtaaagtttgagtgtatactagaagtacaggaattgagttctttctatttctcttatcacttagttagaattatttatatgaggaattctataagcttcgcttcgtgtcactctacccttatattaaattaacccctgcttagactttgatgaaggcaagtaatatatatatgtatagattggcatggctctctttttcacaatcttcccttgggattaaacaaatacgataccttggaatatttccgggtgtaataatacaatggtatattcgtgcgcttgcggattacttctgtaaccataaatatgctaggactatttctgtgccattgatgggaataaatatttctagtaatgtcgttaagaaataccaacagctgtctgggtcgagggaaatgagagaagcaagttcgagcctagcgtgacaatatacgggaacgaccatacgaggaaatctatccagcctttctacggatgttacgatcccctgtcataccctctattcttccctagaggagagagtggttggcatcaaggtcttccaaaggacaaaataaacatgaggatgcaaacgtgcggaatggcgatgatcttggtaagtttatcttcaaactaagttgccttatagaatgataattgtgcgttacatgattgtactaacccagacgtttgtcacgtgtagaatgtaacagcaggatacaactctctataagggactagtacttcaataaattccaatcgcatcatgggattttcaatcctatacttcacggtgaacgcctgttccagcagttcgccgttgacatgcacatcatggttgagagctcccatctggactatgtgaagaacaaccagaaggagataagggcctacctatatcaaagggttgatggatagcatccaggctggggagagttgagcaagtgcagtctgcaaacggactatgctgctagcgtcgttcgtcggtggtggccgaaatatgaagcgtcgatacatggaggccatggccttagtacaaaactacaggaagccagatgtattccttataatgaccatcaaccccaagtgggatgagattacttgcgagcttgagcctggccagacaccacaagatcatcctgatctcgtggtctgtgtgtttcgagccaagttagaggacctaaagaagtagttgttcaagaagcacatccttagcaaagtcattgcacacgtttatcttgttgagtctagaagaggggtctgccacaggcacacttttttctgatcatgagtggtcgatacaagctatcatcttcggagaaatatgaccgcatcgtctcagttgagcttccgaacaagaaataatatccagagctatacaatatggttgtcaagcatatgatgcatggcccttgtggtcgactcaacggtagatgctaatgcacgcgagatggaaagtgcaggaacaactacctgcgagagttcaacgccacaacttcgcaaggcaaggattcatacccgttgtataggagacgtaatgacggtaagtgtaagggggttagaggacatcctctcgataataggtgggatgtcccgtacaatccttatcttctatggatgtacaactctcacatgaacgtggaggtttgctcgagtatcaaggcagtaaagtacctgtttaaaatacatatacaagggacaggacaagcctcgatatccataaacgaggtagatagcaacggtgaaatcgatgagattcagcgctatagggatgcgagttgggtgacccctctagaagccttgtggcatatatatggttttgacatatgccattgcatgtgccaaacatgcatatgttggctttcaattcagacaaggatctccgtgatgttcttgataaggaagacccaggcaggtcgatgcttacagtgtattgcgaggctaacaggcagcatgtctgggctcgagatatcctttattgagatttcccaatgtggtttacttggcagacggcaggtaagtactggaagaaaagagatagacggggcaaggtcgggagaattgtgtgtgcccacccgacagagggggagcgctactatcttcaggtgcttctaaaccacgtggcaagctccacctgattcgaagaccaacacactgctaatggtgtggtcatgtcatcgttccatgctgcagctgaatgaaggtgtattatagaggcagacaacaccctcgactagtgccttatagaggccggggtcttctagatgccagtgtcactacacaggttatttgctaatatatttgtgtactgcgaacctagcgatgtccttgctctttgggacaaacatctagatgtcatatctgatgactacacactattggagaaatgatctttgctgggtcactcaaaaatcacattagtcccgctttgagtaagaaccgggactaaaaatatatttgaaacacacaagtaattttttatctttagtcccggttagtgttactaaccgggactaaatattatttttactcccggtttaaaaacatgtgagagccctattatatttagtcccagttgtttatactaaccgagaccaaagttaaaaaaatagtgaaaatccctgccccgagccacgcgctacctcatcctccccgccttgtccttatcctctcctcttctcctcctcccctctcattttctctccacctcctccccctcccccttccctcctctgacgacggcgatagcgatagcgggcggcggcccagcggaagctaccgtggtggcacacgaggcggcagtggtgtagggccggcgtcctcccttccgccagatccagcgggaggggaggccgggcggcgacggcctggcggaggcggcggggcgaaggcggcttggcggcggcggccgggcggtggaggccgggaggcggcgcacgggcaggcggctggcggcgacgtgttttgtgattatttttgtttttggaataatttgtaaattttgttgtagattattttagatttgagcatgattttgtggatgattttgtggatgtgatgagaattgtggctgatttgttgtgcatgatttggggataatttgtggggatttgagggtgacaatatatgcaagcagcaaaaaaataaaggaaaaaaatgcctaaccaaccatgctaaaggtggctctatgatctttagacccgatataaagatctatctttacttctagttattttaaccaggactaaagatagacatctttagtgccggatttggcatcccggtttacaacccgggactaaaatggattacaaatcgggattgaagagcccttccctagtcgtgacaggcaaaacaacacatgctacaggcaatgggtaaggatgaaatagacgaaatcacatgatagtacccgagaagatcccagagattattcattttcccgagattcacgtaaaaaatgattgaaggaaaggaaggagcgtgaaacctcgtcgcctgctgcctacacaggccacgtgataaggcccatcaagattaggtccgatatattaagattagtcaaccgataatcactttccatcgatcgcacaactcgccgaataaacaacggcgacgccgccgccaaattcaccgaaaccaatctacaccaccaccaaacgatggatgcatatgcatcgccgtcaattcccccctcgccgccactgccgccgtcgccgacactgccactgccgccgactccaccgccaattaatgccgctgtcgccgactccgccgccgccgccattgtcgtcgccgctgccaccgccccaactgtcatcttcggcgcggccgccgccttcatacgatagaagcaaacactctcagcacagatatcgatcaattggtaagttaagcaccttgcttaattagtccatgaaaactatatagctatatgctctcctgcgatttgtgatacttatagcgggcagtacattagctaactactaaggttaatgcatggtactgtagattaatgtatggtactgtagattaatgcaagttactgtacattaattaattgaagcacctagctagccatccactgttatattataaaataattacgtatatatcaattgcattaatatatactcctacactagcttatgcgcagttctcaggcttggctctttacttatgttaggaaatcatctctcacgctcgcaaaactgagggactgattaatgtatgattaattaaatattagtcttttaattagaacaactagatttatatggttttataaaataactttcaattacaattttctttttttcataaaagcaccgtttataagtttgaaaaacgtgcacgcaaaaaaaaacaatggagttgagttgggaactccaacaaaagaactcagcataaaatcaaccttggccctcagcttattttacataaagaatacactgtgtggcatgattcaccaagaaaaatataattgatagctatgatcgagcaaattaaagcattgtaccaaataatgttacaatgatactccctccgtcccattttaagtacaaccataattttccgtgcctaactttgatggttcgtcttatttgaaaatatttttaaaaaattaaaattataagttatgcataaagtactattcatattttatcatctcataacaataaaaatactaattataaaaaatttcaaataagacggatgattaaagttgggcacggaaactcatggttgcacttaaaataggacggatggagtatttacgtacctgccaatggaacatggagtaatttactataaaaatgtataatatttattggttattatgctatatctttccagtgttatataatttccttgtgcaatatagatatccttgcttaatctcatgtggtactcaggtcaatcaagatgctgacatgattataacctgaccctcgaagaaagcaaaaaaatcggaatgtaagggtaacactacttatttttcgtctcaatctatttaattatgccaaagacttatatacaaattatttcaatcactaacatttttggtgactaaaatactaatgtgagctgatgtgtaactgaaaggcaatttaacttggcttaacaaggaaaataacgtcaaagaaaaaagtatttttaattttctatcactgatatccattttagctaggccatgcgtgtgtgaatgagtgtatatgcagacacactatattgatataataacgagtgcaataagatgctatgctgattaatttatgtactgtgcatgccgaaagtttgatctatgtgtatatggtatttacgaaatataattaggttccttgttttgtcaaatgcagcaccacttcagactgacgcattcgtccccaacgctcactatgccaagtggtgaaatagtctgagcaactgtcaaccagacttaggagcggatgcaaatatgtgtagtagtactcttacttttttactgttcatatcatccggttcatattgatggtcaaatattaattaattgtctgatttcgtaggagaaatacaacaagataaaccattacatggaagtgtcccatcaaactacgagcgttctgtttgaacttattaactctacttttagtcaaaattttatttgatagtcttttaatataatattaattatgatatcacatttttattacatgataaataatccgaggagcatggaggatccaaagtcagcatgccaaatattgatgtaccatcgaaattgatactatctatgtttggccagaccccagcgagtatctccctcaaggtacattattgtttcacatacttatctttggtacaatgtatctataacatcttgatacagaattccatatttgttttacagattatgaatcccattaaactacgagtgttcttgatataatggctcaattatcgattgaatattctactgaaaactgtacaatggtggacatgggagaatttcttgtctggaaaaatcacctaatgagccttctctctgaagatgaatttgtgaacgatgatgtaagtacaactacgcaacgttagaatttaattgccaagatattctttagtaattatagatttttaactgaatcaatagatcatcagtgcatacatacattgtatgagggagcaagcaaataacgataggaaagtgtattatgaaaacccttttctttctgacttgctgaaaggggctgaggtcaatggagtagacgaagatagtgataactttattacaaaaatagtgaataattaccttttcaatgaactggtaatatttggctctctataattgataggatatataatatatatatggtatttctaatggatgatcacctcaaattaaattactccatatgggtaattaactaccctaatgttgtgcatttgtgatatacacttaagaaaatctcgtgtgccactaaggatgttgctttcacactcattttgttggtacatcagtagatttagcaaaaagaaaatgtcttagctcgccatcatcctgcacatgtatttataagttaaatatttgaaataatataatataatatatgaatgatcaatgattgtcaggtcttacattaatagctggcaaatgtagttcttcattttttccatgtacacatcaagagatgaacaaaaaaacctgacaaattcctaaggaaattgaatagttagctacccttgcactacacaattaaatttactggtttgaacaaatttttaaaagataacttacctatcaagaaacggattattgacgattatttgcctccacaaggtgatgtctttattccacctagagctagggcatgccttccgcatagctttgttgaagtgatcagcaatagttaatagtttacgatgtatctcatgtttggcttatttttatattctataataagtggattagggtctcatatatagagtgttttaccttcttggtctagtatgaccacgataaagcttagagcatggcatagtggtatagtaatctacaaaagatcaacagtaaagataatataaaaaccacgggcatatcggagcaaatgttagcgatcttaccgatttgcattatgaaagtaccgatggtctttgcaacatctatgttgtcatggtggaccggggatttaccaaaggcagtagcaatatacatgattataaaataatggttcactaacataagctatatagaagtcaatat

SEQ ID NO: 5179 - DNA, 5004 bp, Oryza sativa
attaatctgttgaatgtagtgcaaaagcccgcttatcaactcttgtttacatatcgcagataccatagatatttgtgaactatattttttgttgacttcatgagtttcattgatgtcccttatagagttgaatttccattgacgattacccaatatcacaacatcgtcgtcactgtctttggtatcttcgctttgttccccggtagtcatgaccgccttatttgttttgcaacataataatacaccgggcactttgaacctaaaaggtgtaatatcctcctgcgcattaaaaggtaaatttggtttataaaaaatagataagatatatggtcaactatttttttttaacaaatgcacctgtgtaatagatgagaaagtgaatctcctgtccaattctccataattttgagcatgaacagtccacatgaagaactgtattgtttttaagtatgagtaaaactattaaaaactaaacaagagtacaccaattaaaatatatcattcatcttatattaatattacatgaaaattttaatataagatgaatgatatatgttaattggtgtactcttgtttagtttttaatagttgtactcatactttaaaacaatgtagttcttcatgtggacttttcatgtctcaaaattacggagaattggaaaggagattcactttcgcattctattacacaggtttttaataaaaaaatagttgatcatttatcttatctattttttataaaaacaaatttactttttaatgcgtatgaggatattatatactttttatgttcaaactacctggtgtattattatgttggaaaataaataaggtggtcatggctaccagggaacaaagcgaagataccgaagactgtgacaacgatgttgtcatattgggtagtcatcaacggaaattcatccctataaggaacatcaatgaaacaaaagaaataaccaaaaaatagagtttactactctctgaggtatctatgatgagtaaacaagagttgataagcggccttttgcactacatccaatagattaattgcaccgaagccacagagtaagcccgtgcaatacattttatatacacgtagttcaaacatgcattaacttgttttcttattgattggcaggaaagtatgggtataaagtttaaggccgcactctattagcttgagcctcaaatagcttcaatcagtactaaagaaagatgagccattggaaagtgattgcttcaacatggctatacgtaagttcatgtatgaaaacatctagacgattcaaaaaactaaagaagtaatatcaaatcattgcctggacttgcaattttgggtatgtttttaaaatctattgctcattttattctctttttttttgaccaggcattttattctctattgctcatgttattgcctggacttgcaatatcgaatatattgagttctctattgcttatgttagtgaagattttattaaaatcatgtatattgctagtggctttggtaaatccccagtccaccatgacaacatagatgttgcaaagaccgtctgtactttcataatgcaaatcggtaagattgctaacatttgctccgatatgcccgtgttttttatattatcttgactgttgatcttttgtagattcctataccagtacaccatgctcgaagctttatcgttgtcatactggaccatgaaagtaaaacactctatatatgagaccctaatccacttattccagaatataaaaataacccaaatatgaggtacatcgtaaaactgttaactattgctgatcacatcaacaaagctacgtggaaggcacgcccttgctctaggtggaataaagacatcaccttgtggaggcaaataatggtcaataatccggttcttgataggcaagttatcttctaaaaacttgtttaaaccagtaaatttaattgtgcaatgcaagggtagctaactaatcaatttccttaggaatttatctggttttcttgttcacctcttcatgtgtatatggaaaaaaatgaagaactgcatttactagctattaatgtaagccctgacaagcattgatcattcatatattatattttataattacaaatatttaacttataaataaatgtgcaggatggtgatgagctaagataatttttttttgctaaatctactgatgtaccaacaaaatgaatgtgaaaacaacatccctagcggcgcacgagattttcttaagtgtatcacaaatgcacaacattagggtagttctttacctatatggagtaatttaatttgaggtgatcatccattagaaataccatatatatatatatatattatatatcctatcaaatagagagagccaaataataccagtttattgaaaaggtaattattcactatttttgtaataaagttatcactatcttcgtctactccattgaccccagcccctttaagtatgtcagaaagaaatgggttttcataatacactttcctattgttatttgcttgctacctcgtgcagtgtatgtatgcactggtgacctattgattcaattaaaaatctgtaattactaaagaatatcttggcaattaaattctaacattgcttcatcataggtagttgtacttacatcatcgttcacaaattcatcttcagagaaggcacgttaggtgatttttccggacaaaaaattcttctatgtccaccattgtacagttttcagtcgaatattcaatcgataattgagccattttatccttttggttaattcacaatctgtaaaacaaatatggaattctgatatcaagaagtatcacaaatgcacaacattagggtagttatttacctctatgaagtaatttaatttgaggtgatcatccattagaaataccatatctagaaatgcttgatgttctataattttttgtttgtgctttatttgtatgacattatcaatttttcatagtagtcttctatctatattgcctttttataatttttgcctttaataaatgccatgagattgttttatgcgccaaaaagcttgcagtatgcttctgtaatgataacagatatcttgctttgaaattaatctactaaacaattatgatttgtagtttcttttgtattgccagattttttttccgtgatcaacaaaatttcctgttgcaatgcacagctaccttactagtaagtagggatgaaaacggatcggatacggacagaaactagctctaccatattcgttttcatatttttttcagaatcggaaactccggatacaaaaacggaatcgaatattgtcgaatacagatacggagcgaatatggtaacgaataattatcaaagtacaaaaacccctcaaaataagcttctcaaatcaaggaagagatatagctcattatttatctaaaacaacacttgtacaattcacttccaatgaaacatatcatgaaaaaccacacacatcattacatcaccacatctcaatcacttgcacatagaaatccatcacagataagctacatttgcacagcatacagttgcactgctgctacttgcatagttgcatgtgaggaatccatcacagatctacagcataacagaaaacaaaataatcagagctcaatatgaagtgatgaacctactgtaggttctagcagtgaaatgcaaaaaaaatgcaagagcaatccaatgaatagaagagagcgaacattcgatacaaacctgtcgagatgctgaatcgttgagttgagatggcaggtgtcggcgcgtggaggtggtgcggcggccggcgtcaccgtgtcggtgcgtggtggtggtgcggcggcaggcgtcgccgcgtggaggtggtgcggcggccagcgttgctgcgtggtcgtcgaggtggtgcggcgaccggcgtcgccgcgtcgccgcgtggaggtggtgtggcggccgagacagcgaggcgtcggcgccgccggcagagatggcgaggaggaagacgaggggaggtggagacgactggcgacggacgacggtggcaggggcggggcggcgctgcaggcgcgcaggacctggatgcgccgccgatgccgagggagttggggaatggggagtgccgcacgcccccacccacacagccactctctaggtctagggttaacctggctatggacttgggccgaaaaatatttgggctattaggctatggggagctgcggatatccggcaaaaagtcccggatagtttccgaccgattccgtgttccgacggataccatcgctactgtattcgaattcatatccgagaaaaactatccgaatccgtatccgattctgaaaatatccgaagaaaatccgactgaagctatccgtatccgaaaacaggttcggaactcggaaactatccgtaccactttcatccctactagtaagattaaataagcatacatgcccatataaatcacataattcagggagtttgaaaacctaagccgaaaacaaaggtgccataacctacagcccttatcaaagttgttaactactactccctccacaactaaatattatggacaatttcttttttcaaaacttagcctcaaaatatttagtatagaaacataaaatttttatgggcaaaaatttttattacaagtactttacactatctaataaaaattagtagtcaaatttgcacaaaatctcgaataaattcaactgtgccatatcctatcttactataaaaatataacctattaaatcctaaaacttaacgtgtaaatatgccacatcattatgcaataacaagataccacataattatccactaacaattattacatttttaaacatcatgccaacatgctataattttataatttatttaattttagagttttaaaatgcaatcatattaaatcatcatcccacataattcacataacacatatagctatatagttcatcttttttttttgtaaaacttagtacattattctttttcaat

SEQ ID NO: 5180 - DNA, 16996 bp, Oryza sativa
tagattatcataaactacatcaatttacgtaagtttatgttgtctagctatgttatgcattatttgtacttattgttatcatactaaactcacacggtaaaacgcgggtttcacctagtactaaatacttaggtcgccatttctcccctaaaaatataccactccatccctctaaaaaaatcactcagagaacccctaaactcaattcaacgtgaaaaaacagtcacagaaataatttgaatctctcgatccaattgctaatgcataaacatgtgaccaatattttaaaaataaagaggtagtactttcatgcttattgtgttagacacaacattttctcttatactcattcatcttattatcatttttctgacttatttatcattgaaatacttggagcacggcttatatttcaaacactaaaacgaaggaaatatgtattatatcttcataatatgattatctttgaaatgcatctgatcgatttttttagcgcatgatatcgtttggtttatgatatggcttgccggtgggaattaaaatgtagttgttttttcatgaaacgtcgaaaacctggttttacattagagcaggttttcatatccctggattgcccactctatccaaagaaaaaaacttcttctgattatgctgaaatgaattcatcaaatctagttctagcacaacttggggttcatgcaaatgcttggagggtatacattgaaccaattaaatgcttgatcctgaaaacatggagaatatgtaggcttaaaccaaatggttgttgttaaacacaaagagttccggatggctcccattcatattcatttttttttgtctaacaaagagaattggtgtgccagacggaatgttatggaatagttagtactagtatacatctcacttgtatagtacaggagccccttcattttatttaatacgcatggccaataaatttgtatagtcatatacgaattgtgaaacaggaatttgatgttgaagatcttttttaagataacgggaatcctggtcttttcttattgaaactacaaccaattattacataattctcagcttataaggctatcaaatccttaaaaaagtcaaaataatttcaaacattccaacttacaggacaagacaacataacataaacattccatccataggttgcataaatctgtataaaccatttgctctaattaaattttgtcatgtattttgcatctctcttctagcgcacatttgatgttgaagatatgtacgttcaactaattttcagagaagcttcttgtgcttatatatgtaggtatggtgctatataccgaagttagtactgtagtatattagtagtattcaacatgattatcaagactcggtgatattatttttttaatgttcgctaccagtctcatgtcattttttgacgaggaaccaaaaaatctattatgacgtacgaggccgtattatatttgaactggtagccaccatgcagggattgattgcaactaaacaaaatgcatgttgcaatttctttgatagtgatctttttccgcgtatggtaacctaggttaattaattgatacgaagtaagctgatacacacttctacaacatactgtctgtgagtagtgaatcatatgatacggagtacgacacacacttctacaacatgggtcacaagcaaacatggttccttgcagatgcctacaagtgtgaatatgtcttctgtgattcgccatacttgcatataagtagttccccatggctcccaagcatattttttctatgaaagggaacagcagtgttgcttggagttgtttgcattattttcacttattcctgtaccacaattatgcttatatgggctccccaccaccttcagttgccccggccagtgacacacatataattagaatgcatgcaaagatttaacgcatacaaacatatataatatataggatgtatcacatgctggagatgaatttctgtactaggagtacaaggcattattcaattaattaatttttcatatcaaatctcgattgcctgagctgcctggttgtacaaaactgctgtaatgtagcaatattcaattcaatgtacacaactgttccgttgatgatagactgatagttgatagagctgcctcttgttgcaagtgattcccttgtaataatgcaatctaatccatatttactaaaaggattaacatgaaaagctccaccaattgactaagaaataatatattttatttttggctctgcctcttcataaaaactcgacttgtacaaggaagaccgccttgcagtctgtcattatgaagaaggctcaaccagacctaccaagaaaggctaaaaactttggtccccacacgtggccttgtctcttatggatctgtttttaacccatgttttgaggccccttcctcctacataagggaaagtccaccatagtgtagctcactacgaacgccaccaccactgaccagcagcagttgcatcagaatctccgcacgcttattcccctaccaatctatctacaaacacatgggatcgggcaaggcggatcttgctagatggatctgggtatgttggggaagaaggggatctaatggaaaaaaaaggaaggggttcttagatcggatggacgacaatggaggaggagggagttaccggagaagaaaaggacaacagcgagggtggcggtggcaacgttagggaggagtcgtgaacggatttgttcaagatgcggtccaccggcggtctatggggaggggccaatgggagtaaagagggtctcgaggtgaacggatttgttcaagatgcggtccaccggcggtctatggggaggggccaatgggagtaaagagggtctcgaggttgccttgagtttgtccggggattgaagcccatggctattctaggcctggtctggatagagagcagggccgagccatgttgggttggcctaggctgttttcacatagctgaattcgaaaacaaactctagtataatatttttttttgtttaattagatcattgctatttatctatttgaaatcatgccattacaattttataaatatttgagacatgccgctacttactgtttcggtgcatttagaaaaaaaaaattgaacgagtttcctttcccctccctcctctttctcattgatttgtggttgtttcaatcggctttgtgtttacaaggccttctccacgtctaactaggcttagagatcaaataggagttaacaaatcctgacatcagacaagaaaatacgagaattacctaaattggacttggactcttgatcctgtccagtcctacataaggtcggttcaaccttatgccgtaggtcggtttgtcgttatgctaaagggcagtcctacttgcatgatggtctggtcgtacaattaatgtcggtctggccttgtagagaaggttcaggtttgttctctaatttgaccaaattttgcaatactttgatcctagtatattatttggctatcaacagtaacatagtgccaatgaagtatttcatttggatgctaagaatccttttgaagatattttttttttctgttgctatataaaaacaaggggctatcttaaccaaggataatcaagcaaagaggaggtggaaaggtagtctaggtttttgcttttgtagttatacaacatttcttctttgattcttcattggtaagatatgtttggagtgcaattttcatcacttttggaatccaacgacctaataatgcttcttatctttttggtagttggctagaaaactaactgttttttactagtaattttcaagaaatgtattggacgtggctctagtcacttctacttagagaggatgatggaaacctgttaaagaaagtgtgcaagttgttctagatgtatggttgaaaaacttccacgagagattagaagcataggttttttcattgttttgtggtgtttggttatgtcatgttgcatgcctccatttgtttggagagagggtctcagtatccatgtaagaacttttggtcctgttggatgtagaggtcctgatttatttcactatattgaaaaagcctgtctatcgtcttttcgtaccgagacaatggcacgatttttacaattttggctggatctgttaattccggatgcacgtttagtgtgggctttgacgcggctgcactgtggaacaagctgcaataacgcagcgcatgctcaggaacacgatcgaaacgctgggatttgctgatgaagaagaatggattgctggaaatggtacttgcaagttagacattatccacggatggcgggtcgcatcggcgtccacgtccaaccgcggctcagcaggagccagatcggcaaccacgagttccctcacatgacgtattcccggtgccttccaagcttaaaatgtaaggagatcatcacagagccaagcataggcagtgcgagtgccttattcgagaggagttagctaggctagttagcacaccaacttgtttaaagtactcctggtgtccatttcgaattagtacagtccctctgctcctgcctatatgtgtataaatttacgagctttcatgtcaaaatgaaagctaacacaagcttagtgccgagtggttgtgataacattgtcgtgctgcaagccgcttcatgcccattttaattttcggaaggcctccttgtgctgatcgagctgcacatggctcactgacaaccatcttcttctaggctggagtagattgcaacggagcttaaacaattaatgttgtaaccgtttttttaatataataaaagctttattgatctcagtcaagttctgataatactcccggcctctgcaccatgacaatgcacacaactcacaaaatccaacacactcacaagaagagaagaaaaacagcatccaggatcaaggccctactacccaaagactaggtcgccacccatttgtcagggtaaaaaactccttaaccacttgctccaaatatagacaagccgaagtgacaaagcccttcaaattgtttttctggagaataacctatgatcggagctaatgtgtaatgttgtaacagtacatgacttttaccaatgtacagctacaccaaaagtttcatgctagtaaaaccaaatttaggcttaagctgtgacacaagataatagagtaccattattgcactattcacagtaataaaatatacatatcagttcgcgtgaacgactccacggcggtagataggtgtccattttctttaattggtgggatctagtggggctcactttaacacctcccactcacactaaccatggtgaagagagacttaactagtactgtctacactggccccaccttattgttcattgttcacacacacattggcatgccctatcaattgtgggccacaagtacaccgctgcaatcttgtccaacgcaaacaattatgttcggtccgaccagcatgggcagcacattaatttggataagctataaacgcactttgtaaatataacttgatacaataaacctgatctactttcaagagtttcatcgagacgtatttttataaaccccaacggttagaccggcatctgatgagcggtgtaaacagcggcagggaggtggctcaactgacagcaaggcggtggtcagatcggcaccgagcgtgtagtcaaactgctggggatttttctgtgtgactattacaattttgtctagtttgtttctttttatatttttatcattcacccttctcttctagacttggttgttgtgttcgatcctatagaagtaggccaacttcccgttgtgcatctcacgcatgatgtcctccattcccgttgccgagccttatgcgtgacaccatgtaccgccccttcctccgcatcgctacctactacataatgctgcttcgaaccgccgcatgacaccagaactacccattacagatgatctgtgatttacgagctattacagatgagctgatcattccccaaacccctatctactacatgcacattaaccaaccattacagattagggattaaaaccggtttcctttgatccgttacacatactagctgattctatagtggtgtcagcatgcgtcgatgatcaggaatgatcaggaatgcaggagaagcctaccaaatatgacaacaataattggcatgtacactgtggatcggattactgatgcatctcaacccctttgatatatctctagatcaaaccttttagcatgcatgagtgctagctactctatctagagaaccatgcatatatgaatcaaataaatggcacaaccaacataatttctctcctaatccacgaagaggataaggatgagaatgaggatgcagctagctttcttcgcaagagaatgagaataaggatgagaatgaggaagaagaaataatggagggcccaacaatgcatttgtaccatttgatttcaatagagtaacatgatgatttatgagtgcgtaagtgtgctgcctaccacttacaaccagggttggactgaaattcagtcatttcggtgacccccgatacgatattaattcggccgaaatttttgaattttttcatgaatttggataatatttattcaaattcaactaaattttgtttaaaatttcaaaaatttcggaccaaaatttccgaaatttcgggatttcggtgacccccaatcaaaaaccctaaaccaatacagtgaaccctgcttacaacttttaagtttcctttttctattaactataatatcatacattcacgtcatacaaaagttaatctgaaaattaagagttttgccaagatgatgcgaagtcgctggtgatagattgtacgcagacatggtcaaggggggtcagagtgttaaacgtcaggatccggaattattcaggacagtgaagtggccacaagatttaaatctctccgtttattttcgagcgatgtcgaggtggtcagagattagtaatcaacaacacaaaagcaaataaaatggactatctatatatctttgatagaaattagagcaaaaaactgttagtatttttcccaccgcaggatatatgcacaacgaccaggatggtctctgtgcacgtgctatatttgaattgtacagcctgattatcctactttaccaaaatcaatcaatttttgagacggcatgattaacagcaaatttattacataacaaatagagtaatcataaaagccattaacttgctaattactacgtcaaactagcttactagaaaacataacgtaatttattttccatttgaaaattgaaaataaaattacaaacaaatctactcaaagttgcattgtaactataatgctataatgtaactatactgtaattttttaggtacagcaaaactacattatagttttttcttttggtgttatctctgattctctgtgtacagtagtctagttgctcaagtattctcttgttgggcagcgaaaaatcttcacggcggatgaggtagagaatacaatgctcctgctagagtccgtattactaacatggacatagagtttaacgattgccgtgtgaaatgtgaggagttaaacttctgtatatagagagggcaaacaaatgcacaaatcataactcatatctaagtaatcgatagtttttagcaaaaaaaatatattgacaaatttctaacagatccgaatttattctctgacgcaaagcttttaacattgttgctatttttatgtaagacttttcgattggatgaggcaaggtgagtcggcacctacccactggatggttcagatagaaaagaagaaaatgaaatgaaatttccgatacatgagttgattcaactctgaaatcacattataatctcaaacgagaataattttatttctgatacaggctcttggggcatgggttgatgagttcatgaacacatatgacatcgaccattggaagaagcagtgcgaaaggcaggcacatggcatcgagtggatttatctcggctgagactttctcaggaactccgtagctccggtgctcacggtggatgttgcttggttcatcgcgtagagacatgtgaccgtcaacgagatgcgtgcagacattaaaagtgtctcctgatctcgacccctatcaatatctcaccttgcatcaaagatttccggtgtcttccaagcccaatatatatggataaaggtcatcgagcattagcttgcatgtcactgacaaaccatccgtagtgcgtgttttgtgacatgaagctgtaggggcgccaaaattatgtactgttcatctctctgccgttgtataagcattcctgttgaaaaaaaaaaaagagtgaggaggttgcacactagcataattaatttcagtgtagatcaacgacaggcagctccatggatatatattgccatccttcttaagtttttggatgagaaatataaatgaatgttattagacatcgcaattcctttgaacaaaaatgtaagagattaaactcatttttttatcaatccacttgattgctcaatttaggctagaatcagcccatacagattcaatttgtttttatttctaatttaccaaaaaacattccatgctcatcagaatgtattctcgatttgcaaaatttcaatatatttattgtttcaaaatttcgctgaaacaacttaaacaacggaagatcagaagcaattaccagtctaattaagatattggtggtaacgggtcccaaccaactggttctttaatgttacaatccaactcaatccttttgctcaacaatctctacaaacttaagcctgccctttttacacaacccttaaattttaaattttgtatgctaagaagttaggccaataactcaaccacccaactttaattttgacagaagaaatgctaacatgcatcttgttgacagaaataaaggaaaatattttgtcttttttcgaccagtccacttcagcacacagtcaaacgaggtcaacatacgggatttagaactgacgacaagaaattcttttagacagctcttaacttttactgcccgactttttagagaaagataaaatccgaccacacagagaaacatcttcctatccagaaaataggcaaacaaactcacacccagagaaacatactttacatgcagaaaaataaaccctctagtttctagatcattaggtagaactaggaaggtagcccgcgtgaatacgcgggtatgcgtcgtacattatgtctgagacacttataagagcgaaacatctaccatgatttctccataaattgttttcgtcgatatttaattttataattttctaacctattagctttatattatactccctccgtcccattttaagtgcaatacatgagtttttgtgtccaacttttattgtccgtcttattttcatttttttataattagaatttttattgttaagagatgataaaacattaataatactttatgcgtgacttatgcttttaaatttttttaaaatttttcaaataagacagacgatcaaagttaggcacggaaaatcatgactgcatttaaattgggacagagggagtattatatttaagtaatatttataagaaattatttataatcttcttcatcatttgaaaagaatgtatacttattttttttagaaaacatgtcaacgaaaagtaagtgtaaagtaaaattaagatatttttctttttttaattgcatatatattatcatggtttattcgaggatgaattgggtgagatatgaagctccactaaatatatgggtttatatagcttaatatgattgatgtagtttgaatgtcggtccatctatgaacatttcatgtagagtggataagaggttccacgcaagctaacgttaatacgataacgacgaaatataattgcacaataatacttctgaaatgtgacataccatgaatacacgcttgtgttttcttttataagattaatctaacggttagaaataacagttctaccggtttaaaaggtataggtgtactccaagaatgtagcttaaaaattatggttgtttaaatatccaacattattatgaagtgaacgtagctcaaccggttaggttccttgtgatggaacttgcccgagtctagacatgacaaattcttccagtggtaggcgacgtacctgtcgatagcgaggtgtacgtggtgacttcgtcaatctcaaaatatatcagcctagtctctcagaagtactcataggggtatttgtatgtgtgtgttcaaagatatgggtgcgcgcgcatgtgtttgtactttgtttaaaaaaatttcaaacattatttctcttttattttagtagatacaacaatagggaggggacgacagtgttatatacatgtgagggtgagggggaggtgaagattatatttttctattttttctaaatgatttatgtgaaagccaatgacaaggtgtttcatttttttatatgaatttttaaggttttctccattttttataggacgtgacacactgtgacttaagatttttttttaaaaaaatagatttaatcgttaaaaataatggacaagtcaatttaattgttttttcttataatttaattacaatatctaatctaatggtttattatagatctagtttacatgcatatacttctgtatatattatgtagtattatattttatctttttctatattatacaaaatcctattttagaccatagttttttccacgggtactacgtacgcaatttttttttgggctttatcattttttatcatacatagatgtctatttttttttcttccagctaacagtaggaagctttatttgttattttaattgcccagccaccgtttgcatatctttttttaggaaaagttatcaccattttaataataaatctaatctaatggtataaataaacgggtacaccaatttaagtgaaaatcgatggtgagattagatagtgccacatggcggcctaagagtatttgtaggaacgccacgtggcggtttaggagcgtttataggaagtttaattattcctagttcactatcggcaccctcaaagacgattgcatcggtaattagtaagttgagtactattatcaattctggcctccattgggccagtctcgactcaaccatatgtgatgaggacatcactttatcggatatgttcataacttcacacgttccaatgataattcctagtccaagtccagttcggccttcggagacagcactgactttaaacggacctagcgccttcatgccaacttcgatttgggtgatcttggacttcatggaaagcttatctcgctacctttcaaacgcatccggtctcatgtccaaattcatctcgagatgatggaaatcgccaaaacaaaacagtgctgttgctgaaaccgaacttgggccttgggctttgtaatagattagacccatctcggaagtgtctccctccacctccacgaattagcacttaaccctagctttattttcctctataaatagctttgtacatcctcaaaaacaattgggttttgtttagttgaattttgccaagtgacattcaccttgtctctagtcctcgttcgattagtcggcgactttagattcagagccctcaatagttggtgtcttgatttgccgggtcgattagatctaccacttcaatcgcaactattccttgtgcttaatcacctattcacaatatttagattgcatcttatcttgttcttgtagtgttttctcgtttacattgcagggatcatcaaccccgcgtcacggttagtacgacatcgtttgtggtgtagcaattgcacggcgtcctggacttgttttggttggtagccacgtcgcaaacgtcgcactcgatcaaagctagagttatcccctcacccaaaagatcgggccacgagagagagcgtcatcagttggtatcacagcttcagttgcctggtgaggattttagttttatagatttattatttttcctacccatcacccacaaaattgccgcaccactttttccatctccaaacattagttttgagccttgcaattttcattcaattttgctttattgagttttggtccgctgtcgtgtcggagtgctcactggtggagaaaccatctttcgtcgtacggctgatttccacaatagtcccggatgcaataaaaaccggggctaaagatgatctttagtcccggttcaaaagggtaacgggcatatttgatctttagtcccgattcgaatgctatcagggcatgtcaggcccccccgggaaagatcgtaactttagtcccagttggtattaccaaccggggctaaagatcctggtgatctttagccccggttggtgctaccaaccgggactaaagtcccacccctatatatatgtcttcttcctcctccagctgcccgagcaagcttcaaaatttcttcaaaaaagaggagaggtcatgccaaaatttttattgaatttattttggtgattacatacaaatcggaggtgcctaaaaggtttgcaacttcatcgtccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaattagtttaaaactttacaaatagtttttaagaattatttggtgtaatattttatgatttttgtatgaataaagatatcatataattattgtatgactgtcattattgtaagaataattatttgtgtatggttttttttgactcatgtagatgaatcggcaatggatgtacgctgaccagcggtccaaagagtttattgacggcgtgcactattttttgagggtggccgaagctaacaggcaaaggggttttatttgttgtccatgcaataagtgtaagaatcagaaggagtattctgcatccaggactattcatttccacttgtttgagtcggggttcatgccaagctataattgttgggcatcccacggagagcaaggtgttgaaatagaagaagatgaagtggaagacgacaatattccggactttgctcagtatgttggatttgaagaaaatcaaacgggcgaggaggaaatagctgctgatggtaacgatgttgcggatgatcttggtcagatgttgcatgacgccaaggaggactgcgaaagtgaaaaggaggcccataaattggacaagatgttggagggccacggaacttcgttgtacctaggttgcgagcaggggcacaaaaagttggataccactctggagttcttgcaatggaaggcaaaatatggggttagtgacaaggcatttggcgatttattgaaactcgtcaagaacattcttccggggggaaacaaattgcccgagacaacgtacgaggctaagaagatagtctacccgttaggactggaagttcataagattcacgcatgtccgaatgattgtatcctatatcgcggtgaggagtatgagaacctagaagcatgccctgtttgcaaagcactacgatacaagattagacgagacgatctaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacattgacagcaaatttaaagaatttagaaaggacgcacgaaacatacggtttggtttgagtacggatggcatgaatccttttggagagataagcagcggccatagcacttggcccgttacgatgtgtatctacaacctcccccctggctatgcatgaagaggaagtacataatgatgccgattattattcaaggccccaagcaacctggtaacgacatcgatgtgtacctaagaccactggtaaaagatcttaaacaattgtggaagaagaaaggtgtccccgtgtgggatgaggacaaacaggaggagtttaacctacgagcgctgctattggtaatcatcaacgattggcctgcacttagcaacctatccggacagtccaacaagtggtacaaggcttgcactcactgtatggatgaaacagaaagtatgtatcttaagcactgtaggaaggttgtatacatgggtcatcgtcgattccttgcagcaaaccacctggtacggaagaaaggcaagcacttcgaacataaggccgaccaccgtacgaagcctaaacatcgcagcgggaaaacagtgtttgctatggttaaaaatcttaaagtagtgttcggaaaggggcctgaaagccagcctatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacgcaaagtcaaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcatgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcaattttaagttgatattccaccttcatttttcaatataatgacgcatctgctttgtcaccttgtcaaagagatccgtattctcgggcctgtgtacctacacaacatgtttcctctcgagaggtacatggacgttctgaagaagtatgttcgtaacggtgctcgtccagaggcaagcatcgccaagggttatggaatagaggaggtcatcgaattttgcgtagaatttatcgaagaccttcgcccaatcggggtacttgaatcactccatgaagggagactacggggaaagggaactctcgaaaggaaagcaataatgagggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccacgtggctacgacaacatctcatgggtaacgagtcgatcaaccaacaacttgccttccaggcgaggggaccgtctgggtcgatcgcgacattccagggatatgagatcaatgggtacacattctacacgagagcccaagacatgaagagcacgaaccaaaacagcgttgttcttgtcgatgccatgggacatgatggaacaactgccacgtattacggtgccatcgaggatatatgggaacttgactatggtcctctcaaggttcctctattccggtaccaatgggttaggttgactggtggaggcgtaatgattgatgacagtggtatgacaactgttgaccttaacaaggttggatactcggacgaaccttttatccttgccaatgatgtaacgcaagtctttttcgtgaaggacatgtctagcaaaggaaagaagggcagagggcctaaagagcctaagcgtcaagtggttctcccaggcaaaagaaaaatcgtcggagttgaggacaagactgacgaggattacgatcagttggatgggcaaccccctttcacggtgatgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttagatgtattggttatccatataaatcaattgatgtatggcataatttactatcattcatatgctacatttaattgaatatcattcatatgctaattataattgactagagaatttttaaaagtattaaatcattcatgtggcatttacagatgttaattagagtttttcacaatttaatttactatctttcatatgctacttatatatgactattcttatttttaaaaggtttaaatcatgcatgtggcatttacatatgttaattagagtttttaacatttaatttaatataattcctacgctaagtatatatgatgattacaatttttattaattttaaatcatgcagtatgtacatacaaatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtactttaaataatgttaatacattaacttctattttagaaacacatatgtaagcgaaaataatatgcagtgctataatctttagtcccggttcttaacccttaccgggtttaaaaagaatttggaaatagcggaaaatatctttagtcc

SEQ ID NO: 5181 - DNA, 8853 bp, Oryza sativa
  unsure (1)..(8853): unsure at all n locations
tgttaacgaacacgtgaacgagaacgaacacgtcaacgtacgttgccgtgagaacgtgaacgagaacgagaacgatcgaacgaacgagagcgagaacaagaacgatcgaacgaattaacgtgaacgagaacgacaacgaacgtgaacgagaacgaacgtgaatgagaacgagcgaacgaacgtgaacgtgaaatgcaatatatatatgttacttctcatttatcctaatacatattttttgtatcttgcagaaaagacatgttgtcggagtcgtccctcaagccggagtagaagagctagccctagaaggaattcgtgcaggcaagtgacgtaataatataaatgattgttatatttgtaatgcaattaagaatattagacttgtaattagacttagcatataagattgtgtagtgttctaattttatttgagttttaatataagattattttattgcaaattagacttagtatgtaattattgactacagaattggttcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattattttattgcaaattagacttagtatgtaattattgactacggaattggtgcgactcctagcagttgactattgtagtcttaattagacttagcatatacgcacgaaacacttagcatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgcggatccaaaccagtacttgaacgaggaagggaacgtggagagggatgcggaggggaaccagcaggggcacgtgaaaagggatgtggaggggaaccaggaggaggaggctagtggtagtcaaccctccgttggacagaagagggcacgcaggcaatgaggtgcagcgaagaagcttgagagtcggcacatcataacggaagtggaagaagatggacgtcctattgccccggccgaagccaccaagaactatttacgtcacagcggttgggttgtgcgggataacgtgcctgttagtacggtgtactggcaaagaacaagggcacgtggagatcatgagagctttgtctcagattcggagaaagagatgctgtggaccacaatgctcgagacattcacccttcccgcgggtacagaggacaaagtgaaaaggtggactctgaagaaaatggcagaacagtttcagagcttcaagggagagctgtacaagaaatatatcctgaagaggcagacaccgaacttcgacacatttccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaaccgccaattggccagaacgatcgaagttctggtactatgctcacggtggaacgctcaacctagctgatggctcactggtcttcggcgatcagatacgagaggctgcgcgacgactaacagatacagtggaagcctcgtctcagggcacgttccgaccaaacagagatagggacgagctgacactcgccctgaagactccagagcttccaggacgaacacgagggaaaggggtgattccttggaagattggtttcaaggtggacatccacacgtacaggagtcggatgaggagtaagagagataccgaggcgaagattgcagatctagagttccgggtatcgagctacgaactcagcatgcaagaggaggtggcaaggaaggttgatgaacgcatggccgcacatcggtcccatgatccccagccgaccattcctcctgcaatggtgagcccgtcaggaaaccgtagcagctgcgcctcaacagggcaggtaggatcatagagcatggacgctatgcaaacacaggacgaatcgacctgtcccgttgatgacatcactcagcggacaccatgtgagctgcatattccttacaagaacttatcaataaagataagctcgtagtttatatattttaaatttagccattccgctagttgctgcttatatatgttgattactaataaataatctctcacaacataaaggtggcgtcgggcatggccatcccaacggacccttcaggtacttaccactgcaggccgattccagcaggatactcgaaggtcaaagttgagttggtcgaaggcgcgtacgaggacctccagctggattaccctggaggagacggtgagacgcatctacgagacacaagccatgccattattctatggcgcaggcggtacatcatcatcccttggcgacaagcggcgtctcgtgcaccatctcctccggctccaccatcaactcctcaggatcctgcaccgtctcctcctcattatccgccagcaccgtctccacctcaggctccagcaccgactcctcctcagtatcctgcaccgactcctcctcgggctcctacacctactcctccgcaagctcctcttttggcaccttcaaagtcaagggccctcccagctccaccgcctgcccccacaagggcaacgaagaaggcgaaagttgacgccgccaagaacaaggacccggggtatgattgcacgcaagaggagcttgacgctcatgtggcatcagaagtcaggagacaattgaagcctcgaagtccagaaaaaaagattcctatagacccgagtgtcaggaacttcttcaggggtatgtctgcacctgccaaggaggccataaagctattgaactatgagcgaaccctcaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccttacccacacaaatgtacaagttccatcagctttacatggagatgagcgccaccggtagagagatgatcgaagcgaggatcagggacacggacttcttgcaaggagatgacattctctggatcaatttcaggggaatctacgaactataccagctggacgccctcgacatctctattatgagttgctggattttgtaagtatgtcgttcagttagatttcttactatacgtctcctttaattagttaggtccttgtatataagtagactatagaaaataatatactcccttttatcattgtagaatggagattcaaagggcccgacggcggagggttttcgatactggattcatcgacactcggagagtaaacgtcgcaatgctcgaccaatatccacaagaaacagtggacaatctcgtccatctcctgaaggtgcagcattccaagacgttcatactgttgccgtacaacacagagttagtttaattttactgtcttcctacataccaaatttcattcccgtatgaacttgctaagtgtttcatatgtaatgcatcccacgcacattgcaaattccactgggtgcttttactcttcgacctgtcggcctgcaccgtcaacgtatatgactcaatggataaaaaagagtctacgtttgacaaggtttatgaacttatagataggtaccgtcataagttcctctgttaattaagaaaatcttgttatgttaattgctactacgaatcatagctttaaactccatgtagtgcttggtatcggttccgtcatttggtccgcggcaaatggagagaaagacttaggcggaagttcaaatttcctgtgagtacacatgctctacttttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgtagaccaaatcatcaccacaagagagctcgatgtacgtacaaataaattcaaaatttcattacgtaacgatttcttgtttaattgctaatcaatttcatacattcatatagtttattcgcatgagggataacctgactacacacaaggaatttatcgcggcggttcaagaacaactcatgggattcatcaacgaagaaatacttgatcccaagggtgaattctactacgacggaaacacaattcaccggtccttagcttctgagctagcagcgagtactactactacgtcgaaatcgtagctagctaggacatataatggattgtaattaatacatgactacatatgtttctatatgcatgtgtacacattttctataatgtaaatatattttggncatatatatatatatatatatatatatatatatatatatatatatatatatatatatatatatatatatatatatatacacacacacatatgcatttgcataacatatatattatgcatgtacttatgtacttatgtactgaaccatatatacatatataatatatatatatatatatatatatatatatatatatatatatatatatatatatatatattgaatcatatatatgcatggtttatatatatataaaccatgcagcaacagggccatgaaaaaaaaaaaaggtcagctcgatctttagtcccagttggtaataccaaccgggactaaagatggctcagccacgtggatctttagtcccggttatttcacccgggactaaagatagcgatctttagttccggattggtactcccggtttaaaaaccaggactaaagggggttacaaactgggactacaaagggtttctccaccagtggctggttctagctatagattaatcttggttttgagtatcgcatttgttgtctagtctatgatcaatgtcaatctgtgtgttgccgaaaggaattttttttatctgacttgtttatgttagcagatcgagtctactcccaaaaaaacgcgtggtcacaattcgagtagtaggtcagaaggcaagtcttgttcgcttcctaatttcttgcgccaacagaacaggaaagaccgagattttcttcctgtgattttggtttattccaaaaaaaaaaagaaaaaaaaaagagctgctgcgtgcatatccatgcaaggaaatttcattccagtgctagcttgagtcttcttgtaatttaattagccggttgttccatttgatagccgccacttgttcaaagaaaaaaaaagaaaaaaaaggcaggaggtgcaaaaaaaagagagaaaaagagccgcaccaaaaaaaatcagaaaaggaaaaaaaagaaaaaaaatcagaaaaagaaaaaaaaaagagaaaaaaatcagaaaaagaaagtgtggaatttttttgttggaatcttggagagagttgcttactatagcaagttgtggattgttcgactgtgatcatttgcttgcttaagttaggattgagtctagactacggcagcaattttgactagtactttggactagtattcaatttcgcaaatctgtttgatttttgctattccttgtgatatagttaagcctatcaagatccacatactactaacctttacaggtccggctttgcaattgctccactcatcaagcgtgtcattgtgccacgaaccagccacggtgattgacctgttttgcattctttgagaatattataagaatttggtgtatgcttgagtgttgagtgccttcaaaagctccacatatctatagattgttaggaactgatactttcttgtgagtttcttttgcttgctaacgatgtcaggtacaagttccaatgaaccaacactggagaatgtatcgcataaactgaagggcatggaaagttggtatgaagagttgatgcgtaatagtaaatcatacaaggaaagcatagataaacatttaaaaaccttaagtgaaagcctggtgaaagtagtggatcaaattgagcaaatgaatcgatcacataaacaattaactgaaaacattcagaatatgaatattggacatgaaaatattgtgcgacgcattggtttacttgaggctgcaggtgaagaaggtgcaggtgccactgctcatcgacaccaaagatatgacgatgaagacgaagagaaatatgttgctgatgatgagtaggaagacgagagtgttggaaatagaagacgatgtcgagttagggagaaagatgattatttatctaaggtaaaatttactatgccttcttttgatggtaagtttgaaccttctatttatctagactgggagctaactgttgagcaaaaattctcttgctatgattttcctgataataagaaagttaaagctgccagtagtgaatttacctcctttgcatctctatggtggaatgatatatgtggtagaggacttagacctagaacttgggatgatatgaaacgtacaatgaggtctagatttgttccttcttactatgcttgtgacatgttaaataaactgcaacttttaagacaaggtcccaattctgtagaaacatactatcaagagatgatgattgctttgtcatgctgtgatttgcaagaaactgaggatgctagaatttctaggttctatggaggtcttaatagagagattcgggatattcttgaatataaagaatacaataccgtgaatagattattccattttgcttgcaaagctgaaagagaagtgcagggacgcaacaagcataggagttcttttgcaggtgctacttctacacgacagtcaacaccacgtcaatctactgctgcctttcgtccagcttcttccacaccacctacctccacgccatcccatgttcaagaaacaagcaaaaatgcttcaattcagactctagccaagagtgaaacttcagtagtttccactggacgtacctgtgatactacatgtcataggtgccatggcattggacacattgcatgtgactgtccaaatcggcgagctctatttgtgaacgctgatggtaagtatacttctgctagtgattgtgatgatgaatatgctttagctgccactgaccatgcaggaggacaagataatgatgacatcgaggaagtccatttgcatccagagtcgctagatcagtatcctagcctaattgtcaagctagcacttagtgctaaagagaagtgtaaagagcaaaaccaacgtcacaatttgttccaaagcaaagttcttgtgaaaggccataccgtgaaaatgattattgatagcgagagttgcaacaatttagcaagtgaagagatggtcaagaagcttggcttgactacccatccacatccacatccgtatcatattcagtggtttaatacatgtggtaagatgaaggtaacccgcttggttaaaatacctttttctataggctcctaccatgatcaaattgaatgtgatgttgtgcatatgcaagcttgttctgttattttagggcgaccatggcaatatgatagagaagttgtttttgatggtaggactaatacatataaatttatgttcgatggtaaaagagttgttttgcattttatgactccagccgctgctttgaaagatgatcttgcaagacttgaatgtgaaaagaaagcgaaaagtgaaaatcagattattgctaaacatcctgcttcaactagtaaaatagaaccaagtaccacaaagaatttagttttgtaatttagttggtattagagcttcagttgactagtgaggattttaattttgtaattttttccccatcatccactatacagccacaacacttttccgttcaccaaaccatatatttgtgccttgcgattatcatcctatttgcattattgaattttcgtccctcgtcgtgtcagtgctggtcatagctactgatgacgctctctctcgtggcccgatcttctggtgaggggataactctcgctttgatcgagtgcgacatttgcgacatagctaccaaaaagaacaagtccaggacgccgtgcaatcgctacaccacaaacgatgtcgtaccaaccgtgacgcgcggttgatgatccctgcaatgtaaacgagaaaacactgcaagaacaagataagatgcaatctaaatattgcgaataggtgattaagcacaaggaatagtttcgattgaagtggtagatctaatcgacccggccaaatcacacaccaactaatgggggctctga

SEQ ID NO: 5182 - DNA, 10859 bp, Oryza sativa
  unsure (1)..(10859): unsure at all n locations
tttggcgattcctgttgactcgagacgaatttggacatgagactggatgcgtttgaaaggtagtgagataagctatccacgaagtccaagatcacccaaatcggagttggcatgaagacgctaggtccgtttgaagtcagtgctgtctccggaggccgaactggacttggacttggaattatcattggaacatgtgaagttatgagcgtatccgacgaagtgatgtcctcattaatatgtgtgccacatgctatacttgtggtatctatgcttggtgccctctagggaaacaaagagaagattgatatcatgcaaatagctcttcagttcttcccataaaatatagtttttttatgttttgtttagacacaattttgtttatggtgttaatcaaaactgcttatttttttatggtacaaatacaatgtaatctttagaaatgagtgaggttaatcactaaaaatatatgtagctaaacaaacacgtgaccgtgacaactgtagtagcatataatataaaagttacaattttgtgataatttcccacgctattgttgcagcaaactgaaacatgtcgctaattttgcagcaaattgatagttttgttttgcagcaaactgaaacatgtcgctaattttgcagcaaactgatagttttgacgctaaagttgcggttttgtaaaatttactcttgtttatattcaagaaagatctatattttagcatcttgtttgttttcgtcacttgttgtccataattgcatgatacacctttagtaattctaaaattgtattaatttcccaaaattatttataataactaatttgttgaggtgtacttatagttacgtcactatggtatggtttggtttatgattgttatattataattcctcaactataacaaaatatatggtgaatagttttatactcatgctataggattgttcatttgttaccaaacctatttgacaaagaaaaaacgtatatgctcataattcttgtgatggattaaggagtcatattatagcaagatcattgccggagcataccaatccaatagttatgaaaaatttaaaaactttgagaatctcaatctcacacaaactaaaattaaatcagatattgtcacgcccggaaattcactaataatttccgaactaatttgtgcataaaatcctcgtccaggaatcagccgaggtacacaaactgacaatttaatatacaaatccatcataataacgttacatacttacaaaagaaaagaaaatagcagtggaataacggtctagcgatggcttcagctctactcccacaggcagctcaactggggtataagccaaacgccttctccttctggatcctttttcttcaactgaggttgattaattattgcaagaatgagcatatgacatactcaacaagccacacagcaaatatgcaaatgcacaaggataccaaaggatggcataatatagtcttatttgcgaaagcagcatttagcaaagagctaagagtagtaaaatagtagagtaattaatcagaaattttaatcaacactgaacagcacacccatgctgcacaggcccaaccatcctgaacaaccatacccggctatacagatctaactccaaaccaggagctaaacaaattattaccagttatagcatcaataattattgtgagaggtgtgagactaatcacgaaaaacattgctcaacccgcccataaccgcgggcacgactattcgaatagttttactctggccagaggtgtaccactgtacccacaagacacagccccacagcatgtcaccatgcgcctcaataccaccacggtaccttggaaaggagctgtgacagtacccctcgcagaacacaatccaccacagcgcacctttcctggatcataatcaccctcttataaaacaagacatggactctccagcgacccccgtgggcttatctccgccacttctcagtctggtgctctgcaatgaaccatgctatacaaaaggtaaagccattgcccacgctggcttgtggttggcacggttaatgtttcacaaaagtagctcgcgaaccggtccttaattgtcatgagcatgactctcaaaaccatgtgctcacaacctaccattatcaagttttagttggcaagtaattaattaaccaatcacgattgaccatcgtgaactatcattaagccatcattaaataatagtaagtcataagttatcccaatagtgtgctaatgtttctaagcatggctaagaatcatatataatatctagctgaaccaatatatacaaagctcaactagtcaaattataatatcccaaggtatcaaggaatagagtaatcaatgcaaacaggccataacaaaggaatagatttacaccacccagtgacattcgaaaataaatgcacagttgaaataaatagagaatttaaatataggatcaacatgctcaaaggattgtttgggatctgtgtgacttgccttgcaataatcggtcttcaattaatcttctgaacacttccgacgcactgacgaaccttcgcaataacggaaacgacaagctaacacgcaaaacgaagaaaaagactaataaaaaccaaataaacagtacaaaaacaagcataaacagtacatgtggatatttttaacatgttgatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaaggcaattattacgtcagcggctagggtttgcggtggaccgggtgcacggcggcggctcacggaaacaaatggccgagattcatccatccaaaacggacggccaagatccaacggtccacggccagaccacgagagacgatgacgatgacgtcaccaccggcggtggctcgggcgcgcaaactcgccggcaaacgacggcgcgacgacgcgaacggaggacaccaacacgtagagggcgatgcggcgaactcaccggtgaccaaaacaacggcggaagatcaacggacggcaacggcgtcgaggaagaagcggcggcgaccttcggcttgacgacgacggcgatgctccggcgacctacggcgatggcggataggcggacgaggtcggcgatggcttggtgatcacgacagcagccttcccgagcgacgacgacgacgggagcggcggcggcgcacggctagacgaacggcgatgacggcggcgctagactacacggtgctagggctctaccggcgacgagaggcgaaagcgagggtggcggcgggtaacggcgggcttgggggtccttttataggggcaaggaggcggcggcaaaggcccacggcgaccagcaacgcgaaggaaagtgtagggttcggaggagagagatcgatccgaatcgaactcgaatccacggatttccaaacgattttagccgatgattccaaaagagaaaaaggtagaggagatcccgaagatcatttcccctctatagatttctccggagaaggaaaggcgcgagcgaatttggaaggagacggcggcggcgcagctcggctagggttccggccgggcgacggcgcgatgaggacgacgagtccgacaggtgggacccacctgtcagcggccgagcgcgcgcgcgggcggctgcgggctgactgggccgaagaggagagagagggaaggttttgggccgactttcggcccaaagccaaaagaggacttctagaaccttttccaattaaaataatcacttaaattatatttgaattgttaaaaatacttccaatgctcaaataatttcaagaaaaatcctgaaaatacttggacactcgaagtacttaacaaaattataattagaccatctaatgattaatttaatatgtgggtaattactgaaaagctctttgtatgattaaaaaaaattaggaattgagctccgaaaaaatccgagaatattccagagagtataattaaccatggagaatttaataaaaattaaatccatctatgctttatatttaggaagttttatttcccacctttaacttcacttgtaaattaatgaacatttaatataaattctaataataatttattaaataatttataaatcctgaaagaaaaatcaggatgtgacagatataattaaaaaacataacgttgcttcatttttcatgcatttagattccagtttgtgttatataattgtcaagtgatatttgaccataaaatataatgttaaattatttcgaagattatcatgacattatttattatattctgcctaaattattttaaaaagtattatgatactccctccgtccgataatataagggattttgagtttttgtttgtgttgtttgactacttgtctgattaaaaaattacttattatatgtcagctccaggtgttgtaatgtatttagcactataatataactatgatatgttatcaagatttgaatgcacctgattataagttgactataaaatttaaaaataatctaaaaaatcgctgtttaaacacatttaatttgtttttatatcgacatagtttaacttgcatatttatatttggagtaataaattttattttatcgtatataaaatcctattttgaagtccgtctatatattttttcgatggttctaccaacttatattagtatttttcgggctttatagttttattatcgcgcgttcgtatgtttctttgctttttttcaatcgaacatccagtaaatggtttctctggtatacggtatacacaggagattaaaaggaagtgggctaatcttatgatccaaaataatgggtccatcattttgaatgaaatttgacaacgaaattatatagtaccacgtggcattctaatagtgcttgctgaaacaccacatgaccatatttgtggagtgataaattttatttttatagtatagcaaatcctattttaaaatgaccgtatattatgtaccttttttaacggaacagtactatatagccttatttttactcgtgcatacgtaagtaattttttttcaagtgaacagtatctttttaatagctgctccctccatcccaaaaataagtgcagttttgcactattcatctccaacgtttgaccgtttgtcttatttgaaaaatttttataattactatttttattgttattagatgataaaacatgaatagtcatttatgtgtgactaattttttttataaatttttcaaataagacggacggtcaaacgttggacatggattttcatggttgcacttattttgggacagaggtagtattacataggtaattttttttcaaatgaacagtactgtacgtacgattacacgatgccatcgtacgtgcgtgtgcgtacctatgttgaagggctagtttctttccatagtacgtacgcaagtttttatggtgtaaacggtttcactcatatctataaaatattaagagaaagcaatatatgtattctaatggtcttaaataacggacccattaatttaaatgaaaattgatggtgagattttaaactaccacgtggcaacctagaaacaacatttgtaggagcgccacgtggtggcttagaagcgtttgtagaaaatttaatggacttttagtatataatagaatagatatccacatgatgatgttgtgtcaacttcttcatcgacgatggtaatcagtgggcacgaaatttaaatctcttgggtggctttcgaataatgtcaaggttcttggagattaatcaatcccagtacgctttgtttgatctttcaagtggtgatgtcaaagtgagcaggcaacctacccgttggaatgcggggtatgaaaagaaagaataatatttacgagacgagctgagttgcattggtttgattaagattccagaattcttgaaattttggcaaagagaaatgggattccatcgagctagaggagcaattaacactggtagagaaatcgtttttagtcccggttcgtaacccccctatagtcccggtatttaaatcgagactacgaatccgggactaaagatccctctctttagtcccggttcaaatacccgggattaaagatcgatatttagcaccaaccgggactaaaaataggagtggcagtcacggttagttttttttttcatttattgctacttactatctctaatttattttctcccaaattaggtgggatgcatatccccaaatcaaaccccaaatcaaagtcaaaccccaaatcaaagaaacatcccaaatacacaaatcatgtacatctcagatccatgcaataaatcacagattctaaaaaagaaattatacatctcaatccatacaatgaatcacaaattcttcatctcaatctatacatggatcacaaattcttcaaaaaaaaaaaggaagcaaagccgccggccggctgagccggctgctgcctcccctcctccccggccgccgccgcgccgccctctgccggccggcccgccctccccctcctgctgcacacacgggaagggataacaaagaaaagagataaggaggaagcgaagaagggaaaatattaggattagagatgcagagagagagtagtttgtgtggacgggaaaagagaataaataatagggattatatagtgcgctttgatctttaatctcggttagtaacatcatccgggactaaaggtcatcgtgatctttaatcccagttagattaaagatccgatctttactcccggttggtaactccaaccaggactaaagatcctaaaggggcctgacaacacgactaaagattctctggaggggcctgacaacacctgatagtatgtgaatcaggactaaagatgatctattaaaaatcatgtagtctcgttctgcttataaaccgggactaaaaaccatctttagtcccgatttttattgcaaccgggactattatggttttggtcgaccgggcaaagataatttctccactagtgtaagtagcaatggtacttgaagcatatagctaacaatctcttgctgcatccattctcatctgacgaaggacgatgaaaatgctgagcacggacgagctaggagattgtcctactggccgtttgttggtaagaagaagcagcatgaatggccagcatgcggacgtgtatatgcacttgtggctccagctctcatggcggatgtttggtcgattcatcacatagaggcatgaccaccaacaagcatcaaaagcgtctccaagccatatcgatccatgacattgtccgactgctcatcaatggctcctagtgccttccatgcctatggggatagaggacacagagcctgcgaagagcatgtatcgagccacgatgttgcatgggctgaaagtatgcttcagtcatttctctgttttttatgcgtaggagtatttataaggattcctgtaaaaaaaattataagtacgtacttgcgcacttgcagcaatagatgagagctgagcaggctgctaccggctgcacacttgcaatatacttggatgtgctaaactacacctgggttaccatataactaaaacgcactactcatggatacatccccaccctacccatccagcccgtcccgccccctccccccaccctcttacccaaacatcctgcacgtttcccaccaccccctctcagtccgtaccttttctctctcctgattttcttcctatgtctttctctcagtacatgaattatccttatccttagattgtcttaggccattctattagtaaataaattacaaaagataattctataccaatatgttctcataccttctcctatcttagtaaataaattacaaaagataattctataccaatctgttctcataccttctcctagtaaatgaattatgtggtgatgttacaacaaaatttttcttttaaaataaattaatattaaccaatggttctcgacataaaattattatgccgatagttgtcaacatattaatcttgctacaaaataatatttgcacgttattggccttctcttagtaaataaattacaaacgcatacccataacatttctcttagtaatacattgacggatacctaaacgatttcggtattcaaagtccttcgacgaacaaatggtagtattttttttcctcaacgatatacacagctgttattctggcagtaaaaaagttcctaattgtcatgcctggaatttctatccaaaattccaaacgcttacatgtatgtaaaccctcgtccagtaatcagccgaggcacacaataacaaattgataatagagtacaattattactctaattaataagcgaataaaatgtcattacaggggtagatagttcccctcaaacaataaagttctaagcagtggaaaataaagaaacagcgcaggcgactcctctccacatgcagcttgatcagggctacgcctaatcatccacaccatcagcatcactgtagaactcctcctctgatgaatgattgcaaggtgagtatatgacatactcagcaagtcacgcagcaaatatgcaagtgcacaggataacaaagaatatcatagtatagtctcatttgcataaatagcatttaataaatattttagaatttaataaaacagttaaataataattaaacaatattaatccaacgctatacaacataccctgttgcataggcccaaccattctgatcaaccaatcctggctgcacagttctatctccaaaccaggaattaaccattccaaaccaggagctaaataagttattaacatcaatatggtgagaaatgtgagactaatcacgaaagacattgttagaccagcccataaccgcgggcacggctattcgaatagtttgaactctggccagaggtgtaccactgtacccacaagacacaacctcaacatcatgtcaaccatgcgtcgcgatacttgacaagtacccgaatagagattgtgacaataccctctatataatacaattcaaagcagtgcaccgttcccggatcatatcacccccctatannataatgtatggactccccagctacccccgtgggcttatctccgccacttcacagtctggtgctctactatganccatactatacagaaagtaaagccgtggcccccgctggcttgtggctggcatggtaaatgtttcacaccgaaaaatggtgaaccggtatttaattgtcaagagcacaaccatcaaaaccatatgctcacaacccaccattatcaggttttagttggcaaattaattaattaaccaatcatgattaaccatcatgagctatcattaagccatcattaaataatagtgaagcataagttatcccaacagtgtgctaatgtttctaagcatggctaagcaattatatctagtatccagctgaacccatatataaagctcaactagtcaagttataataacccaaggtatcaaggaatagagtaatcaagaacaaaaagggctataacaaaacaataggttaattccacccaatgatattcgaaaataaatgcaatagttgaatagaaacaatagctttaaacaggattaacatgctcaaagagttgtttgggatctgtgtgacttgccttgctggccttgaaattcctcaaaatcttctcctgcaaattcggactctccgggaacgtcagaatctaaagagaaaagaacaaaattgtcacgtcccaaaacgactctaaaatacatcctctaaattatgcctagaataattaaaatccgtgtgaaagcctccaaccattaaaaggtgcaaagttaaaagtcaaataaggcttgggggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggccggctcggcccatctccctccccctccctctcctgtccccgcggcccatccggcctctccccgcgcgcgcgccgctgacgggcgggcccgcccgccaccctcgctgatgggtggggcccacccatcatccccttcctcccgctgcctcgcccgcgccctagcgccgccgccgccgcgaatcccgccacctcccgccgtctccgcgtgcaataaagagggggaaatcactccccgtgatcccctctccctttaaccccatttttccctctctctctcgcgttcaaacgggcggatttgcccccgcatatctcgccggcgccattgatggcggccggaccttccgcgcccggtttctccctttcccgggcaccctctcccgacccagctctatttaaaccctgcccgcacctactgcgtncggtttcgcctctcgccggccttcctcctcgccggaatcgagctcgcgccgtcgctctctctctccgccgtcgctgtcgagctccggtccgccgccgtcgtcgccccggaccacctcccaccttggcgccgcctccttcgggttcgccgcatactcgccgacctcgtccacccctccgtttcgctcgccgaccgccagaacgccgtcgacccgagccgcgccgccgcctttctccgctccggccgcctttttcgtcgtcgccgtcgacctagggtgagcccgggaccgccgcttcttttcccccttcccttcccctctctcggccgtcgctccgccgtgcctatggccaccgccggcgaccataggggcgcgg

SEQ ID NO: 5183 - DNA, 4215 bp, Oryza sativa
taaagagcatataaacttcaaatgaccataacttggccatttgaactcggaattggaccgtttaagtctctaatttttccttaagaagtcaagaacccatttttgtgctttgttccagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttttttaaattcccgcgttatcattgttttatctagccatgcctatgtacctttgttatgaccttattatccttgttcaccctagaataaacaaaaccccaactagtggacactctactcatggtaccactagtatgattttagttagatgcttcgctggttaattaggtaacattaggtggtttacaactctagaccttgggaatactcttattacctggacactatggaattgttggattattgtggaattggattcacacctccccctctattcaaaatcctcaaaatggttttaggctgggctcggggtgcatggttttgatagtagcacctcggccatataaggaccggtcttcgggcctctgttgcaaagaactaccgtacttccacatgtctagtgggtaaggcttagtttgtggctcagtctggttataaacaaaagtacacggatggagatagacgaagtcgggggtcgatggacatctctagggcaaatgaaggctacacgagctgcggcccggtagtcgagatgtcatggcacagggccggtgtcctgctgctaggggctcagtcctgcctacctgtcccgggggttccggccgtaggtggggttgggtcagtactcttgtctatggcaaggatgggttggaaactatgtcacgtcttccgtccgtataccgtggtggtatggggcacgtggttacacgtgaggaagatgtgtcttgcgggtaaagatgtacacctctgatcagagtataatctattcgaatagccgcgccctcggttatgggcaagccgagcaatgtacccaagttagtgttttaattcttaaaacctgcttaacaactaaaatgtgaaatggttggcctgggttggcttgggacgagctgggacccagggtcaggttgctagttcggtctaaatcatcgtaggccttgggttaaggcaggttcgtgtgggttcacggccttgtttaataatcttgtatagctctaggatcgtatttacaaaatagctttgagcaactaagtgtcttttaatgctgtttgctgcaaaccctaaccctttatattataacccccttgtactcccttgcatttatcctgcacttgtgggtgtgtcttgttgaatacggtggttgtactcagtcttgctcaatttttccgaaacccagaagaggagcccctggaagatgaaggctttggtgtctagctcgcgcctgccatcaagcgcctgtggtcgtcgccctagccttccgctgtttcccatttgtctttgtgtgtgctgggccttcgccgcccatgtaataaattaattaattacgcttcagcttgtaaactctgaattgtatcaacttttggtgtaccttgcctcctgggacaaggaataatgcacgcacgtaaggaacgcccgttgggttatttccggtcgtgacaaaaatcaccaaaacagcacataaacaagcatgaacagtacatgtggatatttttaacatgttgatctcaattttagaaaaatttatagacttgaaccaagtaaatccgagctaagatgaattagttatgaatttttaaagattaaatcggattaaatcatttatatagattttaattgaattatgacgcaataatgaattatttttgaaaaggaaaaagagattattgcgtcagcggactcggctcacggtggaccgggtgcacggcagcggttcacagaaacgaacggccgagatcgatctatccaaaacggacggccaagatttaatggtctacgaccggtctacggcggacggtgtcgatgacgtcagcggtgacgtcatcaccggcgacggctcggacggcgcattctcgccggcgaacaacggcacggcgacgcgaacggaggacacctacgggttgcgggcaacacggcgaactcactagtgaccaaagcagcggcggaaggtcaacagacggcgacggcgtcgaggaaaaagcggcggtgaccttcagcttgacgacgacggtggggctccggcgatctacagcgacgacggaggggcagacgaggatggcgacgagatgacgatcacgacgtcggccttccctagtgacgacgacgaccggagcgatggcggcgcacggctggacgaacgacggcgacggcggcgctaggctacatgacgctagggctctaccggcgacaagagacgaaagcgagggtggcggcgggtagaggagacaccgggggtccttttatagcggctagggggcggcggcgaaggcccacggtgaccggcggcggcgatggaaaggttagggttcggagagagacaaatccgattcgagatcgaatccacggatttccaaacgattttagccgatgattccaaaagagaaaaggtagaggggatctcggggatcatttcccctctatcaatatgaccggagatggaaagatgcgatcgaatttggaagagcggcggcggcgcagctcggctacggttcggccgggcgacggcgcgaggaagacgacgagtccgacaggtgggccccacctgtcagcgggcgagggcgcgcgcacgcgggcggcgctcggctgcgggccgacctgggccgggaaggagagagagagaggtttgggtcgactttcggcccaaagccaaaagaagactttttaaaacttttccaatttaaatttttcatgaaatgcaattccatttattaaaaatacttccttggctcaataaatcccagaaaaatctaggaactatagaatcaagcaaagtatttaataaaattttatctggcccaattttatattggaatttattatttaaaattagatcttctcttctaggcttttaaaattatttctaataattccaattaaacaataatttatatatttgagatttttagggtgtgacactaatacattttttttagataatggaagtattattaatctcagtaaaattctatcaagtgatacaattattctgagagcacctccggcttctgcacccaaagagtgcacacagccaacaagaaagaaacgaaagataaactcatcatccaaatagcagggacaaaaagaacttcaggagccctctaaccgtagcctagaatgccacccatgcgccggggtagaaaactccatggccactagctccaattgttgacaagccggaatgatagttccctgcaaattgaccttctgaaggatagcccatgagcggagccaatgtgtaataaaaaagataacctgcaaaggagaagatatgtttttttctttcaaaaaccacatcatttctgcaaagccaaatagaccaaatagttgttgttgccctaacaagaccaaaaatctcaaattgcgtggttgtcttcttatccaatgcccaaacatatgagttgtactattaggtaaactaatattcgaagcaaactggattaaataccaaactgcgcgggtaaaccgacaatcaaagaccaaatgattaatagtttcatctttatggcagaaagaacaagacttgtttcctctccaattcctttaaataagattatcttttgttaagactactccacgacgtaagtaccataagaagatcttaatctttaggggggctttgatctttcagattcttttgtttatattgggaacattggtctccaccaacgcaagataaagagatttaaccgagaatctgccatcagtggttagattccatttaaactcatcttggtcgtgagataatataatattagcgatgcgtgagagaaggtgattccgcgctactaacttagagccagtaaggtccctacgccaagaaaagcttagaggactggtttggaaaatttctgaaatagttgcatgtttatgcctaacaacgttatagagacaaggatattgtt

SEQ ID NO: 5184 - DNA, 308 bp, Oryza sativa
atatagtttattcgcatgagggataacctgactacacacaaggaatttatcgcggcggttcaagaacaactcatgggattcatcaacgaagaaatacttgatcccaagggtgaattctactacgacggaaacacaattcaccggtccttagcttctgagctagccgcgagtactactactacgtcgaaatcgtagctagctaggacatataatggattgtaattaatacatgactacatatgtttctatatgcatgtgtacacattttctataatgtaaatatattttgggcatatatatatatatat

SEQ ID NO: 5185 - DNA, 17752 bp, Oryza sativa
  unsure (1)..(17752): unsure at all n locations
aatgaagtagtagaattttttttcaagaacacatactttttttaagtgtgaaataaataattcgttttaactatcaataacctggtgaataagcttaaaagtgggccttaagaattgcaatcataagcaaacaaaagttttcgagtgcacttgtcatgtgtcaccaaaaaatattaaacgttgtgttcttttagtttttccatttaacgcagcacatatattcatttcacatagcctttgtggctttgtaacaagccgaaccatctctaatacttcatccgtttcacaatgtaagactttctagcattgctcatattcatatagatgttaatgaatctaggcatatattgacggtcgttatcgatcagtttcgagcgtcaatattaccgaaagagagaagaactagttatgcttgcaatgcatatttgtgttagaaaaataatattccactagtattagatttactaaccttttcaagaataacaataaattggagaagaatcgacatcaaaacagacgatcaatcaatcagacgatgtcgaggatcagacttatacatgaatgggccaagaacttagaaatgacacgtcgaaacggccaaaattcaaaagtctatatagaggagcagaagaggaggccacctgccgaaattgggccaggaaggcccggcccctggttcggccgaacccgaaccctccctggcatcgttggatgcagggtttcttctggacggtgtggatcactctccaatgatggttggagggcaattccgaccgttccaactgccacaaccgtcattggcagcctattcaaggagttcctcttctcacttcctcggttcctccacacacttcaagcgagagctctctcatattctctcaagtttagtttagtgttcttaagctagtggagtaggaatagaatagaaatcagagtctggaagtcttcgggtatggctctggtagctctcctttcctcttttgtaagctttgtactttatttagaatactcttctttgtacatttttggtattgaaatacgttccgaatatatgaatgccaactttactttatgttcatgttatactgattatactgctagcttatctggaagatgcataggtacgggtataatgtttgctattgcaattactctatgtcatgacgatgatattagagtagtatctggtagtttaggcgtggtgtctagattattattgggtatcattatttggggttatatgttgcggatgagaggtgggccgctgatggtgaaagctcagtacaggtattcctctgcgcgtgtatatagttctaagttaatttcctgggaagggtactcctccgtatttagccccgtatggtcatgacagattgtcgtaaggaactcggcagtggggtggcttctcgaagtactaggagggcatcggaaagagggtattagctagttaatcatataactagaatgtatgtatactatgtatatactagaagtataggaataggttcttttctattttctttccacttaggttagataatttagtatgagaataagtagacttatgcttgtgtgtcatcttaccctttgaattatcttaacccctgcttagactatgattattacaactaacatataaactattagtacggttctctctactatgatcttcccacatgattaaataattacgatacccttggaatactctcgggtgaaatgctacaatggtatatccgtgcgcttacggataaactctataaccataatataccaggagtatttctgcgccattgctgggaattatatttctagtaatatcgttaagaaataccaacagtatatatgtgtgtctagattcattaacatctatacgaatatgggcaattgtcgaggaagtgatcctctctagcaggagatcgtgggatccccctttcgtgagttcggccggggggaaaggcccgcctctggaaatcacgtatccgaccccaaggctgctagctagcgtgtaaacaacaagattatacaagttcgggccgctatgaagcgtaataccctactcctgtgtatggaatttagactgagagttacaaaggttcctaaactccggagagcgctctcgcttcccttctcctagagctcaggttttctgagagccgtccgctttctcggtgggcaaggtcatccttttatacctcaagaggataccacatgcactgcctctaactactcttctatcgggtggggacccaccctaccttgaccggatctcgacctgtgccttcgcctggaagctaagccacagtttgtccttgagtggggcccagcgccgtccctcgcctgacacgggggacagccttgtcattcccttattaatgggtaaagacttgtggtggccgccctctcatggggagaactgcgaatgaccctccgatgggacgggtcatacctacctccactccgccggaggcagatgtgacgtgggggcacggccgtccgtgcagtcagacgtgaccggcgacagaccggtcacagatcggtcattcgtgaccgacgcgagccagtcgggcacgccgcacgtctgcccctactgcatggaatgcggcagggggcagttggggcgctgcacgcattaaaggtcgttcagcctgggcccgctccccgcttgctccccccgccagatggcagctgggcgagggcctcggggcaaagcggcgtgagggcccgaggggtatgacgtggcaccccgaggccccccggccgctcctgtgattcgcggggtgcgggggtagggctaggctgtagggtcacgcgacaggatgggaaggtaaattcccctcacttcgcataccccgggcccatatctccgacagtagcccccggcaccacatcggacgttggcctccagaggtcggtctgacgtggcacctcacgacttctcaatctggggttgtgggcccggcggggaatctaagcggatgccgccgagcggccaggttggcgtattaacaataacggcgatttgaccgtcactaaccgcgctgatgatgggggcgcttaaggcgcgaaaatcgggggggggggtcggttggaccacacctcgactccctcgcccgccacgtatgcgacggtactgatggcggcccgcctagattgcgcccgtgaacgtcgcacgccctactccgagtgtgccgctgacaggcgcactaaatgcggggcgcggattcagtgagcgacgtgatgagtggtagcgggaaacgatcaggcaactgcaggcgcaagaattgtgggggcaaccgtgagggcgtgaaacgaggaggcaagcgcgggcgaggcagggataaaaggatacggtggcggggactttgcctccttcctttcgccaactacaagacacatcttcctcacgtgtaaccacgtgccacataccaccacggtatacgaacgtaagacgtgacatagttttcaacccatcctagccatagacaagagtaccgacccaaccccacctatggccggaacctccgggacaggtaggcaggactgagcccctagcagcaggacaccagccctgtgccatgacatctcgactaccgagtgtcacgccctgtagttcccctcccttgctctaaattcataaaataaatcgtccgaagaaattgtttaatttaacctagagataaatccctaattaataaatgcaaataataatcggaatcgacatgtggaatttttcttggattctacatgtcaaaatatgctaacaggatttttagtggaattttcagaaccttggaaataattttaaccaattaaaataagcaaagtgcaatattaaatccctgggaaaatcctttttcctttttatcttttcttttccctcctttttcctttttcttgggcctggcccattccctcccgcgccggcccgcttcacctcccccgaagtccatccaacctcccctctcctcccgggcgccgacaggtggggcccacctgtcggtcgtccctaacctccggcagccgccaccatccgccgccgaaaccaccgcccacgccgccgcttcctttgcatccgcgccccactccgcgcccacacgttcccacgtcaccgccccacgccctgccctcttccgtccgcgcgcgcgcccgcacggacgggattcgatttgaatcctctccccctctctctcctcctccacctcttcacgtcgtcgccgcggaaccgccgttcccgaccacgtncggnctcttcacctctatataaccgaccaccgcgcctctctccacctttttcctctttcgccgtccactcccgagctccctatcgccctagcaccgggcacggacccgccgncattattttcaccgctccggccgcctctagcagccgctagggtcgccggcgcaccccgccatcggcgccgcgcgtccgccatcccttgagccgtcgcgtccgccgttcgctcggccaaatccgtcgtccgagcccgtttctccctactccggtgagcttccaccattgccgccgccttcggccatggtttccgctcgccgtagactccctctctccctctaatctctctctttccctctcttagggcaacccggagcccgtcgccgtcgtcctcccgtctctcgtcgttgccgttcgccgtcgctcctccctcgcgccggccgagcccctcggtgaggatcggtctccctctcttcctctctctccctttgccgcgccgcccgccgcgtagcgccgccgctagggccgctcgcgccaccgcttcggccgccgccgccgtctttgcgccgtccgccgctgcctccgtgcgcgcgccgccgccctcgccataaccggccggccggcttgaagccgagccgagccaggccgccttccccccctttgtgacgctgcccagtgggcccgcctgccagccgccctctctccctctcttagtgccgctgaccagtggggcccgcatgtcggcaccgccccacccccttgctgacgtcagccctgggatgaattattgcgcaataaattgattaagggtttttttttatagtaataaacacagataatcttctaaaaatcataactaattcatccgagctccgtttaagcccattcaagtctcagtaaattcataaaaatgtatagaatccattaaaaatggttttgtttcctgtttcagtagtcttatagcatgttttgcttgtgtgctttgtttgtcgcgtagatttcgcccgtttcgtcgtttcgcggattctcgaagacgttgctgtggtctcatcagtgcgagagcaaggcaagtcatacattgcaattgatcatattgtacctaatatacaaatgtcccgcatttctattaaatattacatttgttttacaatatcatgtgggatgggtcctattactcagccatatattgcttaccttatgccattgataacgtgggtattaaaatgactagatattggtttaggagatgcttagccatgcttagttcaactagtgcacaaagggggattacattaaagcatagacttgattattggcatagctttgatttagtgccaccgtaatggtgttggttaattaaaatacacgtcatggtgggctgtgggtgcatggtcttgctagtcacacccatggcatttaaggaccggttcgcgggatgccctggaagaacttatcgtacttaccacaagccagcgtgggcaaaggctgggcttgtagtgtagcttttctctagccgacgtacccaggcgagggtgggcgtgatggagttgggtcggccggggtgtccggttgatcggcttccggattcaccgcgacacgaaaggggggctgcccgttgcctgctggggacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttagaactggttagttcaggtggtggtttgggcctgttgcaacgtggtgtaacgttggacagtgattggttaatatagattaattactacagctgttttactgctttcaactactgcttgaaatgccggctttatgcaaaagaaaatttagcctcccttggatatatcttgcatcatacctcctcttccggtgtgacttgctgagtacagtgggtagtactcagtcttgctctcttttcccccacaccagagttgaagtccttctcagttgaggatgtctcgaagaggttggtttcgtcgctgccgtcaaggatgcctgtggaatggagtcgcccgctgcagaagtcaagccttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaccgagccacagctcgtgtagccttcatttgccctagagatgtccatcgacccccgacttcgtccatctccatccgtgtacttttgtttataaccagactgagccacaaacaaagccttacccactagacatgtggaagtacggtagtgctttgcaatagaggcccgaagaccggtacttatatggccgaggtgctactatcaaaaccatgcaccccgagcccagcctaaaaccattttgaggattttgaatagaggggaaggtgtgagtccaattccacaataatccaactattccatagtgtccaggtgatgagaatattcccaaagtctagagttataaaaccacctaatgttgcctaattaaccagcgaagcatctacctaaattcatactagtggtaccatgagtagagtgtccactagttggggttttgtttattctagggtgaacaaggtaataataacaatagcaataataataaggtcataacaaaggtaaataggcatggctaaataaaatagtgataacgcgagaatttaaataaagcgataacgcattaatttaaatcaaaataattttataaactgggattcaatatgttcaaggatgatgtgacttgccttgctcgctttcccaaacgtcggcttcaacctccacgaagagtggatcttccgaagctgcagcgtctacacgaccaacggaaacgaaaaaggcttttactctaataaactccatataacaagcaggaacaaagcacaaaaatgggttcttgacttcttaaggaaaaattagagacttgaacggtccaattccgagttcaaatggccaagttatgaccatttgaagtttatatgctctttaaatgaatatttgtgaatttctttatttaaattttaatttaaaaatggtttattgtcagccgagggggaggggcgcgcggaccgggtccacgggagtggggcccacgcggcagcctcacggtccacggtggaccgggtgctcccgggctcacaccgccggcgccgtgggccccacgcgtcagccgcacccgagggcgcgggcggctgacggccgggccccacacggcagccactcggcgtacccgaaggcggccatgccggcgcggtcggcaggaggcggcgcgcctgcgcccctatggtcgccggcggcggccataggcacggcggagcggcggccgaaagaggggagggaaacggggaaacgaggcggcggtctacggctcaccctaggtcgacggcgacgacgaaaaaggcggccgtagcggaggaaggcggtggcgtggctcgggtcgacggggtcggcggcgttccggcggtcggcgagctcgacgagggggtggacggggacggcggcggtgcggcgaagccggaggaggcgacgccggggcgggaaacggtcccggcgagcggggagagccggccgaaggtcatcggcgacggaggagagagagggcgacggcgcgagctcgattccggcgaggagacggtgcggcaaggggcggaaacgggcgagggaggcgcggggagggtttaaatggggttggaagggggagagggcggccggggaaggaaggaaaccggccgggaggtccggccgccatcaatggcgccggcgagatttgcgggagcaaatccgcccgtttgaatgcgagagagagagggaaaaatggggggaaagggggaggggatcacggggaatatttccccccacattattgcacgcggggacgacgggaggcggcgggattcgcgatggcggcggcgctaggcgcgggcgaggcggcgggaggaaggggatgacgggtgggccccacccgtcagcgagggtggcgtgcgggcccgcccgtcagcggcacgcgcgaggggaggggccgagtgggccgcggggaagaggagagagggggagggaaatgggccgagccggcccaagagagggaagggggatttttagggtttttctttttataaaacctttttaactttgtttatttcttaacaattattatttgtgctctgaaaattccactaaaatttatttacacattttaggcttttaggaaatatacaaaaatcctctaagccttatttgacttttactttgcacattttaagttttggacgctttcacatagattttaattattctagacataatttaaaggatatattttagggtcgttttgggacgcgacaggtgtggccgacgatgtggctgttccagtccttcttcgtcccgcagctgctgcatggtgcggtggtggggggatgctacttccagccccgacgaggcacggcgggccatacatcgagagtcatctctggaagaagtgagaggactagaagaaggactggttctacaccgcattgccagaccacctgcgacttcggttctccgccgccccccccccccccgaacgatcagccgcatggctggcggtttcggagctgggcgaggagtacgatgtagtgcagactcgccttaggggcctgcgaagccagggcctcacgggggcaatggtctttggcgattacttccgccgccgcatcgtacctctccaagagcggtcccgcggcacgtgggagtacactggacccaacgatcccatgcgcacccatgtgggtgagcgctgggactggggcgaggacgacgcgaagacggtgattcgtcgggtgctgggtctggacaccgccgagcaaacactgatcccagacaggatccttcccatctgcagcgaccgcgaccgggaaagtatcctggctgtgatgtcggccgtcggcgccggcaggggtcggtcccgccggggcagcgccgtcggcatgggtagcagcggcgcgaccgtaggtgggagtcgaaccagtggctccggcgggggtggtagctccagggcacccggcccgagccgcgggcccgggggagattcggccaacgacccgaaaggaaagcggaaaatgtccaaatctcgaccgccctctcctccgtgcatagggggcgccgagcgcgtggcggaccgaccgaagttggacggaagaagaagcggctccggaagaaaggtcagacggagccgtgccgggggagctttatcgagcccccaaattggaccttcaaccgccctccccacaggtacgactgccggcatccgcttcggtgctctttactcatctcggcctcttgttccttcctcttctttttctttgttaacgcgatcagggttcttttgtagcgagattccttcccagggggtctcggcgtctgaccctttgttggggtcaaaatccgagcgaccggagcggcccgggctcggctgatccagcgccgcggggccttcacagccttacggcggggcccacgggccgcacgccgggtctggccccgagtccaccacagtcgggacaagacctgccgcgagcgacagcggccgcggcgtccctcccgagggcgacaccgaggcccagacccgcgtgtagtgccacccgggagcgggggccgaggggggtcgcggcccgaaagctgaggctgggggcagccctgagcccgaggctgaggccgaaactagggcgggcccgagcccgaggccgaggccgagtctgcccgagggcccaaaacgggggggcgagaggaacagccgctcccccttgcatttggggtgccctcggggctggccgcgcgggaggggggttgagagcagccccctgtctcgcgggggatccagcagcactccgtcgttacaggggcggaccgcaactttctcttctccgacgccggcaagtatggagcctctcctgcaggtgctcgccaccgccgattccaccgtccgggaggggctcaacgcccaagtacaagccccggcggaggagcgggcggccctggaggcagagtgggcacagcttgtggcggaccgcgcgcgggttgacgaggggcgccgcgccgtggacgacatggtggaggtggggcgcaaaatgcgccaagcccaactggcagagatccagacgcgtgaggaggcggcactgatcacctcaagcatcctagatgaagcgctgggtgacatccgcttgcagtacgaggcctatgcgaaggacctgacgaagagggtcgaaaatgcctgcggtgtcattgatgcggctgccgcccaagagcggcgggcctcggaggccgacgcctcgctgcgggctcggacggcggcgctcgaggccgaacgcaaggccttggacgagcgcgctcgctccgcgcaggagtttgaggccacggttcgtcggcgaatcgaggtcctcgaccggaaccagcgcgagcaagacgcgcgcagccgggagcaggcgcagcgagcccaggagttggaggagcaggctcaggcgctagaggagcaagcacgtttgctagaccagcgggagtccaccttggccgcccacgagagaacggcgacggaagcggaggcctcccttcgtcttcgtgaggaggccgcagccgagcgtgaccagacgacccttgctgcgaaggcttcggcggcccgtcgtgtagaggagctacggctccgggaagaggcgtgccgggaacgggacgccgcgctcgccgagcgcaaggccgaggtgaaccgccatgaggtggcgacgcgccggctgcgtgtcacgcccagaaattcccgaatagaattccaagtagaatgtgcattaaaatccccgtccaggaccggccggggtacacaagcgacaaagttgacatatagatccacgtcttacaaacattataaaagtcttacataaatgcagcggaaacttaaaagataactagagctaagccttgacttggactgcagcgggaacaccactccacaggcatcctcaacggcacggacgaagcctactcctcggaaaagccaccatctgacgcatactcaaactctggggtttggggaaaatagagcaagactgagtactacccactgtacttagcaagtcataccggaataggggtatgatgcagggaatcatcaagggatagctataatggttcatttgcataaagcgagcatttataaaccgaagatggaagaagaaaaacagttgtaataattaatcaatattaatcatccactgtccaacactataccacgttgcaacaggcccaaccaaccacctgaactaaccagttccatcagactatactagggtgagactaatcacggtgaatctggttgaccgcccataactgcgggcacggctattcgaatagttttactctgattagaggtgtacaactgtacccacaagacatagccccacgacacgtttccgtgtgccgacatgccaccacgacataccagaaagaggccgtgacaggacccttcgcataaccccctctaaccaagcacaccacacctcaggtttcacccccactcctcgcaaggcagtgggcagtcccctctcgtgcctaggtgaatccgaaagccgcataggccgtcgcagggcccatccaaactccatcacgcccacccttgcctagatgcgtcggctagaggaaagctacgcttcaagcccagccgttgcccacgctggcttgtggtaagtacgaggaaggggagggcggcgccgacatgcgggccccacatggcagtgactcggggagggcggttcacggtggaccgagtccacggaccggggaaggggtggcgcgccacgtggtgcacacgtggcgctgacgcggcgcacacatggcagccacgcggcagccccgcgggtggctgaaccgacggccccgatctacctcgggtagatcggacggcggcgaggagcacgcggccggcgcgcacgggcggctcgagccggcccggcggccatggcgcacggtggcgctaccgcggggcggcggcgcggcaaacggcggtgtccgacggcaagcggcggcagcggcgcgacggcgcggcgacgctggcggcggctaagcggctaggcggtggcgcggtgactagacggcgcgggagagagagagaaagaggaggaggtgcctcaccaacgacaagcgacgacggcgagcgacggagggcgatggtgacggcgggacgatctccgggaccacctagcgaacacgatggaaggggttagagagggagagggatttggaacagggcgaggacgccggccgaaggcggcggccatggcagtgctcaccggcgcacggcgcggagtgggttccagcggtagaatccgacgggagaggggtggacgggctggcccgcacgatggcgaacgcgacggcgtcgtcggcgcggctcggcacggcgtctagcggcggctagcggcgaccggagcagcggcggcggtggcggagaggagggcgacggcgctagggcgttagagagcacgggagagctcggcgagattgggaaaaagagagagggagtggcggtggagcttaaatagaggagggggagcccggacgtggccggtagaggcgggaatcgccggccgaagtgggggagtggggaaggagagagaggcaggattcgaaaatcgaatcccggctatctcgagcgcgggcgtaggcgggagagagggggaagtgggcgcggggaacgcgggtgcgagggcgacgtgggcgacatggcccgagagacgcgggagcggggcgcggcggcgccggctggaggaatgggacgggcccgacaggtgggtcccacctgtcggcgaccccgggagagagaagcgggcggccggctcagctcggctgggcctcggccttcggccggcccagcgggaagaggaggcagagggaattgggccggcggaccaatcgaaagaaaaaaagggggaaaagaaaaagaaaaggaaggaaaaggactttcctgggattaaatattgcttgtgctcaattttaattggttaaaattatttctagagctctgaaaattccactaaaaatctggttagcgtattccgacatgtagaactccagaaaaatttcacatgccaaatccgattattgtttgcattaatttattagggtttactcttgctttacaccggtattttcttgagaccatttataacttcaatttaggcttgggaaagaacttcagggtgtgacactgggcgagcaactcgcggaacgcgaggaggccgtcaccgggcgcgaggctcggcatctggagagcgctcgtgccgagcgcgcggcgatggcggcgagggcttctaagctggaaggccgggagaaggacctggcggcgggcgggtagcccggcggcgcgaagttggtgagccagcttaccgtggctcagagcactcttgccgacctagggcgcctggtgcaagaccaagctggggagatcgcggccctccgccttaccaacgagatcggacccgggcaactctccgatgccgtcgatcagctggagcgacttggagtggtccggtttgcccacagcacagcgggcaactcttcaagccacgaatccccgtgcttcttcaagacgttgtacgtcttagtcttgaggcccttgaggatttctacgttggctcgctcgacttcgccgttgctcttggggtgggcaggcgaggcgaagcatagcttgatgcccatgtcgtcgcaatagtcgccgaacagctcactggtgaactgggtaccattatccgtaatgatacggttgggcaccccgaaccgggacatgatgcccctgatgaacttgagggcggaatgcttgtcaattttgacgaccgggtaagcctcaggccacttggtgaacttgtcgatagcgacatacaggtgttgatacctgcctcgagtcgctttgtacggtccaaggatgtctagcccccagactacgaaaggccaagagagcgggatgacctgtaaggcttgagccggctggtgcgtttgcttggcgtggaactggcacgccttgcatcaccggacccattcctgggcgtcttgcaatgcggtcggctagtaaaaaccttgtcggaaggctttaccgactaatgtgcgtgaggccgaatgtgccccacactcaccttcatgagcgtcggcaatgagctcgacgccctgttctcgagaaatacacttcaagagtatcccgttggcggcccgtcggtagagggtcccttctacgagcacgtactgcttagagatacgcgaaagcttctcagcttctgcgcgaccctcaggaagagtattattgtcgagatatgcccagatgtcagtcatccaggcgacgtgacgaggggtgtcggggtcgaccccctcgggccctgaggcccgtgggtcgtcggggcttggggcggaggtcgtggcaccggggtccctcgggggggccaattataccgacggctgcgcgagcctttcctcgaaggtcccaggagggagtggggctcgtgccgacgcgatacgcaacaactcatcagcgattgcgttgtcacgtcggggcacgtgccgtagctcgagtccgttgaaatggcgttccatacgtcgcacttcacggacgtatgcatccatttccgggtcggtgcatcggtactccttggagacctgattcacgactaactgggaatcgcctaggaccaggaggcggcggatgcccaatccggtcgccgccctcagccccgcgaggagtccttcgtattccgccatattgttcgtgtctcggaagtcgagccgaacgacgtacttgaggacgtccccgcttggcgaagtcagcgtgactccggcccctgcactttgaaggttgagggagccgtcaaaatgcataacccagtgcccgacgcgaatgtcggcgtttgggtcctctgcatctccggggagggagggaacgttggacggaatagggtcgtccactggggtccactccgcgatgaagtcagccaggacctggcttttgatcatgtgccatggttcgaagtgcaggtcgaactcagcaagctcgatggcccactttacgacccgaccagtgccctctcggttgtgcaagatttggccgagagggtaggacgtcactatggaaacccgatgcgcttggaagtagtggcgtaatttccttgaggccattaagactgcataaagcatcttctaggcctgtgggtatcgggtcttcgcgtctcggagcgcctcgctcacaaagtagacgggccgctgcacctttcggtggggccggtccttgttgtcaggggcagatgatctggggcgcccttgctcaagggccccaggggggggtctcgagccatgtcaggaccataggcctcgggaccactcgccaaagcctcccctcctcccacggaggcctcggggtcctctcgggggttgggggcttcgggcactgggctttcggggaacgaagtgccattgccaatcaagggggcctccggtccgctctcgtcacgctcgactactagggcggcactcatcgcatggggggtcacggccaagtagagcaccaatggttcctccggccccgaggctaccaagatggggggaggtgaggtaagctttcaactgactgagagcttgctccgtccacacaaacggcccggggcgctagaggagtttgaataggggcagcgccctctctcccagcctcgatataaatcgacttacggcggccatgcatccagtgacacactgcacatccctaagcttgcgggggggggggggcgcatcctctctattgcacgtattttgtcgggattagcttctgtgcctcaggaggagactagaaaaccgaggagtttgcccgccggcacaccgaacacacacttgtcggggttcagtttcatgcgcgtagacctaagattgtcaaaagtctcggccaaatcctgcaacaaagtgtcctggtggcgcgtctttaccaccaggtcatcgacatacgcctctatattgcgccctacctgattactcaaagtaatacgagtcatatgctgaaaagtagggcctgcattctttaaaccaaaaggcatagttgtataacagatagtgcccataggagtaataaagacagttttttcctcatctaccctagccatgcggatctggtgatacccagagtaggcatctagaaaacacaaaaggtcacaccccgcagtggagtcgactatctgatctatgcgtggttaagggaagggatccttagggcatgccttgttgaggtccgtgtagtcgatgcacttccggagcttgccgttggcctttgggatgaccaccgggtttgccagccactctagatggataacctcgcggatgaagccagcctccaggagcagcgccacctcctctcggatgaaggcctaccgctccggggcttgacgccgtactttctgccggacgggtcgcgcgtctggccgcacggcgaggcggtgctcgatcacctccctgggaccccgggcatgtccgacggcttccatgtgaagacgtcggagtttgcccgcaggaaggagacgagcgcgctttcctatttggcgtccagggtcccgtcaattttggcggtcttcgacggatcattgccaagggggatctccttgacgggcacctcgtcagccgaggtgaggcacttcttggaggcgcaggacgcggaggcctccggggcctgcggctccgtggccaccgccaggatgtcgacgcgctgctccgtgcaggcgagggcgaccttgacattaccaaagacggtgatggggccactagggcccggcatcttcatctggaggtaggcgtagtgggtggcggccatgaacttcaccaacgcaggcctgcccaggaccgtgttgtagggcagattgagatccgccacatcgaagtcgatccgctcggtgcgaaagttggtggagtcgccgaaggttaccgggagctcaacgtggccgagaggccacgtgtgtcccggagtcacaccgatgatcggcagtgacggctggagcttcatccccggagccttgagcgcgtcgaaggcagccggggagatgatgctcaggctgccccccctcaatcaaccaggacgcgcttcatcctgacgttgtgaatggtcagggagaccacaagggccaacttccctccacgagcgagcactgttggatggtcgctctggtcgaaggtgaggttcacctccgaccagcgcgccttccgagctgcctcgtg

SEQ ID NO: 5186 - DNA, 24572 bp, Oryza sativa
ccccccccccccccccgccgtcaagcgtggcgacggttccctgaggtatctgaaactacagatcctcgctgtcatcgccgtcatttgcgggggccttcttcttggcctcccctcgccggtcatcgggtggggttgcgggggccttgccctctcgtcaaccttgccacttctcctcatcggctttccggaaccgctcagccaaattcttgatcgagcggcagtcggcgagactgccgataagtgttgtgcaccgagcaccacttgtctgccaaccggccctcgccggatggagcagtggagctcagcttgtcgccggtggcttttcccttgcgcggggcccgtgtgggcccatcggccgcaaggacgtggccctcgtcatcggagcgggccgacttcctttttccccacctatctcgccgcttagagcggggaacagactcaggggtagccgcagccgccgcgctggtgctgggggagttccaggcccatgcctccttccgagccaccttgtccgccaactcgaagagctcggcagtgatcttgggctccttggaggcgttcttctccagcatgcggttatgccgcaagccattccgaaacgcataaacaaccgcgtgggccagaatgcatggaatagtgttgcggacctggtagaaacgctgtatgtacgatcagagggactcgtcgtccttccgctgcacagcatgcaggtccgcctcttctcctgggcgggggtatgtgccctagaagttcgtgatgaactgctggcacaggtcctcccaggaatggatgcagtcggggggctgggtcatcagccagccgcgcgcctgacccttgagggccatggggaagtaattcgccaggacccggtcgtcgccccctgccgccacgatgatcgtggtgtagatctggaggaactcagagggcgaaactttgggggccaccggacgttctggagactcacaacgaaggccctacaaccggtccctccaagggtgaacgtggggggcgggccgcctcacgaggaggaatgcggcactccatacgaggaggcgccttcccccatgcgggcagctcggcgctcgtcccggcgtcgttcgatattgattcgagcgtcctgctctccgtagaggccatcgtgacgcctccggcttcccgaggcccccgacgatgttggagccgtggaccgtcttgaggccatggccgatcgatgggccctcctcctcgccgacaaggagagggtagtgggggtacgcgacgtacctgtggcggtggaacggccactcgcggctaactgccgctgggcactggtgaccaagttggcgacgtcgtccaaccatcgttggacgggggccttcggctccgcgttcaccggagggtgccgcaggagggctcccgcggcttgaagtgtgccctggggcgagctgccgtcgcgataggtcaggcggcggcgcgctctgacgtgccgtggcctccccccgtccggaggcagggagagggccgaaccacccaatcgggcgggatcctccctccgcggggggtcgcggaggggcggagtccgagagttgcgtcggcggtgacgtgggtcgcgactcccgctgggatcctcactcccggaaggagtgggggtgtgcacctccacctcttcctccaaaacctcgaccatgatcgtcggggccggaggaaaacttggggcagaaggaaacgacttcccttcgaagcgcgcgaaatccccctacctagcgcgccagctgtcaaggaagtgatcctctctagcaagagatcgtgggatccccctttcgtgagttcggccgggggaaaaggcccgcctctggaaatcacgtatccgccccccaaggctgctagctagcgtgtacacaacaagattatacaggttcgggccgctatgaagcgtaataccctactcctgtgtatggaatttagactgagagttacaaaggttcctaaactctggagagcgctctcgcttcccttctcctagagctcaggttttctaagagccgtccgctttctcggtgggcaaggtcctccttttatacctcaaggggataccacatgcaccgcttctacctactcttctatccggtggggacccaccctaccttgaccggatctcgacccgtgccttcgcctggaagctaagccacagtttgtccttgagtggggcccaacgccgtccctcgcctgacacgggggacagccctgtcattcccttattaatgggtgaagacttgtggtggccgccctctcgtggggagaactccgaatgaccctccgatgggacgggtcatacctacctccactccgccggaggtagatgcgacatgggggcatggccgtccgtccagtcagacgtgaccggcgacaggcaggtcacagatcggtcattcctgaccgacgcgagccagtcgggcacgccgcacgtctgtccctactgcattgaatgcggtagggggcagttggggcgctgcgcgcattaaaggtggttcagcctgggccccctccccgcttgctccccccgccagatggcggctgggcgagggcctcggggcaaagcggcgcgagggcccgaggggtatgacatggcaccccgaggccccccggcctctattgcgattcgcggggtgcgggggtagggcaaggctgttgggtcacacgacaggatgggaaggtaaattcccctcacttcgcatacccccgggcccatatctccgacagcaatgctaggaagtcatacaatatgaaacggagggagtactacaaaaaaaacttgttttcgccatgggtttctggtacgtcattcctttccgtttcccacttagacggatgtgtttttcacactttgtttccgatttggcgagcggtcttctcacacaacaatgctacccagcactagcgatcccggacgacgtccatctaggcagcgtccagaccaccacttggaccgaagaatttttttcattttttttaatatttacaaaaatagtctatcggtgaaaagatttacaaaaatagaccctgccgccctcactaggccggcaagccgatgtggcagacggcgccacgatggcgtcgtgtgtgcattttgcgcttaggtccggagcgcaatgcaatttgtgctcgacgaaaaaagcatttggctggtttttttgcatctagggcccttgccgccatctaaaaaaccagccaaatgctttttgcagctctgttgttaacaattaaagaattatttattggtaaaacttgttaataatgttttaaaaattgcattgaagtcggttgttttgcaatttcatattttaagtaagagtttatgttgtaacttattcgacatattagtgtacgaaattgatattggcctatcgtagtctcggtcgtcgaaacattatatacacttaaacaaggagaattatgtcacgtaaagaaataatagtagagtttgagcatgatacatctggttccattgcggttacatagataagattggattcaaactaggagggaggtagtgaaagagttaaacacaacgatgatgtagtaatgggacaaatttcaataaggtaagttgtccgataaaagctaacccctacgtgaggatccctctcctctctcaaactacgctttagtaaacctgtattgctctggtagttcaagctgcaccacacggttaggtggagttagaacccttttggtgtctatccattctctgtattgacatctccttggtgattcctgtgagaaacgaatagatgtgaagcgaacaaagttagtaaatcttgtcagaaaataaggattcatgataatcaaaatattcttaccatgaaatcgtcgtctagaatatttggacaaaaagaactttcgacccaaagtcgtaggctttatggaacgaagaacctgacaacgatcatcgcatctgcattttggacggtcttcccatggagggagtgccgtagttaacacccgccagccacactgttgttcacgacgttgtcgttcgtaagccgcttttctttgcaggtattgctcagtactttcggatgagaaataccagcgtcgttcttgtaaataagtagttaggtcaagaacgggattttctgtattgacccactcgatgtatccgcaagccgtagcgtgggtctgacgaatagagtagtatgatgaagaataaaacaattgcccatacaaaatgaataagcatatgcagataataaaatacctcacggtcatagttagggcacctaaaaaagtgctttcctcgaatgtcaggattcatcgaagccattagttggcatcggtcactgcaaaggcagagaggccgctggcaccaaggtggtagtaggtatacacaaggatcgctacaccagttcggatcctcaacaccctagcgtctagccattgccgaaagctagtgggatttgcaatgaaaccagtgaggaagagagtattgaatgtgattgagttatgacagtttgtgagacatcgctcattatggcgacttatgtaggcaccaaaatcgcaatgataaccttgacatgtctacattatgggccatggtgggtcagcctgattggcgctgaaagtaagattggacatatgcggatatataccctgccgccttgtatatgggcagaataaggccttctgcccttttagagggtggcatggcgccaaaatgaagattagacttatgcggatgtgacatggaagattagacgtttgtggaagaataagggcatgagaagccattcagcagtcgtatcacacgcgaataaaggaggctgcatcggtgcggcagaaagtactcgtgcatgcgctgaaaggtattgtgcttttgtaaaaagtaatagtgaactttagggatgcgaaacccgaatagcaactacgtattcattctacaagcatacagtactagcatgtaaagtaattaaacaaagagaagtctgctctactggccctgccccgcgccgcgaccacgcttggtcctccgggcctgtactcacacgtgatcctgggagtacgtgaagcgatccggtggcacatcacggatagcacgagtgtcaggcggtgcagtggagggcgactggtcctacgtctgcaccggcggtgcgcctcccagcaatgagggaccgatgacgtcctctatcgagtgctggaagtcaaagtcgctaatgtcgaagtgcaaagcggaaccccacccgtactccgacgatgtcctggcatggttcatggttggtggaccctgactcgacgtgccaagaagacaaggcaaattgtcatgcgaggcttcgtaagttccaaatctcatctctattatttttttctgtttggccctccacgccttggcatagctaatagtatacttgaatgtctctgcgatatgttggattattgactttggttcatatgtcagattgtcgatgacatgcgcatacatctcaaatgcaacaaatgcacatgtaacgttcctgtggtatttctgaacaccaggtagataacatgtatgcttggtaacgactgacactgtctagtaatccttccattttcccttataagcgtgcactctccagggacacccatctttttccttaacacacctaacttcatattgtaaccagttgagcttggcaaccaaaactctctatgaagtgacactgcaaaatactttgccgcctccttcatatattctccattagcataaatcgcttcttgaataacctcattgtactcccatctcacactatcctcttcagagacgaccagaccagaaaaatcctcagtagcccattccgctggattaatatcgttctcctcatcacctgacgaatcatcttcctctacacgtttgttgtcagaatcctctctctccatttcattccctcattagccactccaccaggttgaatgcccactggaactactacgccaccttcctctggtgcgttgacctcttacacgaaagtctcattcacttcagcacttggtccctcgccatcatccatgttcatttgcacacttggatccttcgggtgaacatacggaagcatagctagaggccacccgtgttgcaatgcattctccacataccatctccacattcgagagttttaaactggcattagttcccaatgaaaaccctcaattgcccgacttactacaagatagattgttatgccacttgtctgtgaatcaactcccaagcccctcatcaaccatccttttatagaaggttgtaacggactcaaaatttcagggaaaaatttttgcaaaatattttaagtcatgctcttcttcattcttatgttaagtgaccttgctttctcttaatctcttttactcttgatctaagttttatttgcaaagttaaaagctctctttttaaattttataaaatccctattttattctctatttatttcaaattttataaaacctttccatttatttctttaatttctaactttggctcaaaattatatttcctttgaacccattcccgaacacctccaacgaataccctttcaattcccgcttaaccatccctagagcacatgaaatatcaacctccctagaatacatggaataccaattcttattctccccggaaccaatactttccttttgatctccacccaactatctccagaatacatgaaatgccattctctaaccaccctagagtacataaaaatgacaatttccaatttcctcaaagataatactctccctttgaactctacccgaatatctctagagtacatgaaatgttgatacctttcctttagactccacctatatttcccagagtccataaaatatccttttcaatccccttttgagtcaacatacccatcctttagagtttatcaatctaccactaattccgttcctataaaaattcctatccacatatacttccgaatccagttctgtactcccacaattattttccctttgaaatctcgttcctccaaattatccatttataaccctgaggctaaaccggccggtgtaattccaaattttgttggaatttattttggatcacccctatctagatctatccacaaaaaacctttacctccttccatccgatccaaaatattttatggttaagttcttattttaatcgagccgccaatttgattaccatggcttgatcgcatccttggcacaagaataatattatcaccaataattgctcttgtgctaagaaacctaatttctaatcccttccatataaagtccgaattttctttagcccaccaccgaatcaccagaaattcataccgcatatctggggactaaaatcctatttattcctccatccatttttaccaccatcccaaatatttatccaaagttagtagattaattatttctattttctttccttccatttgattatttcaatcttacattttaaaatattagaggaaatattttgtgacaagttttatatatttggttcttattgaattctattaaaattggagcatctttattttgaatccttttcaagtttatatttcaaaaataaatatctttagttttatttttaaaatatttcaaacctctttagcattttaaaaaatctattttaaaattccttttctaaaatttcaaaaagatccactaacatttttctttagatctatttcttttgaattccttagccaaaatccaaaaagatccacatccatcctttgatttccatctcctttaaattccttgaccaaagtccccaaataactttctttagattttatctcctttgcattctattcaattcccttcatataaaattaccaaaattctctattcaatttgggccaaaaactcctcatttggcccattccattctcttttttcttttccctccattttttctcggaataagttatctaaggtcccttaacttgtcaacgaatccgattttcgtccttcaaccggaaaaccaggtacaacaggtctctcaactatcaaaaccggtgctgatgaggtccctcggcggttttgactaacgtgccgcctacgtggctaatttaactcggtcttcatctgacgtggcattgacgtggtgcttacatggcaatttatcttgaaaaataataaaacatggaggacccaaatatcagtttcacaaaaaaataataataaatagtgggacctgcgtgggccctacctatcatcctctttctcccctcttatctttatcatctctctcagtctctccggtgggagaggagcaacgttcgtgctcgagtgccggccggcgggaggagaggagcggcggccggtgagagagtgtcatgtatctggtgggctgcatgggctgctggagaaatgggcttggcctagctcacatactgaaggtgcaagcaaccaagaagtataaataccaaccgtggcagtgagagaaggcatcgatgaattagaacctgatggttgtggcctcttcttcctcctcttgatttctcctctaatcccctactctgtgtttctctgattccctttaccccctgcttctcttcccaatctctgctgctagttcttccaatttgtatccctaaacttgatatacagagttggagaggatatattgctcctgtgcttgtgttcaccggtgagattcatgtgggatcgtgacaatatggtatcagagcagtcgattcatgggattccgatccaggagatgcagtggacgacacatgggggcagtgacgactgttggggccaggatttgagccatggaggtgacagtgtcggaggcgcccgtcaggtgttcgatgaaatgccaagccggttaggaagtgctgcaggtgctgcactccatgtccaagtgaaccacctcatctaccctgtgtctaccaatgtgatgcatcaagtcttcaacccctacggagcagtggcggtgcagatgcttgtggtcgatgcatggcgtgtggaggcaattgtttggtttcggacgacctgcgacgctgagtgggctcaggctgaactccacggccgcaatatctacgatgggggctgcgtgttggatgtgcaacatgtgccgaccttgctcgaagacagagccgacattgcgcccaccaagtgttcgatgcaagtaccagtatgtgccaccacaaagtctgatacccagagcactcctactactctggaacacgtgttcccggccaccatgagcccatctgcggcctcaaccaaatcagcagtcacaacaacgtcggcttcactcaccgaggccatggaggctgaggctagcatggacaaggtggtggagaatgcaggcaaggccattcaagacctgtgcactaggatcgatcggattttggaggcatttcgcgacaccaaggtggatttatccgagaacaaggattccactagagatgtggcagtgttgagcgccaacactagtccaactaccattgcattggaggtcagtgctgaggccggcccaactaaccatgttgactcagccaagcttggcatgggaacaaccatcgagtgttcaatgaaggggaagaatcagttggttgatgatgatggcaaagacatggccaacgatgagagaactgagctcattgaagtggataccaagtttacttctgtgaatttatgcttcagagatccatggttagccctcaatgcaattccttccaggatcttgattgggtgtctaagccatgaccttggtgttaacagtctctcgttggttccatctacgttggaagtgccataccattgctttgtattgggctcagtatgtagagttagctctccaccagtaccactttggagagtggcagttccattgtacagcgatcaggtctattcaggttctcggccctcgccatggcctgatccatggttgcattcaggcagcggaagtgtggtggtatttcagcctctccaaccatggccaccccctctacaagccaagagcaaaggttctattgttgagcggcaactagaactgtggcatgatcctcaaataaaacaagataacaaaggtgttgtggtgaatctcctacaacccagactttcacctgacaaatggaatgagtcttggttcagttgtgataatgcttgggagttagcacaaagtcactgcaagttcttgctgacagaacacatggccttgattgcacaatatgaaaagaatcgctttgagcaagatctaagtctgtgtatggtaagcaaaagggcatcctggaatctttggaatctgttgactgagggatcaatatcattaatggaagcaaaagcacaattgtttaggaggatgcattgggttggtagtaaaactatggatcaatttgtgtggaatttatgcatgccgaatatggagaaatcaccatggccaccacctcctcataagatcagaactgatttattgtggttgaattcgcatgaagtatcatctctccaattcaatgctgaattctggaggttgctggcaagaatcaatttgtttgattgtcattctggacaagaggatatgcagctgttccaggcaggtgcaaagcagtactctcctttggtggttagaatggcccttgccgatcatttacaagcaccctgggaccctggaggcagtaacctggttactctcttgcatgttaggaaggacaggcagcaaccaccaccacgaccactgcaaattgtctttcctattggattatctggtgtgaaggtctggctattgtttgctctcactttggtgcagttccttggatcggttaccacgtataatgcaaagttttggagattttcgcctgatagtgtttcaatccaagggagtaaagaatccaatttcagggttgcataccttatgtgcagaagttcagataggcaacttgcaagcagcaatatagctctgaacattcaaacaagctcttcttgtcatgttttacacaagtgtcgtcaagttctaaattcttgtcaagcaccaagttcatttcagctcaaacttacagcaagttgtttactgggcaaacattctcttagaaggaaaggcataggttctgttcctactgacaaaagaacccatttacaagtgctgctgcatcaacttatgtacaagaaatcatatcaaatgtatgagaccagagctcaagtgctgaaactgacaaggccttggaatcttggaattcttcttctcaacaattccttgatggctatctacagcagaagttgttgcatcgacttggggacaagtcgatttttaaggagggaggaatgtcatgtatctggtaggctgcatgggctgctggagaaatgggcttggcctagctcacatactgaaggtgcaagcaaccaagaagtataaataccaaccgtggcagtgagagaaggcatcgatgaattagaacctgatggttgtggcctcttcttcctcctcttgatttctcctctaatcccctactctgtgtttctctgattccctttaccccctgcttctcttcccaatctctgctgctagttcttccaatttgtatccctaaacttgatatacacagttggagaggatatattgctcctgtgcttgtgttcaccggtgagattcatgtgggatcgtgacagagaggagcggcacgcgggcgccagccggtggaaggagaggagccgcgggcggaggccgaggggggaggagaagttggcgggatttgggagggaaaggagagggagaagcggccgccgccgccgccgccgccgctccggagtgttggctcctccctttccgacatatcttgacccacatcgtttctgttgttgttgtcagtgtaccactgggtgctctcaagcacggggcgcctcgacggcgtgctggccggcacactccgcggctacgtttggtggccgtcgatctgcgactgccatgggggagactgtcgcagctgggaggcgagaaggcggcgaccattggcttgggccccagcctcctctccaccatgctagcacatcgacgggagctcgggaggctgcggtggcgcaaaatgatgcgggagctcggctaggcagcactgccgccatggagctcaatgcagtttgcggcggatagctacccgcgtgcacgacggtgtgggcaccgcatggcgaagcacgcgctcagagatgcattggggttgccgcgacggacggagccgcacgctgccgaggccacgcgcggcggcaggcttgatggagaagcagaaacagttttttttttttttccgttgcagcgcggcactttgagttttggtccttggtaatggtaggagcaggagcagaagcaaccttgttggcttgttggccttcctgcctttcctgcactacttcttccccgatcaacccttgaaccaagttatgtaggacttccacaacaacagcagcatcagcgacggcagggactggatgtagggatgggtaatcaactaatcatgctttccggcggcggcgactaatcaactaatatgctccgtcgcgctcgccggcgaccttctcctctgcctcctcctcccccagccacctctccactgcccgcggcctgccgctctgcccgcccctccgctcgcctgcggcctaccgccgccgctccggcgtgaggatgagggagagccgagaggaagaagagggacagccgagagggacttgtggggcccacgtgggtcccaccatctttttttatttgacatgtgggccccatcattttttttaatttatgtgtgaaactgacatgtgggtcccatgaagtttattatttttctggatcggattgccacataagcgccacgtcaatactacatcagatgaacaccaagtcaaataagccatgtagacgccatgtcagccaaaaccactatcaaaactaccgagggacctcatctgcactggttttgatagttcagggacccgttctatctggttttccggttgaaggggaaaaatcggattcgtggacaagttaagagacctcagttgaacttattccaatcagttataacatgcatggaatgaaacaggttctcgaaattgtggacttactaaattcctctcttattgggcctcactctagctaggcccagattcctggtaagccttgtagcaattggtgtagtcgtgtagaggatctgattgctttttccaaactttgttttgtccttcactgcataaatatacacttatgtattttacctattttatttaagaggcttctctgtaaaattggttatactctcagttcttcctaataaattctatgcaaaaattgctactacgcatctaaattttatggtctttggtgatggccaattggccatcagaagaacatatataccctgaggatagattaaaaacttggtaatttattgaggataccattgtcattatttaattattattttgggataaatggagagagaaacatgcgaatatttatcattaaaaatattcactcatcctagcgcattgcaagcgtgtagattaattagcaaccgatatgcaagctagtactccctccgtttcacagggtaaaccattctagcatttctcacattcatattgatgttaatgaatctagatactttcacaatgtaagccattctagcatttttcacatttataatgatgttaatgaatctagatatatgaatgtggaaaatactagaatgacttacattgtgaaacggaaagagtacattgcaaggggcttttaactatttgccacttttagatttggcaaataactatttgccacccctatctcaatgacatatgggtccagtggcaaaaagttatttgccacatctaaatatggcaaatggttaaatatctcacattgcaaggatcctttataacgtgctcatatggatatgttggctacataatgtagtatttataaattataatgcgagccgaatcaaaaaaaatgatacaaataaaagttattgttatataaaaaaaacgttttaacctgatgtctactaataaaaaccaacttcttactacatagttaggcctggtttagttcctcaaattttcttctcaaaaacatcacatcgaatctttggacacatatatgaagcattaaatatatattaaaaaaattaattgtacagttagggggaaaatcgcgagacgaatcttttgagtctaattagtccatgattagccataagtgttacagtaacccacatgtgctaatgatggattaattatgctcaaaagattcgtctcacggttatgaaattagtttttttcatttgtgtccaaaaaccccttccgataccctgtcaaatatctgatgtggcaaaaaaaaattcttttcacgaattaaactagcccttagaaggtaatttttttttaaagaaatgaataacttgaggttggagccttggacacggtgtgaactcccaagtacgaaagtctagtttgcctgcgtcattgtagtgcatatacgcaatgaggcagccctcaattccgccgcatcttttgttggtcaaaggatgggtaattgtatgcggccgccttttttccgtggtagatgttctacttctcatgcctcagctgcatttctggagcaaaggacctgacagttcgatcgagcgagctagcggctctgattgtttgataaatcgtaggaaatacaaactaatcaaataaaaaagatttatacgataaaacttagcgatttaaattgagttctgaaaaacaaactacgatgaatttttttttaaaaatcaagatgcagatgaacaggagttcgagagtttgaacttcgagtagctagcaaagtcaatctgaacagagtgcacggtagattcgaccttttcttatacggtgaagctcaattttgggtagatattttattcgtctctttactagtgataaaataagatctaggcaacgcaggtgacaaaaacaactaaaaactaattacgaaatcaaactataagaaaaattaaaatcaacttgttgaactttatgggaaaagctggtcatgtgatagtgagttgtaggtaataagttcaaatccataaaatcaagatatacctctaggatctctcttttctaatatgtgttaggagacgaattcataaaagtgttgtattgcttgtatatttgtgtatgtgcatgtgtaacaataattaccactttggttatggatgaacggtaaaattcaaacaaattttataaaacaaatacatttcagtttgattttattacctgtttaccaagcaatttctagattcctaccggcttgtctgatcaccatgatgactgaggctgtgttctttgctcctagtcccaactcctctcccttgtttctatacaaaagttgcttaaaatatcataatgatccatttttttaaaaaaatagctaatacttatttaatcacgtatcaatagactactcctttttcgtgtggaggagttttgttcccatccacccaaaactaacacagcctgagcagttaagatgactagccccaacgtttggcatattgaagaaaaaagcaaaacgatatatttacaaatgaaaaataatttatgaataaaacttttatctacgtgttcttaatgatctaaaagcaaagaataaaaaataaactacactgagaaaaccccaaactctaaattttaaaatttaaattttggctaataagtataagcataactgtataagcaaaatgatgatgcttgacatttgccatccgtaccgtgatcctccttttactgctcaccaagaacgagttttaacacaaattaagattgatagaaaatgatgtgattgattaagcttataaagttaaaataaaatgtttataataaagtagtataagacggcctcgacctcttggtgacggccttgatggaggcattggaccttgtagtcaactcagtacatggcattttgcggcgagcaacgtcgacgacttgatggaggtttagacaagtcggagtcaaaagaaacggactcgataggcaaaaaggactgccatgattatgattggagtccctggcaaagtttggccgagttcaactaactcacacctaatttctgaacaaggcctacgatttataaaaaactgtatggaactgcactaattccctaatttaaacagatcaactggcctcaatgtatgtttgaaattcatgtgagccagtcaatactgcattttataacagcttcagctatttatataacggaattatttaaagttgacaccaatagaggactagaagagtgcagagtgcataacgctgagaacaagaccatgttttaccagatgctcgctgccattctccaagcacttcttataggtacgtatgctggctgcaacatatgttcaccattattatcatcaccatttttctctttctgaaattgcctgtgacatgctacacagctcagatgattcatgggcaaagcgataaggaagttcttgttcagctcaagaacttcctgcaggtgcaaaacccgataaaccacggcgcttacgtcagctggtcggagtcagaggcctcgccgtgccattggaaaggtgttgggtgtgatgatgccgggcatgtgaattccctcgatctttcgaactcaaacatcgcaggtccattattcagaaacttctcacgcatcatgcggcttacccacctaaacctttcatcaaacagcatcactggtgaactccaggatgatctcaaacaatgccagagtctccagcacctcaacatatccaacaacctcattggtggcatccttgatttgtccagcctgaccaaccttcagacactagacgtatcccaaaatcggtttcagggaaggatagacagaaacttcccgggaatatgcggcaacctcactttcctcagtgtctccagcaacagcttcacaggcaggatagataaactatttgacggctgcccaaagctcaagcatgttgatctcagctggaacggcttcaccggcatggtctggccaggcattgaaaggcttagacagttcaaggccaacaacaacaacctcacagggagaatttctcctggcatgttcacagaagggtgcaaattgcgctcactgaacattgctatcaactcattgcacggtagctttccaagctccattggcaattgctctaacatgaaattcctttcactatgggaaaacagcttttatggatctataccaccaggaattggttcgattgcacggcttgaggagctggtccttgcaagcaacagctttgatggaattattccaatggagctgacaaactgtaccaacctgaaatatttggacatcagtgacaacaattttggtggagaggtgcaggatgtctttgggaaactaacatgcatgaggagtctgttactccaagagaacaactatactggtggcattacctcatccgggattctccagttgccgaatctaattgtgcttgacctatgctacaaccaattctccggtgatttacccagtgaaatcagcagcatgaagaatctcaaggttctcatgcttgctgaaaacaacttctctggtaaaataccaccaacatatggtcagcttctcaggctccaagtattggacttgtccttcaacagtctttctggtgagattccaccagacattggtaacctatcatcacttctccttttgatacttgctgggaaccaaatttcaggtgagatcccaagggagataggaaattgtaccagcttagtttggcttaaccttgctggaaaccagctaatggggcaaatcccaccagagatggcaaatatagggagcaatccaagcccaacattcatggagaatcgaaagaacccagaacttttggaatctatcaccagcaaatgtgtcgctgtagagtggcttccatcaagttatccagaattcaactttgttcagtccctgatgatgtctcagaagaactgccaaaccatatggaatcgactcgccatggggtatgacgtacttccaatatcttcaccactgcgaacagcattaggatatgttcagttgtcaggaaatctgctgtctggagagataccatctgctattggtacaatgaagaacttcagtttgctccttcttgatggaaaccgactctctggacacctaccagcagagattggtcatcttcaacttgttgctttgaatatctcaagcaattttatttctggtgaaattccctctgagattggtcatatggtaacacttgaaagccttgatctgtcaagtaataacttctctggtgcactcccatcaaaccttaaccaactcactaaactgagtaggttcaatttgtcatacaatccgcttctctcagggaatgttccaagcagtgggcagctctccacctttgatgagcaatcttttctgggagatccactgttgtctttgaatgtaacagcaggttccagttctgattctagtccaagggagttctcatcatctgacacagaggagcatcctacaaacgaagagatcatggtgacaacaattgcattccttgcattcttttcagtcacattgcttaccagagaatttcatatcttcatgtacttgtacttcacagcatcacggaaaattgccaactgtaggattatttgcacctgagtgctagataagttaaatcacttaatagaacaaatacctttgaaaagcgaatgtgtccctttatgttccatttctgatttcaaatataaatatttactagacaatatggcatgctagttggcatgtagtcacattggacaaatcagttcaaacgaagctgctgaaaagatgacaaaggacatatgcaaccgaaaaggcttggttgtgaagattggagaatcagcattttcgaccaaacccctctatagtttgtaccagcaaccataaataagtgcactgtaactaaccatgctgtagaactgatattactgtcgattttaaaaagtgaccaaaccataatgtagtaatgtactgcataaaacactatgatatcaagttcggtgtcagcactgataaagtttccagcaaacatgcttcttgttgattgcagtcttcctaccttgcatggcaacgtgccaactcaaagagttataagtagaggatctctttttccaaaaacaaatagtaagtttactgacaactcagtgctcttacaacaatgtaagcatttggcaatacgcctcttttgtgaataataaccatccgcttgacactgggaatctccaaggttggtcaaaattcacaaatacatctggctatatatgaagaattgtttcccgctgtacgtttctcttcaactgcaactgcacaagctcctatcaatgaaacagctgataccatgaaaatatcatttaatttagtcaagaaagatgaaataaattgtaaattgcagaactatttaattcatacggagtctaaatcagctcaaaggaaagaagtggactctaaagctttgcattttgaaaaagcataggtcaatcatacaccatggaaatattattttgaatcaaggtctcaaggaagaagcaaataatacaagtctcaattgcataattaaatcagatatcatataattaaggatgaactgaaggatatgcccatatcttaaatatatcgggaatatgtagcaaagagatagataccctactctaatcatgtagacagaggtactgcatgagcagttattcaacagacattcatgacttcatgtacccagtcccatctcttagagtggaagacttctaccatgtaaaaaggcatgagcaaatgcaaagggttcagcctgtatagttatttgattccagtgcaatagataatcattgccaatgcatgtctctagtccagaactccagattgccatatcaataaattttgaagtcactatttagctggtaagttgtgttaagtgaaccaggctcaaagtcattgtactcggtggaacttaaccgtagcacaaataacaacatgaaaatactatgacttgtttctcttgtcatcttatccaatgtgttgtattcaatagtatccaccttggaactcacatttaaagaaaccattttggaacaggggtacatagaatgtcagcttgattgagatggatttgtatacagctaactaccttagtagatgcactttcaagagtatatgcatctgtaggaagagtttgctatcagggtttcccttaccatttaccgcctggtaaccgcgataaactgagaaaaaccggacaaaatttaccaaattttatttttttaaaaaaaaaatactttttaacgtggtagggataccgggcctttaccgttactgtgccctggtggtaagcctggttaccacagtaaccagtggtaagggaaaccctgattgtggttgttattgccttttgttattgtaaattttccgctacttaagggattggataaggtatctcagttgcacttaggagcactagatgttgtatgtagttttctgaccatctatatcatcatcaacaaaacttatatctgaagttctaaatgtacttcagtttgtataatagtgagaacatttctcattgaatgtgagcacaaatttctaccaagatcattttcttggttgtgttggggatagtcaggtcacagtcatctagccatggatttgaactttatgagaaagctggtgaataacacatgtgattgaataatttttttgcgaaaatggtgggccagtcccaatctatccagtgtagtgagcactaacttaaagcattaattctaagagtccccttttaaacactaaagttaatatagtgaaattccgagcatttgacagattcaagataagcagtaccttagaggacgttttgagatacgttttcacctcaaatccatctaaccctgaatgatgaactcttagttattcggtttaacttttatcaagaggttgtaactataataagtaataaggtgcattaaattggtcacataaaaatgaatcacaaagcatgtaaagtaaaggcatcatatgcacaaccacagaggagaattttaaataatagatcagcatgggagagactgagttttagatgaacatgtcaataagtcatgctgagaaaacaatgtcatgttaaggattacatgaattcatcatcaactgtcaaaggaataaacagctatattgtcaagtagaaatatgaacaaagaaggtcgatgatgctttatcattaaaaggcatggtctagaatgcttaccgatgtgatagtgtacattcttcaatttatccaaatgcattcctatctgatctgcacatcccagaaatagcaagctcaaagaaccacaatatcctgattaatctctagaagaacactactactgaattccttaattaaatttctctgcatcacatgattacatatctaacactaaattgagatgcttgtcccaaatattagttgtatttaccttcctgataaaaatatcccaagaatcatcatccaagaaatcccgtcaacttaaaactacaatttcaagaattttgctaacgatatctttatgtattgactattgagtcagaaaagctatcaaccaaaatttgcaaaagaagctttgcttggactgcatcctctggtcaccatctcaaaaactgcagccccttcatttggcttccccgttttgcataatccctttatcaatacatcataagtcgttgcatttggtccatatcctcattcaaccatcacattacacacccgcccagcctcctataactccacattttcacataatcctcaaataagtgaattctacgttaacagactcggtttgaaacccctctcgagttcatcaaccaggttcctttccttgcaaaccattccattcttgcccaaccaatagatcaatgtgcttgtgaccacattatctggtggcacgttcttctgtaccatccatctcctcatttcatatggctcatttacttttccaccttggcatagcacatcaacaactttagcacctcacttatttgcgtgcctcagcagattttgtgacctcattcggttgtaacctggccacatccataattttggctgcatgttggagcattccgcactggcagtaactgccaatgagcagagtgtgcatcgtagcatatggtctacagtcactcgcaactatatcatcataaagattttgtgcacactcaagatccccctttcccacagtggacagcaagaaccgtggtgtaggtgacggcatctggggcgatccccaggccaggcatttcatcgagtaccttgagggcagaatccaggtcaccgatgccaacaagccccttgagcaggaatgcaggatgttgcggtagccgatagacgagattgggtgtgatgtagaggttagtaggcacatcgcaagagagcgcggcagcaaagcggaggcggcgcgcggagatgagagaatgaaggaggcggcgcggctagggctggacggtcgaggtgacggtgtggtgggcgagtggcacggtggtggtctttgcggtggagaaagagagggcggtgcagcgtcggcgtcggcgggcgtacactaacagcggcggcatgggcggaaggaagggaagagacaaattcacaggggctgttcttaaaattccataaaacattctacaatagggccactctgtaaattcccatttttctctttgtgaaatcatgaaagccctcactgtaagtgaagaaaactacctcgtttgttcattataagatattttgggttttaaatagattaatgcacgggttcatatatgtgtcaaaataccatatttatccccactaagaccatgtttgtttcagcgatttagattattgagtcagattactgtaagctggattataataagctggcgtagaatgagctatgagttatttgtttctctggactattggaggcatggattactgggtttgaaaggccaaagtttataatgtcctcaactattttggatgccttgctcatcctttttgtcactatatacaacaaatacatattttgaaaatagctaaaaaaataatgtcatgtattaataaataaatcattcatgacaacttttttataatagagtaaacaccaaattattatctcctagcaaataaaacatcggaaatattatcacacaagatatttgtgtctccctcttcgtctccaaattgactagcattcgcttgagatgaaggcatcatcatatagttttcatcattatcacaccgatcaaactcttcccactcaatttactatctcgaataaaattatgaagcgccatgcatgcatgtataatgcatatatagcatcggataactcatatgtccaacaaaatttctccatttcatcttcaaaataccaaaagaacgctcaatcatattacaaatagatgaatataagtggttgaacacctccttgtcactagaatgcctagtgaaggagccggcgcgcagtgacggtccagattagagagaagcccgagcgtggggtgaggaagacggcggcgcggctaaggtaggagaggcccgatgctcgcgtgaccaggggacgaggcagtggcgcacgctgctgggggaggaggaggccgatgcccacgcggccggggtagatgcacacgcggagtggggaaggagtccgctctgtttggttggatgacagagatgggtaatttcttttaagtatcttggggtagtgggtctttagccgtgaaataatatggaaaaaaagcacttttggaggaattaccagattatactaatatggcttatatattatccattcatttcaaattactcataataatctagattatgataatcttaaactaaaacaaacagggtctaagggttacttaagtgctattttctcaagaagccatatcacaacaattgttgttagcctttggataattcatcaatggtgcaaattgcatcttttcttcccaaaagctgcaccatataactcagtcatttataacctttggataattagaagaagggagaagaggccaaaacaacttgacggagctcgtggctcctcaccgggagaccgcgcaggcccccctttgccggttcggccgggggcttagggtgagatctcaagctctcgctgtgtgtggaaagatcgtccgcccgcaagacacacgagacacggcgatgtatacaggttcgggccgctgcgaagcgtaataccctactcctgtgttttggtggatctgtgtatgaaagaactacaaagtgtgagccgacctctcccttgttctaggctctgaatctggaaagaatcatcccccttctctatgggcaaggtcctccttttatacttcaaggggataccacatgcacccttctctttccaaactggacttttcttctctttatggacggagattggtatggttgctgtccgaatgacactttgatgggacagcccacacctacctccactcccagcggagacgggcgcaacgtgggatcgtggcttccccttgctgacgcgaccagtgtcagaccggtcattcttgtccaccacgcgtcagtttaatagcatgcatgttttcccttctt

SEQ ID NO: 5187 - DNA, 22093 bp, Oryza sativa
gacgggatggggcaaggcgtgcgtcagaccgccagtcgccacctaacccttgatctgaccggtctgtgactggtcacagaccggataaaagagcgtgctgtactgcgttgcatgcagcgtgacacgcttgaccaaactgcaataaatgctgttaggtgagcacagctgtgctcacttatcccatatatgtggcgcagactcctttaaggggtcggggtgcttcggccctcggggtcggggcaaaagcaacccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattgataactttggttgtccataatgggcggtctattcaagactgccacatcacttgagcagcgcgcgaatctgggtgagcagatttgtctcgctcggagatacggtaacgccgcttcagtcggcgagcgtaattaacgcgcgcacgatacaatccgtttcgattgccacaaccgcatatccacttcacgcgccgtaagcgggcgaatgggattagtggaagcgtgggcacgggaaactagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctactttcgccacacgcgctcgttctcaatcatctcttcctcaaccgccatggcacggggctctgctctgctcgacggcagtgtactaccgccttcccgcatcgtgaacgagaggcacgccggactgccgcgccgcttcatgcctgagtccgccaccggtcgggagacagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcgcacctgtgcgagatgtttattggggtgcgcccctctcttcagctgttccggtggttcttcaccgtgcagtcggtgtcaccgccgtcggtggttggcggctgctacttccagccgcgggggccggtgttgaatcgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggagtacgacgccgtcctcgaccgcctggcgggcctgcgatcccaggggctcaccggggccatggtgtacggcgattacctccgtcgccggattgcgccgctccaacggcgcgcccggagcgcctgggagtacactggtcctgaagactacatgcggacccaccagggagccagatgggattgggctcccgaggacttcaagatcgtggtccaaagggtgctgaatcttggctccgcggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagctgggaggaacacctcccccatctcctccccgagggggcggggcggcgcgtgccagtagtcggcgcccggagggggccgcgccgacgtcacagcccgagggggagcgcaagaagaagcggctccgcaagatgggggagacggaaccagcccggggaaacctgatttcccctccaaagtggtcatttaaccgaccccctcgcaggttcgtctcactcttattgcgaccatctttctcccaaacggaagttttttcttactcattttgttcgtcttctggttttttcttctgcttcagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcacttgggcctactccctcgggcggccctcaggcgacatccttcgaggcggctcgcgacgaggccgcgggcgcgtcgcctgggcctacctcaccgggcgacgcccaggaccaaacgggcccgggggacatccccgagcccagcgcatcctccggggggccaagccgcgtcgcattttctccaaggcggctcttttcctcatcttctgtcgccccgctgagcgccgagccccttctgcaggccctggccgccgcgaacaccgcagtgctggatgggttcaacgcccgagtggaggccctgcgtgcggaacgagcggagctcgaggccgcatgggcgcgtgttgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcatcgccaccaccgcgatggtcgaggcgcaagacaccctccgccttcaacacgcaagctgggaggcggagctgaagaacaagctcgacgccgcccaaggggttctcaactccgccgctgcccgagagcggcgggcaacggaagtcgaagcggcgtcccggcggcgcgaggagtcccttgaggcccgtgccatggcgctggaagaacacgccggcaccgtggagaagggcttcacggaccgcgaggccgccaccgctctccgggaggcgacgctggcggcgcacgaggccgcctgcgccgaggaggagtccgcgctccgccttcgcgaggaggcactcgctgagcgggagcgaactctcgaggaggccgaggccacgacgcaacggctggcggacagcctctccctccgcgaggcggcgcaagaggagcaggcgcgccgcaaccttgaatgcgtccgtgccgagagggccgcgctggagcagcgggctgccaacctcgaggcacgggagaaagagctggccgcgagggcgcgcatcggtggggcggctgcgggcgaaagcgacttagccgctcgcctcgcggctgccgaacacaccgtcgctgacatgcagcgcgcgctggattcttccatcggggaggccgaggccctccgcttggcgggcgagatggggcccgacatgctttgggactcggtctcccgcatggatcgcgccggtcggcaagcgggcctctggaaaggccagtcgaggacgcgccctagcaatctggaaggcctcgctccgcacctcaacaggatggcctgggttctcgaacgactccccgaggagctcgagaagaccattaagtcatcctcgagggacctcgcccggggggcggtcgaactcgtgctggcgagttaccaggcccgggaccccaacttctctccatggatggcgctggaggagttcccccccgggaccgaggacgacgcgcgcgcgcgggtcggggatgctgccgaccacatcgtcaacggcttcgaggggtcggcccctcggcttgcgttcgcccccagctccgacgaggagggcgacgccagcggtgaggacgacagtggcgaagaggccggcgacccgggcgcgttggaatgagcccccaggcccccgccaatttccaatcttttctttttctttcttctttttgtatagatcaacttaatctgcaatcaaaaatgatgaaaaatttctatgttaactttattttgctatacatatgagctgaggatgatttgtgccgtggtccttttgcgccttagcttgaaataagggctcgtgcccaagtcccagtcctcgagtggttcgggtcggggctagtgcctggggagatccacatgtcgagactggccaggccgggaacatggtgaccgaggggtatgggtgacccgattgtgggtttttgccgattcccccccggagttcaccacgccccggggcacggctcggttctgggccccgtttggcgattttagctgaccgaaccgaacccccaagggcaaggttgagtacgagtgaccttattttaagttaagattcttcaaaaggaaagaacagcacagacacaacctttaggaatttgaaactgcttttattgaaatgctgaaataagaaaagtaagactgtgcatgtgtggtagcccccggccaaccctgcacacccgaggggggtgcggggttggcccgagccaaaacctgacacccgaccccccccttcaggggtagaagcgacgaaggtgctcgatgttccacgggttcggcagctcagtgccgtcgcccgtggccagccgtacggagcccggccgggggacgccgattactcgatacggaccctcccacattggtgagagcttgctcaatccagcacgcgtttggacgcggcgtaggacgaggtcgtcgacgcagagtgatcgggcccggacgtggcgctgatggtagcgccgtaggctctgctggtagcgcgcgactcggagggccgcgcgccgccttcgctcttccaagtagtcgaggtcatctctacgaagctgatcttgatcagcctcgcagtacatggtggcccgaggagaccttagggtgagctcggatgggagaaccgcttctgcgccgtagacgaggaagaaaggcgtttccctggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcacagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttggtgaacttgtcgatcgcaacatacagatactcaaacccgcccggggcccgtttgaacggtcccaggatatcaagcccacagacagcaaatggccatgacagtggtatgatctgcagggcttgggccggctgatggatttgcttggcgtggaactgacacgctctgcatcgccggaccagatcgactgcgtcattgagagctgtcggccagtaaaatccttgacgaaaggccttgccaaccagagtacgcgaggcggaatgggctccgcactcgccctcatggatatcagcaagaagctcaacgccttgttcctgagatatgcacttcaggaggattccgttagccgcgcgccgatagagggtcccttctaccaacacgtagcgtttggaaatgcgttgtacgcgttcactcccttcgcggtcctcaggtagagtcttatctgtaaggtatgtttggatctcagagatccaagcaatcaatctaagggagcttggagcgctcccttcgggtcccgaggcctggactccgacgggcctcgggggccggtcaggcgcatccgtctcccctaagggatcgggtcgcgccgacggctgggtcagcctttcttcaaaggcgcccggtggggtctgggctcgcgaagacgcgagccgtgagagttcgtcggcaatcatattatcccgtctgggcacatgccgaagttctatcccgtcaaaatggcgctccatacgccgtacttggcgcacgtaggcgtccatctgcgggtcagagcaccgatactccttacagacttggttaacaaccagctgagagtcgcctaacaccaggaggcggcggatccccagcccggccgccactctgagtccggcaaggagtccctcgtactctgccatattattagtcgctcgaaagtcgagacggaccaagtatctgaggacgtctccgttcggagaggtcaacgtgacccctgcaccggcgccctggagagacagagaaccgtcgaactgcatcacccagtgggcggtctgaggcagccgagaggggttcgtactggcctcgggtattgagacggtctctggagccggggtccactctgccacaaaatcggcgagggcctggctcttgatagcgtggcgtggttcaaagtgcagatcgaactcagaaagctcgattgcccactttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctaggggccgtacccccggggcgttcttcatccaagtggcctctcggggcgcactcgtcttctgtgccgatgacctcggggtcggaggatgaaaggggcggccttccctcagtggcctcggggccgtcctgagggtcgggggctcctggcatcgtcggacaagcgggtaaagggcctactccggtcgtcaggggcctctggcctccgtccggctcgggggcctcttctccctgctttctcccgggtcgagtcaacacagggttagcctcggggccaaagggcgataggtgcggccttcccgcagtggcctcggggccctcctgagggtcgggggcacctagcaccgtctggcaagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgctgctaagtaaagtagcagggattcatttggatccggggcaactagaaccggaggagagctgagatacgccttcaactgggcgagggcattttcagcttcctccgtccaagtaaacggcccggagcgcttaaggagcttaaacaagggtagcgccttctctcccagccttgatatgaaacgacttagggcggccatgcaaccggtgacgcattgcacatccctaagtttgctgggagggcgcatccgctcgatagctcgaatcttctcggggttggcctcaatgcctcgggcagagaccaaaaacccgagaagcttgcccgcaggtacaccaaacacgcacttatcggggttcagttttatgcgggcagagcggaggttttcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacccgcattctttaacccgaagggcattgatgtataacaataagttcctacgggggtaatgaacgcagttttttcctcatcctccctagccatgcgaatctgatggtaaccagagtatgcatctagaaagcacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggctgtcgcccaaggcaacctccttgaccggtacctcgtcgcatgtggcgatccggtgcctcggggcggtgggggcagaggtgccaagcctctcgtcaccaccctcgggcttgggcgcagcagcgaggcggtcggcgcgctgctccatgcaagcgagcgcgactttaagatcgccatggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctgatggccacgtgtgccccggcgtcacaccgatgatcggttgagacggctggagcaccatccccggggccttgatagcatcaaaggccgcgggggaaaggatgttgagagccgctcctccatctatgaggacacgccccaacttcacgttgcagatggtgggggaaactaccatcgcaacctgccctccccgggcaatgcacggtgggtggtcggtctggtcgaaagtgagagcaacctccgaccaccgcgcccgacgcatcgcctcatgagtaggagccatggccagcagctctcgcttcatagccttgaagctccggcgagagatgtgagcacacgctcctccatcgacggtggcaatggtggccccaggttcttggaaacctaggtcatcatcaccatcatcgatgccaacagcgggggccttctgcttggcctcacttcgccgtttgccggaaggaaccgccggggacttgccctcacggcgttcctgcctcctgtcctcctcccacttcctcgttcgctcagccagatttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcgaagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtggtctggggctctttggaagcgatcttttcgagcatgcggttgtgtcgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgtggatatgtgccttggaagttcatggtgaactgttggcacagatcctcccaggagtggaccgacgcgggtggcaagttcatcagccaaccccgcgcctgtccctttagggccatgggaaagaaattcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccgacaccaccagccgggggcacggagggctgatcctcacgtccatgtcgaggtgacactctggacgaggaggcgccctccgttgcacggggagtacgccggctattacgccggcgctcgatgttgaggcgggcatccggctccccatgctgatcctcccgagtcgagggtgtcgacgagggagtggcagccgaatgccgtgcagccgccgccgctcgctgcgccctccgccttgacgacacggagccggtggtagcggcgccggaggtcttggtggtggcggaccgtccaccagcacccaggcgctgctgtgccgtcatgaccaagttggccacgtcttccagccatcgctgggctggagactcagggtcatggacgacgggcgggtgacgtaggagcgcgccagcagcctgaagcgcaccctgaggcgtgctgccgtcgccgtagacgaggaggcgacgctccccatctcgctgttcccctgcatcacctgcgactggtgatgctgcggatttattcaccctctcgagcgcctccccctgcttaggactttggtgtggaggtgggggagtacgagctcgacgacgtgggtttggctctccgtcgtcgccgctcacactcggagagaggtcgtgcgcctttgcttgctcggccattaggctgaacaagggaagcttggcggacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctcgctgtgtgtggaaagatcgtccgcccgcaagacacacgagacacggcgatgtatacaggttcgggccgctgcgaagcgtaataccctactcctgtgttttggtggatctgtgtatgaaagaactacaaagtgtgagccgacctctcccttgttctaggctctgaatctggaaagaatcatcccccttctctatgggcaaggtcctccttttatacttcaaggggataccacatgcacccttctctttccaaactggacttttcttctctttatggacggagattggtatggttgctgtccgaatgacactttgatgggacagcccacacctacctccactcccagcggagacgggcgcaacgtgggatcgtggctgcccgttgctgacgcgaccagtgtcagaccggtcattcttgtccaccacgcgtcagtttaatagcatgcatgtttgcccttcttcgtgtaacaccttgtctgtaatggttaggatgaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttgcatgcagcgtgacacgcttgaccaaactgcaataaatgctgttaggtgagcacagctgtgctcacttatcccatatatgtggcgcagactcctttaaggggtcggggtgcttcggccctcggggtcggggcaaaagcaacccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacacaacttataatatgaaacggaggaagtagtagtcatttgttttttcaaaatgaatgcacaggcaaatatgaagtggaaaacataactcgcaattttttttagatggtgcacaaatattatattaaactagatgggtactccacgcgttacagcaggagaattgtgtgataatatagtagatatgagttctctttcttacctactatacgatttttttcatgtgtttatatattttgtaactttataattatcctaaggatataaatggtttggttgtatggtgtgccttttgggggaagagatgcaatttacactcttgatgaatcatccaaaggctaaaaacaattgaggtgatgtggcttcatgagagaagagagaattagcattaactacacttagtggggatgaactttatagatatataggacaagacaaaaaaattacaatacaagaaaaattttatctctttcttccatattccctttttatagaagaaaaagatattgagattcattccacttttacccccgaactatttaattggaatgtttaaccctctaaactatttttttctcattttatatcccaaactattaaaaacggttcacttcacttccctaacgctactatttttttctctatataagccgtattttgcactttggcaaaataagatatgttcacaacaaacaaaaaattaagtctgatttaaacataaaatttcaaacaaacaaccatgaaaatatttttaaaaataaaactttgataatatagccatatatggctctaacaaatttcatataaaaaacaactttaataaagagcaattaaaaaagagaaatgttcttatgaagtaaaatgaaccactttcaatagtttataggtaaaatgagaaaaaaaatactagtctgtccaaaaaaagctaaactctggcttgtgtccaggttcatagctaggattagacttttttttgggacggaggggatagttaggaagttgagtgattctttgaattagttcagagaagtaaaatggactttttttttctcaaattttctaatatcacactaactacatgcggggtggggttcttttatattttttgaggaacttttttgtaatgtgttttttttatcgtttccatggtatattttacccagtaatagcaaatgatttttaccgtttccatggtatatttacctagtagtagcaaacaagcctgccagatcttgcggccaggtaaatagtattaaaagtatattgaatcctaaacataggcataaaacttttgtccatcgcagtctaaccatttaagaaaatttgaacagccataataatcaaccggaatagctactgagtaattctccttgtgttcgctcacataggatatcagagcatcactcatatttttttgaactcttaggtctcctttggaatgtatgattgtgaaaatataggaacaggaaaaatattgataagagtgtcatacctattgaattcctatagcaaattaaaacaaagagaaaaacatgaggacaaacgcaaacatgaagaaagttctgaaactatcgtttggatgatatataggaaaaacgctggaactttgtgtcattgggagagaaaaacatgaagaacctcatgctagactcctccaaaattcatagttcaaatccataagaattttgaaggaatttgagagagcttttactttgttccaaaggaccatatatgattttttttctcaggaaccaaatcctccaaaattccttgttttcccttcattccaaaggagcccttaataatgaattcatacgattgtgtgatccgccaatttgtactccctccatttcacattatatgaagatttggtattttcatccctcgtctagattcactaatattcacataaatttgaactgaaacacatacatggatctatgtatgaatctattcaaaacccaaaatgacttataatgcaaaataagtagcagtttgttctattatggcatcgggtatgatgatgaatattagatgtggaatttcaaacccattctcaagcaatggcgatcaataggaggaattccttacctattctgaccatctttttcagatggattctaaccctcttcattgcacaaaagttagccttccatctggccaaaagaaatagagaagtttgcttgtcatataataaacagtggggaaattaaatcaccaaaccagcattctgcttgaagcggggtcatcattattccctatttcacagcatacgggataacatcacattgccttgggaaaatacctcatatactgatcatgttctcatagaacaagtctaacaactgaatcaacatctttctctctctaaaaaatcaacatcatatcaaacagagaatgtgcaagagaactctacaagactgcaagggacacatcgaacatggtaacaagatcgtggtaacaaaatgaactaatcggtataaccggtaaatacattatgatagttctgtccaactgctatccatgggaaaaaaatgtatggcacaatttacatcttagtcccgtaaaaatatgtttggtgttagactgaattaattagccttgtcatgaataaggagcatcagaattcagaagagtcttgtaaatgcacaacaatctgcatcaatattttatcatgttccctggtttatcttttgaacagaagatggggaacattgtcacaaagtgctcaggaaataacctgcataacagaaaacggttaatcccataatattatactccctctatttctaaatatttgacaccgttgactttttagcacatgtttgaccgttcgtcttattcaaaaacttttgttaaatatgtaaaactatacttatacatataagtatatttaacaatgaatcaaataataggaaaataattaataattacttaaatttttttaataagatgaacggtcaaacatatttaaaaaagtcaacggtgtcaaatatttagaaacggagggagtattagtataggagaaaagccaaagaaataaggaatatataacttacaaaagttcattctgcaacttgatgcataaagcagggcatagcagtcctcaacatggataagggctttcatccaataaaaatagaaatgagactgcactgcatgatatgaaattggaactagcgcgccacagaggaaacccaagccctaactcccattctttctttctttctttttgaatcaactttccattctttggaggtttgcgcatcctaagttttgtcaagagtctttctattctatcaaaattacgaattttccactgaaaacactaccatgaaccataataaactcgtggctcataattatcatgatacaagtcgtccacataaaactccaccaaatatcaaagcgccaaaccacttattggacacaaatctgcagagtaccaacagagctaagtgagttaataatctcatagatatacaaaagaatgaacacatttcggttcaatgtaaaaacacatacttcctgttgcaatccaggcggtcagataaatcaacagttgaaatctgccatgctaactgcgcagatgcagcagctagaaaaggatagtaaggccatgctgtccaacatgagtaaagtttgcagtcaatatcatgtatgccaataaatatttgttaaacaaggcattatgataacattcaccaaccaaggtcagcactgtagccactgagtgctaagctgccaatgcatgcaacaccgaagccactaatccagtgttttgttaaatctccaaaccttaatgctgtggacttgacccctactttgaggtcatcttctttgtcctagcatatatttggataagaaattacgttatctactaagatgttatcactaaggtaaaacatcaaaaaaaaaaaccattagtacctgatgtgcatatatggtatcatatacgagtgtccagcatataccagcggtatacaatgggaggatgatggcaggatctaagctttctttaatggcagcccatcctaacaaagctccccaattaaaggtcaagccaagatacgcctgaggctgtaacaaatgcattaaaatgaacacaattgatcaccgttggtgaaataagttcacattattatgacttccatgtgctcagtgcatacccaaaatgtgaatctcttcatcaagggataagagaagaccaaaaaaagtgaagatgccccaagaatacggctgcacgaaaaatataacgcagtgatggaggtgaatattaatgtgctgacataagcaaaaaaagaaattgcagaaatataaaatgcaagcagcttgtattttgttaagtggataagaaactagacttaaaacatattcagtttttgcattccaaacttagaagataaactcgagtgttgcaccaaatatctccgtgctattttctgcacaaaaccttgaaaaacacctattgttatttagtcaaacaaggccaatgtacctatagttatttagttggagaagaatgcccaatcccagtaaaagctgcaatccaaggaagcccactccttgtgtaggggttagaatgcctgatgcaaaaggcctgcttttggtgcgctcaacctacaagaaaacaaatacttttctgtcaaagatcaagatgctgaaatcccatcagagagtaaactgctttatgttcctggttgaccattccactgaattgttcttggagcaactggtgatatggtgatgacatttaatatggttattggttttttaacttgaaaactgcaacagtctgaaaggcatttctcttaacaggagaaagtacaacgaaacggaaacgattaacacaaatcaccttgttatcaatgtctcgatcaagaagatcattgaccgtgcatccagcgcctctgaggaggacggctccacatccgaagagtgccagcattctcatgtcaggcagctcccccggcatcgccgccattgagattgacctacgaagaaagaaacaaacggttccagcctcatgtaggttgctgtggtggtggtgtactagtagcagcagtggtagattatagacagtatagtaccagaagcagggccacgcgaggagccaggtgccgatgggcttgtcgaggcgggcaagcatggcgtaggggcgcgccgcctgtgggagccacctgtcaacccacgaggacggaggcgccgccgcgggagacgggtgcggcggcgaggaatcctcatccggggagccgtcgggggaggcggaggaggaggtagagaggggagagtagatcgagaaggtcgcggggagcaggatccccctgccgacgtaggaggaagacgagacgcgcggaggcggaggcggaggcggccagcttcgacggcggcggcatagcggaggcggaggcggagcgaagtatggggcgacgggactggggccgtcggggcaggattccggggtggtcggtggaggcggcgagagagcggagagtaagagtgggagcggggcgcggcggtggcggcggaggaggtcggcggcggcggctgctcggagtagagccatgggcttgtttggaaaaggaaaaaaaaaaactagggaaaattttcggatctacaagggtttccccacttgccaagtgacaggagacagagagagagaaaagaactgaagaagaacaacaagctcaccagggagatctcaccggagtgggagatgaactagagtctagaggcggttgcggcatcgatggtgggcggctctgtggttgaggttttgatgggagatggccgtgccgtcgagggttggccaacgccgtcgcggcaccggcggagacagaggccaacgccggagacggaggcagtcgcagctataccgggccaaacgggcggcccggctcagcccggcccgttaggcacggcttctgtagcgggccggcacggacccatcaatggcccatggacctagtcagcccgttggcacggtcggcccgaagtgaggctgggctgctggggagcgcggcacaggcggaaaatggaggcgggagtggctcagcgcctcagcgggcgggcgcgcgggggaccgcgagacgcacggtctcatggaggacagcgattgcacaggatactacccccaccagggagtgtattgggcatgttcctagctcccaatatttaattttagtagcatttctatatgatcgctgctcgataattctttcgcatagactgaaggttgattcggaggataccgaagatacgggcaccgtcaacacatcccgtgctagttttgaaagcacaggatatgacatcttgtgatcgttccaccatcgagtagatgattcatggttgatagcgtcgctatccaaatagttggacaactcttcaacgggaccatgcgatctagcgtcaccacttgctgctgacgaactactacaccaccatggctagaagatgagccaccccaaattctgctccactgtaactttttcttacctgctgcaggggctggtgggggtctttgcaaatgaactccttgaaactttaattcatacttcccaaatacctcataaaattagttttaacatcagaataataggaataatcaatattaattatctccaataattgatagaatattgaggaatccccgtaattttcccctagaatcaagaataaatgcaaaagcgtaaaacatggggggatgtttttccaatatttaagatatttttgtttcatactagagactgcggacattaaaagttcaccattttcatactctttcaacagagtggcaatttcaagaatattatgcaaaattaaattagttgctggatgatatacttgagataaaagaagagtacagttatgaaatgtttcaagaaattgattgaacctttcaattcgacaatatgccaagtacggtcaattggtattgcctggctgtccctgtttgttggtctattacatgttgaagaaaaacagtaagtaattatcctttaacatataataagtggcattccgtcgatgttccgcatcggttataaacttacgtcggggcttattcgatgcacgacaatacctttttcgttgtgcaatccgtgggtttgaagcagttaaccacgtgattgcttgacgaacggtgtcgatgggtacattcactctcttaaaaccacatttaacaattagattaataatatggcatgcacaacgatgatgcagaagaaatgatttagcataaacacaaaataagggttgcagaatttgcatggccctagaagagatgcactattagttgttacagcaaagatgttatctacaaggctatactcattaataacctctcgaattctctctactatattttcatcagtatgtgcaacatcaattgaccttagcccaagaactattttttgcatttgtcagtcatcataaatgaaatgtacaactacactaaggtaatcctctttacccctactactccatatgtttgtggtgacattaacagaaaagttgcatgtactaaataattccttcagtgattcacaacctttgtcatagacattttttaaatcacgggttgtggtttgtctactaacagcttaaaacctaggattatgagaagttttgatgtaattttcaaatgcagcactctcaccaaagttcaaggataaatcgtgtctagcaattaaacggacaagagattctcgagctactataggatcgttctcccatgtacgtaaccgtaccatcaggatttagtagcagttgctgctgtcatagttggattcattgcttctttacacaagcctaagcatgttgcttcaagtgtattgttccaccaattgattttgcagatattttttgcatattctacatttcgcgaatgttacctgccttccaaacgccggaagttcttgatctctttgagctggtgttcgtcgatgcactcccgcgcatagtaccaaatccttctaaacccgccggtacctcctcggctcctccacagctggtggtgttggagccaacctggtcgcatcatactcaccaggtgggaatgatcccgacaagtaattagggtcgaaaaatcaccaaacgtgaacgacggaaggttcggatcgtccattctgaaatgttaaaacaacgtgaacaaattttcagaatatttattcacataaaataaataaagggttaattagatctataccactgtaactttgacgattttgaaatatgccattactattcatctatttgaaggcatgccattataattctatagttatttgaaatatgccactacttaccctttcaatgtattttcttaaacttttagactaaattacccttgtcttcttcctccatctcttcttctccaacatatgcatcccctttcttcacccagtgataccgacctgccggtgcactgatgcatgctctctgcgcgagccccttcctgcggggcgttttcacacgttgggccgttggcgtgtagggtgacagactagagctgaaaatggtaaaagttgcaatggcatggatctaattaaccctaaaataaaatacaaacaatacagaagtatgaatattatggtgtacttctttattaccagttaccaccttggctttacagctctggtgtgcactattttttatttctgacaaaaattttgactaaacaaaaagacgaactagcacacaaaagagcacaagaaagcataaattgagaggtttggatgatctagaatgctaaaaagaaatttcatatttttatttttttttcatgctgcaacggctactcctcaaatatagccgttggctagttggcctagccgttgcaaacactggacaggacacgtggcgccatagtattggctggcgagtggcgacgcactgagctgtacgcgcgggcgcggcgctgtacggcactcctcgcctccctgcccggccctgccctccaccgcttgacgatgccatgcggcacacgctctcgctcccgccgtcccgctcccacgtggccacgtcctgctcccgtgtggccacgttgcgcgtgctcgcgtcctcctgccccaccgctgactggctggctgaccgtgccgcccgtgtccatgggtggtgccgtgttggcccatgggctgaggcgctggcccagacacgggatgggagaatgggccgtgccggcatggcccacatgctacatgtattgctaggacggggcctacaatagtaatgtcgtgattgggtcagcccggcttggcacgacccatttggcaagttatagtcgtagcgaagagtgccatatgagccggctgacggcgcttcgtgctactgtctactcctcgagagaataaagtttgaaagagtaaatttcgtaaaaccatacatacttatgaggacatagctataggttttttaatctaaaagttacataaaatttcacatttattaaaatattgattaatttcagtatatgtagaacattttttttacaaaaatagtgaagagttaaactaaaaacttaataattgaaattttttatacactgtagattgaattttaagtaaatttcatgctcaaactcataagggtgggggtggggattttaacaactttacaatcatatacctaagcgtaatgcctcataagttatatctagaacattttttacaaaaatagtgaagagttaaactaaaaacttaataattgaaattttatatacactgtagattgaattttaggtaaatttcatgctcaaactcataagggtgggggtggggtttttaacaactttagaatcatatacctaagcgtaatgcgtcataagttatacactactacaaaaatcgtttttctgtacgaggggatcggtaagttccatgcgggccgcttgtggcggcgcctgcaaaaaccgcccccccggggcgggttgattagccgcat

SEQ ID NO: 5188 - DNA, 9472 bp, Oryza sativa
tcttcgcatgcggctggcttaagggaccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtatgtgttgtattttttttgggagacaaatgcatttaaacttttgtatgaaatacctgcggtctatttttttatctgtaacttttttgcctttatataattagatggatcggtcgtcatgaatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatgattgtcgatgtttccaccgatagtgatgatttcgatggtggttttgatttagaggatatgctacgccatgttgaaccagaggtgctagcgggcaggtcacgaggattggagaattggcaagcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaatgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcaatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaataggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgctattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacctcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaggtgttttatgtgaaggacccttcagatgaaagaaaatctattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagagaaaaaaaaatatgagtttttttggtaaaaagatctttctatgcggctggcttaacagcccgcatggaaagatctttttcgcatgcggccggcttaacagcccgcatggaaagatctttttcgcatgcggccggcgtaacagcccgcatggaaagatctttttcgcatgcggccggcttatgtcgaccgcatggaaagatatttttccatgcggtcccttaagccgcccgcatgcgatgatctgcgcctatatatagggagcgcggggagccaaaattttctaagtcccggctcccgcgaaaccctagccgccaggctgccaaaatttcccaagtcgccatcgccgtcgtccccgccaccgccggctcctccccaaagtcgccccgccccacgccgccgccgccgccgccgccaggacctctcccccctcgccgttgccgtcgctgccgccaggacctctcccccctcgccgtcgccgtcgccgccggcaggtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggacctctcccccctcgccgtcgccgtcgccgccgccaggtcgccgtcgccgccgcacggacctctcccccctcgccgttgccatcgccgccgccaggtcgtcgccgccgccaggtcgtctccgccgtcgctcggtaacatttacttttaaaaaaagaaatgtgaaatgtgcaattgtggattgtggattgtttaattgtgcatcgtggattgtgatatgtgcaattgtggattgtttaattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaattgggacctatgttaatttgagatttatgtataattgggacttatgttaaattgagatttatgtataattcggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcatccaggcgcttctagtgaagaaacgtggcgcacaccaagtgacccgtttccaatggaaataacacaagtcgccccccgcgatgatgatccggactacatacctatcgaacaggccgtaagtgatgaaaatcgttagccatgtattattccctaactatgatgtgacatgaacttaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcatcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactaggtttgggcgcgcagcacaggtcaagtctcggatgagggagacatactattcgagactccagacatagaagaagtgactactaatttgcagcagatagtcgagaaagaaagatcaggacagttcgttccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctaatagccagcaacccacacaatccgcacagcaaacaactaatgtacctagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatctgctctggtagaagaagtgcacataccagatggtactacatccgaaccaaagtctaatactttggaacctcgtcgtataattccaaagttgctatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattctagccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacgattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatgcggtctacttaagacgcccgcatgcgaaaatagatcttcgcatgcggtcttcttaggtcaaccgcatgggaaaatactatcttcgcatgcggcttcttatatggaccg

SEQ ID NO: 5189 - DNA, 30089 bp, Oryza sativa
  unsure (1)..(30089): unsure at all n locations
ataaacatcttagtctcagatggatggatgatataagcttgtaggtggggctttataaaacactttgccccaaaacttgagtttcatgaaacaaattgaaaacactgaggttttgagttatagatgcctaaaattctggattttatggaatttgctctttagaaaaccacacgtattatcactactacagaaagcgtttttgcatacgggcggaatcgatcttcacatgcggttggccggcccgcatgcgcgaaatggtctgcaaagatcaccatgtgcgcatgcgtccgtcgcggccgcatgcgaagatcaatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgataatacgtgtggttttctaaagagcaaattccataaaatccagaattttaggcatctataactcaaaacctcagtgttttcaatttgtttcatgaaactcaagttttggggcaaagtgttttataaagccccacctacaagcttatatcatccatccatctgagactaagatgtttatctataataattgtaaaagaatgaatgagatatttttttaagtacatattcacgttagcgggtttcaacaaccgttgatcatcgtggtgctatcatttatgtgtatatttaacaaattattatgtcattatcagttaggattatgttgagttttttcattgaaaaactgagaaaaaaaactagataagatgaatatgtactttgagtcaacgaatgtgaatttatgaaaaaaataatcatatataataatgaaatatgagtattttaaataaatatatgttttttaaacattttgcctcgaaatatgggttccttgaaacatatcacaataactagggtttaatgttatggatggcccaataccttggattttgtgaaatttattcttttttaaaattactcaatttaaagtgcattgttcagtggtttttattttgggaatatacgtgctgcaaaaatatttgcaactccatacgagtcgtccatgccgacacgtggggatgacgcggtgagagtgagaccttgcgaaccgggacgttgtgttgagccgttgagaccttgcaaaaatggacgagttcacatgccactcgcgcgaactcaccattggtggtaggacagagctgcaaccctggcgagttcgcgtctagggtcagcgaagtcgcatgcctagcgaattcatttccaagggacacgaaagtcgccagcatgcaaagacgagattgcttgcatgggcaacgaagtggccagcttgcttcgcatgcatgcatgagttaggctgtgatcggaactagaagaacttctagttcccaaccctccctctcgttttccgtacgcatacttttcaaactgctaaacggtacaaaagttgcttaaaaatcaaattaatctattttttaaaaaaattactaatacttaattaatcatgtgctaatggaccgctctgttttccgtgttgaggagatggatttccaaccgtgatgagcgaacacagcataaggctttagcttagctttagcttcctttgtttgtgagatactggagcagtggagatcaatggctgtgtttagttaccttcaaacttccgaaaatcccatcacatcaaatgtttggacatatacaaggagccttaaatgtggaaaaaaaaaccaattgcacagtttgcatgtaaattacgagacgaatcttttgagcctaattacgccatgatttgacaatgtggtgctacagtaaacattttctaatgacggattaatttggcttaataaattcatctcgcaatttataggcggaatctgtaatttattttgttactagtatacgtttaatatttcaaatgtgtgtctgtatagttcaaagaaattttgaaaaggaactaaacacggccaatgtaggtttttgtttgttcgtgatacattcatgcatacaaaactctcttcgcgctagggtcgtgaacttgtaattgccgccgcgcgccgctgccgatatagctgttcgaccaatgtcttcgtgtcactaaccacgattgtggctcactgccgcgttccctcgatgcgagaacgtgcatcatcattccatcacattcttatgccacgatgatagtatatctctgccaattcttttgaagtatgaatattcctgtgaaacccataaaaaaatataggagaccgctatataccatgggatcctgtctagacgggatgacatctacgatgtatcaagttctgatactggcatacttccggtatcatcagtaggaaagaaagccatagagatatgtgtgttgttgctcaagaggaggaagaaaaccaaagcttatatgcaccttgtcgctggcggcaaggacgaagagagagaaggggagagcaaaatatgtatctccgcccaagaggatgaccatcatatattggccatcttgaagaagcaatgtcaccaagcccagtggccttcgccttcttttcgttgtcatagtcgatgtgccaagtacatcgaccttcactatttgctcttgtcaccgtcggtggagcaccaagcccgttagcctccgccgcctccgccctcttgtcttctcatcggaatagaaggaagagaggagagagaatcccttctctgtgcataggagcctactgatgacgtctcctgaggaacctcagcagtgggggcaaagactcctctagactggccaagcggcggtagcacacacgcccccatccgtgcctctcttgtggatatgtgtgtgtgagagagagagagaggcgaatatataacgatcggtgatttggtattaccatggggcctgtaccctctatcacgcgtggaatgggatctcgtggcatcacttgatgctcatagatatcgagtttaatactacctagtagcacctcatactaataggtattaggtctggtactgtgcatgtatcatgtccaatgttctaaatctctggctatggctatagccggagtagccggagatagcggattgggaaggaaatagctaggataaaccaatttcgacgctatgatttatcggctgctaatagccggagatagccactaaaatagccaaatatagctgcacttagcgctggctaaacataagcaaaactgaaaatgggcttttatgtgcatggtccacaaaactcagcccaaaactaaccctaaatcccccactcgtgctctccacctctcccctccccaaattggcagcacaccgtgaccgggagcgatggggcgcttgtgaccggtgttgatattttgtatggtcacagataaaatccgtaagcgcatggaaataccgctgtaccactttacccaggagtattccaaggtatcgattttccattaggaacgtgtgtgttcaacttcttcaagttcatctaagggtgtaacgcgccgcttttcgtgagtcgttaaaaactaattcggcaaaatcctaattgcgaaaatttccgttctttgtgtgcgagtctaagttgttcccgtggatctcaattcaatcccgttgttccctctcatcgaaatcaaaatcctccacctcgaaaattcttcttccgattcaagtctccgaaatccaattccgtccttgaatcccttgccaatattcctctcggtttcgagaataccaaatccccattttgaatcccttcgtcgactcctccctctcatccgaagtccaagtcaaattccaaattcaaattccctccaattcaacttctctgtcaaagtccgttttgcctccctctatttttgtgggccgaattcctctccctcggcccaaccctcctctcagccgtgtccccctcctcttcgcacgtgcgttgcacgcgccccagccgagcagagagagagcggctctctctctctctctctcgctcgctcgctctctcctcttgctcgccctctctctctccgtttctctcccccgtcgaagctcccccaccggcgcagattctcgccgccgccttttcaaatttcgccgcgccctcgcgtcgcgcgcgcgctcgcccgcgcgtggctgaccgcctggtcgccgccgcatcagccctggccgcctgcaccgcgcagccgcccatgccgccctgccctgccactcgctccacctgtgcgcgcgtgcatccaagacgtggaggcagagcctcggctcccctctctcacgcgctctccctcctccctctgctcgtccaaatcggcaaggagctgagctcctttcccctcccctttttgctttttccctcttagcccggccgcccgtgaccacctcctaccgctccttgaccgcaagcgtcgcgccagccgagctcccttgaccacctaagtcggtttcctccccgaaaccgacttcccgtgcctataaaaccacagccgagcccctcctctcaacccctcccgctttactctccacgctgccgcgccattgtcgcccctgccctgcagtcgccctcgtcgtccatcgccaaagcaccagggagaccggtgcgtgcgaaggacgcgagaagaggactccgggcgccgtcatcttccccttccccggcccgaggccggagagctcgctcctgcgccgtcggccgctcgtcacagcgctcgtctcggctcggtagtgcctccctccgttctcccttcgcgcttccctttccctcctttagctcgctcggtagctcggtagccgtcccgaacgcgcgtagacgaagccccaagccccgccgccgcccggcatggcctcgctgccattgccgcccattccagggagccgccgctcgtcgccggcctccctcggggcccctccgtcccatccaaccctgggaacgagttccccgagtcctagagatgctctagctccgacgaatcgaaccctcgtcgtctcatcgtcgtttccccctttgctcgccgccggttgccgccgccgcgattcgccgtcgccggccaccctccggcgaatccgagccgttggctcactctctcttgtcttcctcgtcgttccggtgtgctccccgtcgcctctcgccgtcgcatggtgtcccggtgaaactgccgccgtccgccgtctattctcggccggcctcctccttcctcccgccggcccgcatggcagccatgaaggcgccacgtcggcgccagctcggctgcgaccgggtcaaaagactggtcggccgcctccctccgtcacatctttcatgcgcctggtccacggagagccctagcggctgcacgtgggcccgctgtctcttggtccacccagtgctcaagccgtgagccgcatccacctccctctcccccgcgccccccctcagttgggccgcctccccgtggccgcgccggcccaatggctcggccgagccgctaaaatcctttgggccgcgcccaagcgcctgagaaagtctgaaattcgcccctccttctttctttttcaaaaagggtttaattaaatccttttcctttgattagaaaatcctttcaaccttagaaaatccatatctcccgatccgtaattccgattgaccccattccacttccaataattctgtaaaattgagatctatctaatggcactattaatttgtctaaatagggtctttcttttggtccttgtttaggttttgattgtttgcgtatagttgcggttaccggattttcttcaatcgtggatttctcgaagattcgtgaagctccgtgaaaaccttgagcaaggcaagtcaccctttgaccaattgctcctataattggaaaatcattattattttgtttgcaacttgcattattagaaccactcacgtttaacttgcttggcctcggtttgcatgccaaaccgatggacctacctagtagtcgcactaattcctgtaggctgtactaccttgactccttgtcgctccacccttgtggtacttcggtatccgtgctctctgagcgcgtataccaaatatcccatatacaccgttgattgtcgaaaacttgggaaatgggtttgagaagccttgaaaacccgacacgtggtgtcggcgtgtttgaaaataaaatagtttgtgaaaactcgcgatgcgggtgccgtgcctacgtggcgttgtcccgtattcacatataaggaccgattcctgtgggaaactcatcgagcataatcaaagtgcaaccacaaggtggaatgggacaccctggctaagtaactagtcggttcagggaaacctcgcatgccaatagttgggaacgccggggcggggtcggttggagccaaaccggcttcctggtaagcaaggaagagaagcttgcagaattaccgatcgaggtggttggagtttgatttgtgaaaactaaaatggcctatatttatgtgaggatttgatccttctatgtggcatgaggtaaccctgggttggctaggaaaaggtcttgtcgcgaatctccctttttccgccgtgcgtcatgaacacgggttcggcaatgggagcaagttcgtgtcttgtgggtaaagtgtacccctctgcagaggttaactaactgttcgaacagccgtgcccacggtcatgggcggatgtgaggtggttcccgttgcgtagatttgattgcttgtgctttgtgaaaagttgttgtggtgtgggaatcgttaccagaatcagcctatgtggcagatagatgacctgagtggtcagaagcgaatctgtgtgattcgggatgtctacgggcatcatagactaggcttcccgagtggaagcagattgttgtgctgctgggcagcaggactctgggagtccgagaaaatgaaaaaagctctgggagccgattaatcaagtgaaatggctccgggagccgagaagtaatgatctgacccgggaggtcggtacattaccatttgagttgttgaaaagcatctcttaagtcggatcgagacgcaagtctccttttcgacccaaacttaaaaaagaaataaatcacttagtgatttcaaaatgatttcaaataaaggatttgcaaaacaaccttgcctctcttccaagcttgcattaaacacctaaattcccgtgacttgcggagtacgaaagtacttatccttgatctatataaatatatatagttcctccgccctgaagttgaagatgaagtaaagtgaagattagggtttcgtcctagttcccagccgtcgcctgtggtgttgggtgttagttcgttggttccgctgctgctgctgctggtgtttccttgtccgtgtcgtctgttgcatttttgggctcttctgagctgcaacctaagttaaggtaaataagtcctctatttattttaaggattgcaatgattcatatttgtcaccgtgggtaccagcactatgtcctgggactggtactgagatcgcggtttcgtaggaagcggttcatgccgtttctcctacgacacgctctagtcaggtgccgttgtacgacggtgccggattggggtgtgacagagggcacagcaaaaatgggcaaaggatagagaggatttcctagtgaaaaacagtgtctacagaaagcttatttaatcctatcgcaatacttcaggcactggctaacccactgcttctagatatcgctctactccgtacccagacagggaggacttcagtgcttctgagggctgtcaccacctctacacccacctcaaatctactgtgggatacgcagcaaataatggtactcaataatatagacaccaaatctacagtatttaatactactctaatgccgatcaaacatcaaagtaaacactatatctaatacacaatattctagtaagcttaatagaaactaactaagagataatcctcacaaagtaaatcttaattactcgataaagatattatcaatttaagcagagtaattgacaaggtacaaaagtaagagaagaattaccgacaacttcaaaattcctctgattcttctaccttaatttctccctattctaatgtccgtaaagaatacaatagagcctcttgtaattcagctcatgcttggtgtgtgttggaatgaagggaaatgagagggtatttataggtggaggtgccttgggagtgtggagatcttccatagcatccaaagagcatcttccttctcccttttgccatgtgaaccttctgatgacggttgagcgccgaaaacagtcacaaccatcattgaggttggtatctaccgaactcaacttgggcctgtgctagcggcctctgttagggttcggccgaactcagggttcgaccaaaccttggccggctccgttggccccgtttttctcctgtacaccgatattggggccctcattctattggtatggtggattgacccatttggaggtgtttaattagttttttggatccaaaactctataagtttggatatgagtttgattctcctcattcttcatgtatattttttctcaacttagatagtttgtcatctgcgtacaaatatacaccaacacttgtggacatttttacaagtataccctactgctatgttagatgttttatactttcagttttatgcaggtattaacggcataaatttgatacttaacagtcgtcatcaaccggaagcggcggcagctcctgccccctagcagcggcggtggctcctccccaagcagcgccagcgacggctcctccttccaagcagcggcggctgctccttagtgctttttccggcagtggatattgcttctctcggcacctggtggcggttgctgcttcttcccagcgacgaatggccactattcaaaaaatgcatgccaagtcaaaaaaatcgggactaaagatacatacctagttacggttgtgcaaccagggcgcacaatccgggactaaagatgcatacaagtaaaaaaaaaaagtgattgaaatcccggttgaaacaaccgggactaaaaatgcatacctagtcaaaaacaaatgtgtgggatatggattcgaaatcaagatctcccacctcagccatcacgcacgttaccatcccacctactacatacatctaacttggatagagatacttcctttttaaactaaccctagaggcatctttagtccgagttagtatcaccaaccggaactaaagatcaatttttagtccaggttggtgttaccaaccgaaactagagatcctccatctttagtcccgattggtatcatcaatcaggactaaaaaataatctttagtcccagttagtaagacaaacccggactaaaaatgcttccagggttcgaggccaacccctgtgaataaatttcaccgtgttaattcaccaatggtatatgtgatcaatttatttcctcatcaggttcaggcccagccaatggtatttgtgattagcttggttccccgtcaggttcagagtaaatttcatcattaattcaccgatggtacatgtgatatctgtgatcagcatagttccccatcacacgaccaaatcttgcgctaaaagtttattactcctatttatcaatcccctatcacacagtataagacatgacctaacttggcacgatattcaaaactaatatttaaattataatttcttatatacatataaggtttatagcaacaaaattataaacatatcaaagtaaattcaaatgtcaatccaataatattattttcagcaaataaaattcaatccatattatactggtcaaaatatactagaagttgaattttaaaaaacttgagctatgggatggatggagtactatatagagattgggcatttactggcttcctggcaactcggtcttgttgccgtcaaatctttttcaaggagaaatctatcatcccattaatctcgaccgggtcaaaaaaaatgcagcaaatgcaactatgcaaccgaagcacgttataggcttgacaatttaaatactgaactgcgatctaatcatctcttcatacagtatgtaaccgagttagtgtgacattcaaaactgatgtactttgaaaacgcaaatttttttgcctaacaaaaaaaaagtatgacattcttaaggggaaagggatgcccaacaaaaccattccaccaatcgagagtgccatgttccagttcatggcaaaagaaaagaccaattcaaaccaccaaactaatgtatcaaaatccaagaggaagataatcctgtcgaactacgccctcccttcttttcagccccagaatctgctgagaagacccttcttctccttcttcattctgttctcaatgtttgggaactcgatcgcattgtaggccatatcaagaacaataggattacacggaactgattggaatggaggtgggaatcgtgcaatgcgacatggtgttttggtatttgattcaccgagtgctgattcatagctttctagcatatcaagaaggaaagcctgctgcaaaataccagtatatcatcaaaatctgtttgaagatgttctataccagaactttctttcaattgcaatgatccatggggtaataaaatacacaacataaagtgctacaaaatattaacttaacttgcaaatctagcctacttaaacttaacgaacaataacatcctaagacattcttaacccttcacatgcatgcagaagacattcttattctaataattgtacagaacagcaccaacagaagcttgtcatgtcaagcatctaattgttagtccctcaatccacagatattgcttcagaacattagaaacttgaagtataaattattaattgtttttaaatatttaaattgatgcatgaaaaatatgtgtggattcttcttgacaagtataaattattaattgttttcttgtccatcaggattatgcataaattacaatggacacactggtttatgactttatgttgcattttatggatcatgtcggtgttcaaacatgtatttgtggctttagagagtaactgtcaagtacatctcatctttgcgatctagatatctgtttaaatatttaaattgatgcatgaaaaatatgtgtggattcttcttgacaagtatttgtccatcaggattatgcataaattacaatggacacactggtttatgactttatgttgcattttatggatcatgtcggtgttcaaacatgtatttgtggctttagagagtaactgtcaagtacatctcatctatgcattggactactcattgcgatctagatatctgttgttctaagtcttcaaacaaaccagcaaatgaatgaattctaatcccctcaagttcccctcctggtggacatgctgacatatgtgatgacttaaaccagtatgtggatccacatgccagcatcattgtttgtgttctaattttacctatgctaatgttaaagtagaaaagtagctatatttagggatggagggggtactattctaaaaaatgtttgtcaaatatgccatcgtcgcactattctgctgatcttagacatcaatggtaaatgacagggcatcccacaaatgatgcaaaccttagtaaatgtccacattgagtaagtcctagaaacatacctttcgttcaccaagtgacaatgttgagacacctttcgaaagtctttcaggaacattctcttcctccataatacctgtcgcatgttctatgaagctattggatctacagctgtcagaaagagccttaagatcttggactaaggcctgtaataattagcatttgagttaagattctgtgtacattttttaacacaaaaaacatgaacgacaagcatgctgagaaaaccataagtcattactttgaaaaattcattgaacagcccaaaaattatgttgatagaataactggtcaacttaatccctccattttttaatagatgacgccgttgactttcaaacacatgtcttattcaaaaagattacgcaaatgtataagatataagtcatgcttaaagtactttgaatgataaaacaactcacaacaaaacaaattataattacgtaaattttttgaataagacgaatggtcaaatgtgacaaaaagtcaacggcgtcatctattaaaaaactaagataatagatcatttatagttatatggtgtcatgaacatgcatgggtattgaacaggccaactgtgctagctgcttcaatccctgacgcggttcacaagtaatactccctccgtcccattttaagtgcagccatgattttccgtgcccaactttgatcgtctgtgttatttgaattttttttaaaaacaataaaaacataagtcacacataaagtactattcatgttttatcatctaataacaatagaaatactaatcataaaaaaatttcaaataagacgaacgataaagttgggcacggaaactcatggctgcacttaagatgggacggagggagtataagactatcactttctagatgagcattaacagcatgtgaccaagtatttgaccaggattgaagcttcgggtgtatttggtttgctaccatgccaaaatgttggtactaccaaaacctaggcaaattttggtagtgccaaaattttggtaacttttcatgtgttattggtatattttggaagcaaaccaaacactaacaaaatactgttcaaagtgccaaacaatttggtagggcacattttggcttcgaaccaaaatggccccttcatgcttggactagatcttacaactctagtcatgaactcacaattaaacagtgctcaagatccaaagcaaaaatgctacttcatccgtcccaatatgtaacaacctagaatgggtactacgaatctggacacaggctgtgtttagttccaaaataattcttcaaacttccaacttttccatcacatcaaaactttcctacacacaaacttccaacttttccgtcacatcgttctgatttcaaccaaacctccaattttggtgtgaactaaacacagccataggaaatgtccagattcgtaatcctaggatgggtctaatcccagacccatcctaggttgctacatattgggacggagggagtagcagatagtgggttggtaccagattggctctggtgtagtggcagatagcatgagctacggacactatattctcccatgttattgtacagaaaatttttaaatttgaattatctatgagcatatatacacactttcctttgccaatctaacataaacaatatgaattcatttatgacaaactaggcatatgcatatcttaaaaaggttgcaaacttgtgtatgcaacttacaaatagtgcccgctatcatggcagctacaaatgatattgacctattgtggccgttgccaccactattacgtccactattccatacccactgttttgaaatttgaattgctacgttgttacagtaacatcgagtcaccttagagcccactaccactacagcggccacaaagtggccactatcaccactatttagtaccatgctcattactaataatacaagcccaaaatggtattgatggtgacactcaaatcaacgataaaaatattaaccataatctaggagctactgaattcttattgatcataaaaaaaattgaaactgtggctaatacattaaataacatgacatgtaatcagcaagaagaatgttgggtttagcaaaaccttgtcaggactgttagtcagctgttgcagtgcagaatcagtgattgaacgggcatgacaaaacagcgcgtaagattcagcccttttaccggctgaactgtatgactttgccaaatagaaacatctgcacagtttatcaatttaacttgagattagacatcattagacgcacatttctataactcaaatgaaattctataaacctagcaagttttaaataaaagcagtaattttaaaatgtgaccacagaaaatgccttgtagcaatgttcatttcagggagttggaaacctttccctcccacacggaaaaagaggtagttcacacgcaaaagaacttgaaaaatggattaatatgatattttacagcaacttttcaatataatttttttttcaaaaacacaccgtttagcattttgggaaacgtgcgcgcagaaatgagagtagaagttgggaaactgtacaaaagaacacagctaaatcttgataactcattattgaggacatggtttagtagataggtaattggcgtagttgaaggttcttgtagcaagcaagacatttgccaatatcatgattaattgtgaggaggtttacagccaaagcagagaatgtgcatggaaagcaaaaggaaattcaagctcgatttgtaacagacctctcagctcggaaagccaaacttttcagctcatactcctgaataaaagtgttctcttccttgtttttatcccttcctgagctaattaaatcagtcagatctgttgtattctgcaaattaaagcagcttcacatcagcaaaagaacacaattctataaatgcctgatataaaagaaaccttacttgaataagcagatcatacaaccgaacaagttcttctggttttgtgattttctcattcttctcatcccggtgcttggtaaacttgcttttagcaatactaacgagtaattggtttcgctcaatggttctgaatcccaagacagcactaacagccttgtcaagaccattcaattcatctcttatattctcagcattgccagcagaagcctgcattcagaaaagaagaatgtgaattaatattatatgatgcatagaattcttctagaatataagctgctgcgcatgcgtgtgtttcataccaagtcattgcggatgcagctccgagcgtcatggtatgcagaaaatattttgtcaaaaatgccaagttttttgtccgctggaactgattctgtgtttgcaccattcaagtctttctccagctgttgagctgatcatataactagattaaagagaattcgacaagtaaaactaagcagacgtagcaatttgtttttttatcgaatacacaggagatctgcgtatattaagaagaaagagggggtagaaccctgagtacaaaaccaaacacgcacccactgagttgtaggaaccatgcgtatcgccaacctgaccacaaacacaaagaaagatgctgcatacctttcaaaatggagacacgggtctttgcattagtaattggaaatctgcgaccaagccagctaaactcggtcatggaagctgcctgctgcgatcttgtctcagataatacagcctgaaaatttccccaacataaacatattagaagatgaaaaaaaaagtttggctgactgagaatacatgaaattatcatttccaaacagttagaaatctaagcatggaattgatagcaaaaattgtgcgcagcctaacatcagctgtcaggaagagtgagattacctagcgtggcatttatactcctctttcaaatatgcaatcccaatggccaagaatatatacccaaactaatgtagcactatccggactaggataataattcctttctgacttcgttagaaaatgaattaggctgaattagcatgtccaaatttcaaagttgtccatacaaagagagtgggggtttcaaggaactacatgatttgttctatgacatatgaataaataatccaacaaaaataatcataccaaaattgttcataccagcaaaataataataatttgatcatgaaattttcacgttgacgaaagattgtccattatcgtagtaatttaaggatgcagaattaacaagcatcgtcctaactgcatttattttactgtattcccacaagtgcaaaagaaatgactaactacgttgtgcagatactacgccccgctttgtttgggcttctagccagcttctcaaccacaaaagcagaagacaaaataaacaagctgattctaaaccatgattttggaaaagtcaggcccatcaaatactgtacctacaacccactgggggcaattaaattacccacaatgccatcagataaaaaaggcacatttctctcctgcctattaccccttcctcccaatgaccccatgggacaaactgcacccataaggctagggggcaaagaggatgaagtctaggagcacaccacctctatacaccgtctcctgctgtcccattcaattcaccaccacctcactcctaggtcaagccacctcctctgctcactccttgcaggttggctctctccatctcctaactcctatgccagcgctgccccatgcaggcctctccagtaaaactcatcatgtcgttgacttctgatccagtcatcattaattcattactaatggtcgagatgatccggctgcaatgaagatgtcaactgatcatcatatcgagcggtggccttcgtagatgtaggttttatgtttctttccccttaatttgcatgacctttgagtagtaattcaaacattgtatgtctcaagaaagaatttcattgcctttgtatatccggaaattgagatgaacagagctagttgctcatcagcatttggacgatgcaattttctggtttggaaatgttcatctctatagtcaagatgtcaatttgtgtttgtggatttggctgcatcattcactggtatgcagatcctatatgttcgttgaatttttacacttagcacttcacagaaaaactgcagtacaaaacagtttcattgctttcaaggatctcacaagctctaactgcttctcatgcataagccagaaaagcatcttctgaagaatccactgaacagaacaggtggcctaacaacaacattacttcctagcaagaactaaacaagttgcaaatatcatattttaggttgagatcatatatagttaatatgtctatgaattgcaagaccgctaaaaccacaaaagttcaaacattcacgtttcatgtcataacaaatgtgttcagtaataaggtctacatgatttaaaaccctagtgcattgcaatcaacagtgtattttcaaaaggattctgacaaataaaaaatgagggaaccagtcatacccccatctgccccctcacctacaacagaaaactagtaaaaaagtatcatgtgcatgcaccaccgctctcccaccttacacacaataccacttaaaaagaacaaaaatccaattttaaacaaattctccaaggttaaaccatgcacttatctctacaccaaacatcccatgtcctctacataattcttgaacaacatcaaacatatattataacagtagtaagaaaacaaatatatatacctcaatcttagccttgaaaagatcataagcaggcccctccttttccagatctagtagttcatgtgcttgcaaagctgatccgcctagtttgcgagagcaaaatccaatcataggttccacttcctcaatgcgctgacggcataaaagttgattttctatactcccatatttcccaagctcctcatatacagccctgtgataaaacaatacatcactcagccatcaatgatctcccaacaattataatgcaaagaagatttagcagtggcgctgattatcaaatatgtacaaacaacaaggagaacaattatggaaaaatatatgcaagaaataatggccaaacttctagaacctaacctggtgttcttgaaatttgtcattgctgcctctatgttcttctcttgctcaaacagcaaggtacctttcatgtatgaagcatatgcctgcaaaacaattttatcaaagaaattatttaatgttagtattgtaagggttattttctcatatggcaatatcaccttaaaatttcttgatttgagttttctcaaaaaaaaaaaaaagggggtatgaaacacacctcagcttccaaagacgtcctggaatctccttttagagaacataaatgtgaaaaaagcgttgcccatttgacagcttttctaaatctacctaacatgtagatacgctgttgtgcatttggaccagcagttttcttttccatcgcatgactccatgctctctcagccatataaaatactatgtgtagaaacctgctctcatatgttgaaattacttcagaatgtaatgatgcaataaatgtctaaaaactacacaaattcaactgtaatgctcaatgccattgtacttcttgatgaagtcattaaaaaaaatgatgtgacatacatatatggcgataataataaatacttttgctgggtgatgggaatagcctgccaaggaacaatcagaggcatcatatgcaattaccaaacaaggagtgcaaacatttagcaaacaataactatgaagcaagattacactgagctcatcactatgcgtttatgacagggcaccaaacggttttaatcatcctcaataaccacccaatttcaccttcttttgtggtgctgccatggtggtggtgtctctatgcgtgtgctctggttttcactaaggaaaaatgatggatataggaacttaagactgtcataggactccaacccaattatcctagacacccaggaggttaacaacttctaccaccaggtcactggtctgtttccctactattgctcttagcagcttaagtaagatagcagtcccaaattggttcactaaatagtttaggtggagcaatatcctgagatctagatggcaagaaggcatcatgctatgaagtatgaaatggtaacttctttcaactttgaaaatgggaagacaacacccggatattgaagtatgaacagagacaccaagctatataacagattatcagcagaaagcatcacacctcacatctgtgactgttgactctgttatattcctcttggtatatttaccacggccatgcagaaacttgagagacttgtataaccttctgagacgtgcggtacagtatctcctgcaggtcatgaacatccttgagacaaagtgtaaccaataacatgaaacattaactaactaattacagaaaaatagtggcccatgcaagtgcaatgcatttcacaattgaggagttgtctgagggtgcagggggcagatgttggaggaatggcaagtaaaagaatatataggttgatttgattttgatttacttgggtctaattaattatgatcattgttaagaaatattaggggcatattagacttttcacatctcctgtatacatttgccctttagggctagatcaactgtactgtggaaaatccccaattcactgaaattgacatggtatcagagtctctcctcaatccctaactctagttcagctccctggcgagcagccaggggcccgcatcgtcggtcatcatcatcacctaagtacgtcatccgtcgcagtcaccacccattcgtcatggttgttgcgtgcctgccgccagtcgcggccgccacatgtgtgctgcctctcatcgtcgtcatctgctccaacccgtccacagcctgcagcagtagcaagttcctagccactgccgacctcgtcagacccgtcgttcccctctgcggttcctcgtcaatcacggggccatcctcactgtccacctcggatatgttgcattgccgtggctcgtcgtcgtcagcaagcccggccagtcaaagccaccgctgtcgcggcgcccgtctctgcttcgtccatctatcgcgccatcggctggtgccgcgtcatctgtcgtcattcgcagaaggcagccatcagtcgcccttgctctctgctgcagggagtggtcaagctcttcacccaggacctgctggcagctgcacgtcctcaagcagcagcagatctgtttgacctcgagtatcctcttcatcattctcaccagatcaggtgatattcatggggtttaggctcagatcgagtctattctactcattgtcctcaagctccttttgtcttctagcagtagcaacaacaggcttagcatcagcaagttccaatcctcttgctatcatcatctctactacctactatattattcatcttcatcagttgcttaatctcatctgctagtgcattcagttcatccaaagtaatatcatgtgactgctagttagtgtctttgctgctgttataggatattcctctccaaatgtcttttgctagtatcctaagtcatctgctagtttagattgagccaccactatgtcttttgctagcatatcaatattctctacaaatcgatttctttcctatctagtctatccactcagtccagccacatatcttctagtatcattgtgtcatttactagttcccatttactccatcaaagtcagtgcctatccttcaattcgttgaggtcatgccaatctatctccaacttgcccggcttcccgtcggagttggtctacgtcatcagttcaccagctccatgtcagagttggttatcatcacttcatcagctctatgtcaaagctgatcatcatcatcatctaatagtaaaggcccaagaacagtttgtgaagggcctctatcatcatcatcatcgaagtctccgaatcagtgaagggctgaagaatggttcgtaaaggctgtaaggaaccgagggtcaaagaacaatttctgaaggctccgaggtcacttcattgaggaggggacagatcttttcttcttcaatatccaagaattggcacactttgacgacatcatcaagactttggagatatgccaatatttactttgtcctagtttttagttttacctttcaaatgcaatgttactgcatcattgcatttgaatgggggtgttaagaatattatggacattttagacttttcacatctcctgtatacattgcacttgccctttagggctagatcaactgtactgtgaagaatccccaattcactgaaattgacattatcacagatggaataaaatagtggtaaattacatacactagtaagtggtgtcaatgccaagccatatcacatagacactactctagaaactaatttgtcaatgtattatttctagattagggattaacataaaatttcctccaatcctcctcctctccctgtttccccttgttaccttcttggtttacacgtagaactgattcttacatgagatcactctctcctcaataaatctattgctaactctatcaaaaatcccatctagcaccctattcaatactacaggaactatcctacatgaagcactgggactgctctgatcctttctgtaatagtataaatcctagatacagactaacttgtaaataacaatcaaaagcaagataattgggcaaaacaaaaaacatgccacgggattgtactaacatagaaacgaaaatcctttcaagcacctctgccaggaaaaagagcaggcattgcagagcaaatatacatttctcatcatttctcaaaatgaaattaaggagacggtttcaaaaaaaaaaattatagagattcagtatatatataccaaaaaaaaaaggtttgcatagaacagtttggatcgcaagtagctatacaattagatgagggcaatccatcacaagtccatcagagaccgcaggagataagatcgggagccttagacgattcgatctaacacgggggggcggaggggggaaatcgtagacagatctggtaggaagtccgggagcgcgcacctgtaccgcgtgtagtcgccgtggcggaggccgtgctgcatctgcgcctccctcatgagctccagcactgcgaggaggagaggagaaccggcggcgcccggatcagcaactagggatcggtcgtggaaccatcggggagtggggagaggggaggaagagaagcccaccgttgatggagaacctgacgagcggcttctcctcggccgcggcgtcgacctccatgtccgacggcgggggctggtccgcgggcttcgacatggctggcggccggcggggtgcgcctccggtgcagccgcggcgtagcgtagcgagggaggattgtgttgggttttgctgggttgggggccgggggtacttggatccgagtctccgagactgtttcacggggttataccgtctatctatcgtctttcgtgtgttagtactaccaagagagaagcgtagtgagaatattaatccaaacaataaaactaaaatgttagggaagtttttttttgtcaaaacaattgattgttatgattactaataaattataaatactccatccgttttatatcataattcgtttgattttttttcttagtcaaactttgttaatttgattaaatttaagtggtattctttttctcctgaaaatgaagataaagatgaagattaagttttttatgcaaaacgaggtggtattaacgtatgattgattgagttttaattattacaaacttgaaaaatagattaataagatattttagagcaacttttatatagaaagttttcgcatgaaacgcaccgtttagcgtttgaaaagcgtgccacgaaaatctaaatcttcatccaaactcttgtcggagaaaagaacgcgaccatatagaaaagtttagcaacatctaaatattaaattagtttcattaaatccaacttattagtcaacacagaggaaacttctcactctgtcccataaaacttcattcctagattccaaggtgcagttaagaagagagatgaaagatcaaaatgctcctggttaataatataagatgggtaagtagataaagggtattgaaaggattaaaaatagtatttatggatcgatgatagaaagaagataataattggtttattttgggataaaattaaaactctataagttgatttattttggaatggtgggaaaaactttcatacacgaaaaaaaagcacaaaactagtcggaaccaagataaatcgttcctatgtaaaactaacaagctctacagatataaccacattttattgacctatgctatgtcatctaggtctctgtacataaaaatagtcaagacccagatcttgttaaagtgtatcatcccgatctaaaattgtcatgttcctgttgtgttcttttgtggtaggttgggaggaaagatccattgttccccgcgcacatgcttcctgaacttctaaatggtatgttttttgcaaaaaaaaaatctataggaaagttgctataaaaatcatatttatatatctttcaaatttaaaatatttaatatttcattaattatggacaaatgactcacttcattttgcgtatcttctcaatcttctattttccatgtgttttgggataaggtgggaatgggatatgttcgacgtatccatgtgttttgagatggaaggttcctatatatacgtttagtacgaggggcgagagtataaatgaaccccttatttgtatcgggtgctaacccatctgtgatgaacaaaagtctcattaaggattagtgctcactaatgacaaaacctcatccatgacgggtggtaacataccacctatcacacatcacagttgactcatatgtgacgggttataattacgaaccatcatggattagaatttacattttttgaattttcaatgaaaaaccataaaataattttaaattttaaatgcaacggaaaaacccctaaaatattttaaatattactatatcattcctcacacatcactagccagaagtttatgattttaccacggccatgcagaaacttgagagacttgttatgtgtgaatcacaaataatgttattagtgatgggtggaagttaggactactcatctgttatgggccatctcattacacccatcacagatgacctttatctttcatggggcatgattgtgacccgttataggtcatatgtgacatgttacaactgtgacccgtcacaaatgaccttgtatctatggtgggttatccctataaccatacctaaaatgtgatacttttcgacctgttagagatgagtcatctccaacgagtagcattagcttgtcacggatgtctggatctatagttgtgtcgtggtactacttcttaagggatggcccacatgtcagctagtgagaaatgtgatttggattggttggtcagtttttaagagacaaggtcaatttggatctttgtgcaatcccatctacctccaaactaaatacctaaaaaatagaatcaacccaacccgacccatcctatcccttgaactaaacatacgcttaggatcatatgtggcgcaaacatggttgtcaccttccctcttctctctcatctctccttgtttctttcccatagtgggaccatacaaaaaaatttcttttatttcatagagaattccacaatgagccacttatttcacttaatttagactagataagtttgcaaaaaggatccattttataccacttacgtacatatcttcctctctttatctccagcatgtagccaaacttgctggtgagctcctgagaaggcaaaaatgtgcatgataagctcttagctgtgataccacttaatatgctcacatctctgattagtttgatcttttggtgagttgatgataactacaatttggaacaaacattgacaacccgactacaactgtacaagacataattgtgttgtgccattgttggtatttgttacgatcacaaataaatccgcaagcgcacagataccgttgtagcatttcattcgtgagtatttagggtatcgttatttgtttttccgcaggggaggcggcggtttaaagaatgggctaatatattcatgatcatagtatgattaataaaccacggtctaagcaggggtaaatgataatatagatgtagtgtgacatatagaagatcatctcgataaaagataaactagattgtggagaaggacaaaagagagctatggtttattatatacttctatatttacgatacatagttcacagacaaacatacgtatgcatatacatatacaagcttaggacttcgttctatgcatataggcactaccgagagaccgctccctactggtctgccagtgtggttatgacattttaccaattcttgcgtcgtacccgaacatggagtattacaaaggacggacatggttgtcaccatgtgctgcctaagctctataacccgtggggtatacccgcatccaacaacatttaatcaacccaagaaccatgtttgcgttgctaaataatgcatatagctcccccgaaaatcccaccctacagatggaaaagtaagaactagctcacccattaaaatcactaaaacgatgccatggcatagatcgactagcctaaacatatatagcatatgaaataagtataaaaacatcaaggaaacatataattgacaaagtagtatatgaaccacgaacaccgataaataaagaagtcttacaaagagaaaagagcactagagccatactcgaatctccaagaggactaggaaacaaaatagtaagctactcttagcctaaactctattaatctagagagtaatacaaatgagagagagattgcttcttgtgtgtattttgaaagggagagcttcttctccttttatagctgcccaatgatggttactaatgacagttatcacctacaactgccatagggaaccaatgaggggttgccatgtggaaggtggagatgagagggaccaagcctggttcggccgaaccagggtaacctctccaccgcctttctttgtgagcatgatgtctaggcccttgagttggtgcatggtggattagcctcaattatgttagttttgcttttgatttgtgggcccttaaatccttgtgcactctcctaattggtcggaactgtgtttcttcgcatgtcagctcattttcaccttcatttggttgataatccctgcattcacattattctccaatgacaagtggaactacattatttgaaatgaatatgcgtgtaagaaatatgagttctctttattttttttgagataattgacggtcgaatttggtacttaacaaccgtcaacagccatagcgattgttgacggtcgttatagaccagtttcgcccgtcaatattactaaaataaaggatgagagctccttaaatagcctcccaatgacggttaattgccaagtacaaggatgagagctccttgttctagaataaagaattgcacacactcaagaactagttatgcttgcagtgcacatttgttctagaataaactatttccacttgtacttggcaattaacctcttgcagagattacaacataaaatggaggagaatcaacagtaaaacaactaaagaaccaatcggaagctgtcgagaatcagacttatggatggatgggccgagaattcaaaattaacacgatccaataagcccaaaattcacaagtctgaaaagagaagaagaagaggccactagccaaaatgtgggctggttgggctggcccatggttcggccgaaccctccctccccccccagcgcccttcgatccagggctttggctggacggcgtggatcactccccaatgacggttggagggcatttctgaccatttcaaccaccacaaccgtcattgggaggctatttaaggagctctcatccttcactcttgcacacactcaagaagaagagctctctccctctctcaagtttagtagtatcctagtgttagtggagtaggaattagaatagtattcttagtcctcggatcttcaggagaattcaggtatggctctagtacctttcctctcttcttttgtaagactaattgaattaatagaatattcctctttatacatcttcggtattttattccatttatattatctgagtaccaacttcattttatacttgtatcaatatagttgtgtagctagcctaccagtgaggtgcaatggtgtgggtttagtgtctgattactcggtggctctatgtcatctcgggggatatagagtagtattcaataatgtagacctagtgtctagattaataagtatcactatctgggcatatatggtacaggtcagtcgaggtgggctgctgatggtgacagctcagtatgggtattcctccacgatagtatatattcctagacactttcctagggagggtactcctccatatttagccccggttggacggccatgataggttgtcgtaaggaactcggcaatccgaggtggtctctcaaaacaccaggagggcactgttagggggtattggttgcataattgtatactaacaagtgtaaactaaagatgtttgtatattagaagtataggaatgatttcttttcttattcttcctccacttagcatatattatatttttgtgagagtatcatatttctttcttctgtgttgcacataccctttgaattacttaacccctggatagaccttgatgtatataagtaatatataaactattagcatagtactcttttatcatatcttcccttgggattaaataaatacgatacattggaatactcccgggtgaaatgctataatggtatatccgtgcgcttgtggatcaaatctgtgaccataaatataccatgaatatttctacgtcattgctggaaaatatatttctagtaatatcgttaagaaatatcaacagcgatcgatacacctcttcgtgggttgttggtcttgtcaagaaagatcaaccatattcctgaaacaaatgtaaaaaactagtaagaacaagataaaagcaatgcaatattgcaaataggaattggaatgcatgagataagtttcggggttcagtaacgagaaaaacgtcatctaaccgatcacggctttacctagaaaagtaacaatggctttacctatgatgtgatgagaaattgttgtatccatcatagccattactctccgcttagtgtatgatcttgcccatagaagtgtacatatgaaaagaagcgcaacaaacttttatcatgtaatatcattagttctctagcaaatagaattaacctccaacgaaacgtatatacctggtaatgaggatgcacaacaaaatgatgtagatgctacattgaaatcattctcttgcatgccatctcactctagtcgctccgcttctttgcatgtcatcttgctctagtcgctctgcttctttaggaccaattgtttctttgaatcacaacaagacaaacttgagatagcataattagtcataataaacttcatgcgttaaatatactcctttatcattgtgggttccaaaaatatggaaactgtcgaagggttgtacccgacaacaatgtttgtagagcatgtggatcattggtactaggttgtacactagattgtactaaggagacgtgggacaaatatttttataaaagtttgagccccttgttacaaacggaactcgaatccaaccctgaaatgtttttttctaaagaattttgcacaatgactaggaaacaaaaaagatggactggtatggtggaaataacgattcggtctcaaagggagactgacgtgagaacatatgacagagtcctaaaaagaaaacatagtttgtctagtttagaccgaaatgtcacttcgagatatgattttcggtagaaaaagcgttgttgggtttgcagaacaggattctcttttattaggaaaatatcgcgacacacattccttgctctcaactcaagggaaattgaaaccatttttttaatattatgaattaaattaaacctttgcttctgtagaagctataaccacttattacaaagttcatggcttaaaactaagaataaaagtatataacaaagaataaattgatgacacattaaaaagccacctccaacatgagggagagatataatttattcaaatagcaattatattagtaaatttctatccaaaattgatgaaaatttgcatgatcgttgtctctaactaatagcatgcaacacaaaagaattccttatcctcttcacacttttgtagttggacccaaaaccgaaaccaatatgttagtttgaagactaactgcatataaaatttagatggagaattatcaaaaactacattatttctattaagtcataaaacccaacattaaatcagatgctcatatgttttctgttttttagtcaaaacacatggaccaactcataaattaaatatactagaaaaaaaatgcccgtgcgttgcaacagttgaaggctattttaatcttattactattgtacggtttagctaagatgaaattcactgtagaaattcatttggatatttttttttacaaaatcacgagatgcaattaggagtcctttctgtatttccaaaaatgaatgaatttaaaaaccgactcaaatacggatatgtatttctaaaggcaaacgaaattaaaaaccgactcatacacagatgacgtaccaaagtaagtacaggcaaaaacatcttcaatttttataacagtagagatatgttacaaaataactgttggagagaaatatatgctggaagcctaattgtaggcgaactaaaattgaaaagcaattatttggtaagattaggcaataagacgcggtatctaaggataaatattttttttataaataaacttaacaaataacttaaaacaaatggttaagtaatatagtagattttttttaacaaaatgtaatttgtgaagcatgtagtaagtaatttgtttcaataatccggtgaataatataaaaataattaataatccggtgaataataagaaaaaatgtcatatggaggaacgaagagagaggcacatgttgtagttaaacaatgcgtgtagcgtgctatagcacttctcatccctaattaccaactttgataactctgctctcgtagtctcgttgatgtatcccactagcaataggatagatttcacatgagcctactaccttaatttgaacatgaagttccggaaaagccaattgaacttgcatggtcggaatcgccctctcgcanagcgtgaaggagggtgatttcgacccgccatttgccgtacatgctanatgtaggggggtgaaaggcccgagtggacgcaagcgtagtcggtactcgcgttagtcaataaagggttatgatataaggcggtgttgacaggccttcaatccgatatgatgca

SEQ ID NO: 5190 - DNA, 1765 bp, Oryza sativa
  unsure (1)..(1765): unsure at all n locations
ctcgccttgcacgccgcattggacggccgccgacgcgccaccgcgccacctgtgtggggagttggatggtgcgatggcgcggcttccgcgcaacgaattggcagtggcattaccgcatctaactcgggtacataagaaacctctcaactattgtgcttggccttgttcttccataacttaaacttgcagaagctgggctgaggtgagcattttccattcttcaggttctctgctgtgcacagtttctcaccaaacaacatgcttatttaaatggacttgttacaccccaaaattccaccctgaactgaagcaaaagaggatgatgatctttccagcttttgtgttggtgagaaacataagttactccatgtgccattctgcatccatcagaaatgtcctttgtacatgttagctctaaattcatagcaagtgaagttgagttgttagttgttgctgtacatgactcacaatttttccccttttgctgataaatagttggggcctgtttggtacagctccaactcctatatataactccaggagttgagtctggagtggagttgtggagctgcttaaacccagctccacaactctagtacattttgtgagagagctccacccaactccactcccagttttggtggagctgaaactgtttggctgagctccagctccaggaggggtggagctggagctggagctgtgccaaacaggcccttggtttctcagtgtgagggcaaatagcaaatgtttgatctagagcttggatcgattccattattgaaaagaaacttgacagctaagcatatgcaattaagattttagcaggattgtcaaggaaactttattcttttttttcctttgttttgttaaattttgatgaaacaaaatgggttagagatacttggaatgcgaggctacaggaatttcggttcaaaagtcactggagttccacggagtgctagcacaaggtgccttcactgaaccacatggagcatgagcagagtagcatcagacatcagtggtcagagagtgctcggtacaacgttcatttgtctggtttggtaccaaccgattacacaaattctaattttatgctaggcttttgttgttttaatttgaaactacaacttaactagaaattgagctgagaatcttgtttcggtgtatttcaattatacattcctaatcaatggctctacaaaacctgaatggcaagatacaagtcaattatgtcccctccagaaaattcagggacttttgtttcatattagtttcaagttcttgataaaaacagaccgagagtaaactaaagcaaaaatgcaagcgataaataataatatccgcaatgtttttttaatatgcatgagtatgcatataatttcattaaaaaggtataaaaatggggaaaagactaaaacaccattctccccaaaaacacttaaaagacgctacttacaaaacaaaaaaggctcacacaacccaaaattacccaactgggataatcgaccttctaaggaactcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5191 - DNA, 675 bp, Oryza sativa
tttggccacctttccggccagagccaactcggcctgcggtttgttgccccagaggaggacaacagggagacgatcgtcgcgcaggatgcgcttgtaatcacgtggaactcgtcgccagacaccgcagatcttgcccgtggcattctgatagacactgagagtgcccgcaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacactagttctcttgttaattaaatgtaggagctggtgaatgggattacaatttcccgcaggatttggcggattctattgggatctgggtgggtgtcgggtacttttgtacttacgtttgatgttgcgctcttcctcttcattgggcacgggcacatctaaggttacatccgtatctgaaagatgtagggaatacacatagagtataagatgatgctggg

SEQ ID NO: 5192 - DNA, 743 bp, Oryza sativa
  unsure (1)..(743): unsure at all n locations
agataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttgcatgcagcgtgacacgcttgaccaaactgcaataaatgctgttaggtgagcacagctgtgctcacttatcccatatatgtggcgcagactcctttaaggggtcggggtgcttcggccctcggggtcgggnngcaaaagcaacccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacacaacttataatatgaaacggaggaagtagtagtcatttgttttttcaaaatgaatgcacaggcaaatatgaagtggaaacataactcgcaattttttttagatggtgcacaaatattatattaaactagatgggtactccacgcgttacagcaggggaaatgtgtgataatataggagatatgagttctctttcttacctactatacgatttttttcatggggttatatattttggaaccttataaatatcctaaagatataaatgggttgggtgatggggtgcctttggggggaag

SEQ ID NO: 5193 - DNA, 195 bp, Oryza sativa
agggcgcgtcctcgactggcctttccagaggcccgcttgccgaccggcgcgatccatgcgggagaccgagtcccaaagcatgtcgggccccatctcgcccgccaagcggagggcctcagcctccccgatggaagaatccagcgcgcgctgcatgtcagcgacggtgtgttcggcagccgcgaggcgagcggctaa

SEQ ID NO: 5194 - DNA, 609 bp, Oryza sativa
cattaatgctacttatctcacatgatgccttggatatggtgtataaactaagtctcatgcaagagatggttttcttctcttttctaatttattcacttgacacatcatttttttatcataggtgacagcttatttaatactatagagacatcatcctacttattgggttgagaatggcctaatgccggagtacgcacgcacgtgtttgtgcacagggttggtatcgagtcgatcggtctgaactcggaagtaaacgcacggatgctattctactgacgttcatcttttgacgacgcacttttgccttacaaatggagaccgataccccattgtgttgaccgttcacactatgtgtatatctaggagtagtttcttaagacaacgaattaacatttgattaataacgtccgccgctgccttcagactctgtctaaggagaactaactatacaaaaacgagatacatttgatgctttctaaaggagatcgagcactatagtagaaaagatcgattagataacactgtgatattcggaagtgtgttattttgatgcacttcctcaaagagtgtacatgaagtttgtaaaagcagaatgcaagtgttactgaa

SEQ ID NO: 5195 - DNA, 652 bp, Oryza sativa
tttttttaaaaaagcaccatttagaaacttggaaagcgtggagcgtacaaacaaaaatccaaaagatggaatcaggaataaaatagggcgttacactcccttataacactcttatcctataagagttctattgatattcattaatattgtgctcaaatttataacataatgatttctttcaactgtacgaacaaataatacaaagaccaaatacaacataacacaatacattataactattatgtactcaactttcggtttcagcttaaatagagctaagtgttggaaaaactcaacccacggggcttaattcttctctcgctgcatcacacctttaattttcatttcatgttattaacaaaattaattatctccatatatgaattgatatgtggcaaagcggtagcgttgtagcggttgtgatcaccttagatgccgctttgtcacatgtgcgaaaggcaaaggtgcaaacgtgcattgtgcagcaggccaaaaagggagaacttcggacacttatttattaacaatagatccgatgatttaaataataggttcaccggttctagtgtaaatgtaaattagttaatataaattttaaattgttaatttaatgggtacacaatataatggtgtagactttattttaaaacat

SEQ ID NO: 5196 - DNA, 1602 bp, Oryza sativa
atatatatatatatatatatacttaatatagattgtgtgatgtatatgtattttgtattatgagttttttggttagtgtggttttaggctaacgtaattgctttcaattccacagatgttttattttgtccaatatttggagttggtgagtttacttacttgacaggattaacttcacgtagtgcaaattaactaattttactttgaaaattgcagtgcacgctccaactagtttatgttgagcaataagctctagttagctcatcatcctgcctagtactatatagctcagtcttatcttgaatcctactgtactttatgtaaaataaatcggtgtgattattgtacttaattataacttgacacaagcatgactacagtttgagagtcatacatatattagtacctaatttctagaaagttataattgactagaatataatccaggacactagctaatgattgtgtacatgcatgtaatggcacatatgtacgtacgcgtaggttctattcatgtctgtgtttttgttcgtatatatttctacttgggcaaacatatatagttttgttcttatagttacataactccttgagcacttttgtaattaattcgtcagcaacaataccatagatcgagttcgtccacatattaaaatcttcacgggtttgaatgtgttcgtcctcgtacatgtgtgcacatccacacaagtgaaaaataaggtatcatccggagaggcagattctcgtcgtatcgggcctgttcactttgatgccattttcaatcttagcaaattttggtaaagttataaaaaagtggttatatttactttgctatcaaattttagtaactatataagaaatcctaccaaaattttggcaacttggtaaggttctttttttgcgttaaagtgaataggccctacgtaccaacaattatgctgtgtttagaggtggaggttagaaactatatctccccacacacaaaacataatgatccgttagcgcgtgtttatttaactattagctaaaataaacttaaaaatagattaatatgattttaaaacaatttatatatataacttttttctgataatacgtaccgtttagcagttgtaaaacatccgtgtggaaaatgagggagtaccagtcgggaagatgtgataaaaacacacccttaataatcacttaattagccggacagttttaattaattaagataatttgaattagttgtaagcataactggatggttaattgttgttaccgattttatttgtttttgtctgctcgcaagtatagcacgtacttacgtacgtagaaacgtacgtatacgggtagtattatacctgcatcatgagggggaggtcgagggggtggacaccgggggcggcgtcagggaggaggtcatcctcagagatcatgagcgggtggtcaaggccattcacatcatccaagctccaaccagcaacagcctccacaaaccaagcaccctcaccaatgcactccacacaaacactccccaacccaccaccaccatccacaaacctccccacaaactaatagtattccaccagcgccttccccagcacctccttaatcacc

SEQ ID NO: 5197 - DNA, 945 bp, Oryza sativa
atttataataatgaatatgtaatcatgtatttcttctattttaaaataaatgatactgttgatgtttcgtataaagattgattattggtattttttaaaaaaatatatattatttattttgtaatgagtttttttatcgtcaaataaaatataatgttaaattatatttttatatatttttactaaatttttaaataaaaaaattaaatattattgaaaaaatttaagggtgttacatattttaaaaagaaggtactagtactacctaatgatctacataaacaattaaccatctcagcttgtttggcacaatggaatctaaagagtattcgacgtggttttctctgcaataccgctggtacagtgcagtaacagacgtactatggacaagtcgtacaaatgatccacttccaagctgtattttgtaattggcgccgatcgatgctggcaggtagttggatccgttcaggcccaatcatcgagttagagagagattccgtatttgtccccgtgaggcacgcatgatagaataagcatcttgagtacatacttgtttaattacatagtatattcgatgataaattaatactacgactaattgtgcttgattgccagctgagtgtttagcactgcactggctcagctggtacatgagcacgacatcagtgcccgataactgttttataaatgttcgatacaacattctcaaataagacatgaaacatcactacgaaaaatgtataacatttgtgtagaagttgtggaatatgtacagagatccgtgcaagataattgatgcaacatccaaacaaagggggtgaaacacgcaacagcgaaacagtaaaatgcagcacgtacaacgaatcgtcgaaaagatatgtaacaagagactaccagtttaattagaatttattttcttagccttggatcataacttgtcaacat

SEQ ID NO: 5198 - DNA, 4586 bp, Oryza sativa
tatgtaaacatggaggaagttggaatgaatattaacatatatcccatacatatatattacatggttaatattctaatcacatgtggtaagtccattaaaattttttaaaatgcccccaagctaccatgtggtgttctagtaaattagaaaaaatattagaaattctaaaaaaacaaagtatctattacttgattttcgtttaaatcggtgggtccaatattataaaccattagattaaattgatcttagaacaaactaaatattacgaggtcccacctctccacctttggtaggcacctatgtacgtgggtacctacgcttcccctccccattttcatttttccctttcttcttttctccatgtatacgcttccctccctttcttattatatcatgcgccttcatgagacaatttaatcgcaagaattttgagtatcttgatctcgcatttttcatttgtagccatactacaagcaatagtttattatttactcgagaaaaaaacatgattcaaaagtcgtaaaagtcgtaagtacttaatccatctcctactcaaaagtttgtgaatagatttttaagatatcttaagaaaaatagaacccttaaattattataaaattaatacaaaataacagtatccgaactttagttttcccttaatctatcatacaaaatttttgaacaaagaaaacaaatcttacctttcaataatacaagtgcccgcgcatacgcgcgggtcaccttcctagttaataagttaaagacactatggagcccacatgtcaatgaagcatgtcttccttccctatcctctctctcctctctcctttctccggttctccccacaacgagtcaatggcggtagcggccaacgaggaaggaaagcagcgacagtagctaatcaaggagggagctgcaacaacggaggagaggacagagtcgaggaagctatagtgagctcgaggttgcgaatcccgtccgccataaggtgctggtgcggccggcgaggaatgcagcccactgatatacacgccccactaccgtccctcgcctcgtcgggatgctccacaacagaggtcgtcgtctccaactgcgtatcccctttccaccgacagactcactagctaccacgacatcgacaacgtacgggagtcatacgttgaagcggagtgcgccgaggtggtgccctcttcgctggacaatggccccactatctccaatcaaatcctcgtccgatgctccacgcaccatcatcgacgccccctcgggcgccgccgcttgccggcgcaaccaccttctacttttttcccaaagcctactagtcccgctctacaagcgcgcctgcaagaaacaccactacatgaaacgctgccaccaccagcgcccagctccgtccggctcgtcatcggtgatgcaggccccctagcccctccagtcgtccagcggctcttgtccccgctttgggagaccgtcacgaccgcaagaatcaagaaaaaggaaggccgattttttttaatctacccacatgcgacctcataattccaaatgtgagcatgtattgtcctgattcctgtttctaatcaaactagctggcaggcacaaagcaaatgatccattaacatgtttcgctagtattacaattaccctttgttaagcagcttctatgtaaacaaaatcaagttttattagcacacataatattatgattccgatgatccaagcagatggattatatttcaaccgaccgccacagttccaattttcaaaacgaaaacaccatccaagtcaaatatggattaagaaaaaaaaaaaagccgaagaaagctcgagactaacggcatgacggcacggtgccctatctcgtaatggttgatccacccaattgcaaatggtaataagattttcttttctgacgacaaacaatcaattagacctaaacaagtcgctacgagctagtgatttgtccaatgatcagcaaccattagtttgttatatttcgtttgacattaagtctgatggaaaaccactgcacacacacatgtgggcttcttgattaaaaatagaactccatccattacctactcatatttggaattagaaggttgcatgtgcttaaatgtgaaaatttcggaaaggaagtggaaaaaaaagtgtagaaagagaggtgaagagggaagagaggtttctcgctgaaatatacgaccatcacatttttatttatttattttaactgaaatgccacgtaggataaacgcaccattcaaatcgcttggggaagtaaattgaattggttttaatagtttgggtatcgtcttttttgggttcagggacgctaatcaaactggggctataattaggggatgaagagtgtgaacttaggtctgttttggattagtgccaaaaacgtgccctaccaatactttggtagtttgaacagtgtatctggtgattttggtttgaagccaaatcattggcattgccaatgcccaatttgatattttctatattctactcaatgcttggttctaaattggcctcaaaccaaatacaactctaccctaccaaaaaattggtagtaccaaaacttgcctaggttttggcactaccaacattttggtagggtattgaaccaaacaagcccttattccaccgtaatatactgagcttttcaagggcgctgatgggccaaagcctgataagagcccatttgttttcttttgtaaccagtccactccaagcccagaaagtaattagcctaggcctagttaaaatcggcaaatgagcgtgggcttttatccaggccacagccgccgttgagttgaataaattggaaaaggttcactttaggtacctcatatatatgtagacttccaatcacatcccttaaccgtaaaatcgagtatagatcgtctcccaacttctacaaccagtgtaaatcgagtctgtcagtggtttttatagcggttttgattgacgagatgctctatacacggttttgcagttgtgggatccgattgcaactcgacctatactttagggacctaacattaacttttccgaacagaatttgaaagagcatgcagttgagcatgaaaataagcaagtatttccccatgggctatcttaacctaaaaaatgggccttaagagaatgttcttaattttctgagacaatataatccatttttgccaccaaattaattatgcccagctcacggtggtagtcgtaaaagaaacttactatacgtgcgagactatttcttgcgtacagctacggcattctcatctacctattgtatacgtgtacacagaattgcttggtttgtgtatacaagtatccacacaattaataatgtttgcagccacatgcagcaacaacccaataaactaattaaagagtaacatgctctcaatatcctggccggataaacctatttcggctgcgacgacataaaactattcctcatcacagtagtactttgagattcctaacaaagcctgcccattatatatctccaagagatcatgcactaacctaaaaatatagaggatcatggcgtactaggtatatccattattagtttattatatcacacatcgcatattcataatttccaaccatgattaccaagataattaattaaagctacagacaaaaaattaaaaggacgtacctacctaccgtgatacattgatacagggatgcacgcaatggcacgatcgatcgatcgatcgtacgtacgtacccatatatcgggctatacggtgtgaacgtacgtactgaagaattgatcagttcttcgtttcgttcccttgcagcaaaagccacttgatagctagtagatagttcgtcagttagccgatcacgtgtgctagctagctgtcacgggagtttgtgaaaagaaaattttttggtgtcacatcgaacgtttaactggatatcgaaaggtgttttcaaacatgaatgaaaaaaataatttcataactcgcctggaaaccacgagacgaatttattaaacctaattaatatatcattaacacaaactggttactgtggcacttatgactaattatgaactaattagtctcaaaagattcgtctcgcgattcaatacaaactgtgcaattagttttttattttatctaaatttaatgctccatacatgtgtcaaagatttgatgtgaccttttttgaaaaaaaaaattgagaactaaacaatagcaaactaacttaccacgcacttacgcaaaccaacaattaaactctcttgggattgtagggctcgttgcagagatcaaaccggcaaatcggtcgtggaaagaaagcgaccgatgaatatatatatatgtgtgtgtgtagcaagtgtatatatatgtgcttatgcgtgtatgattattgcatgtatcgcgcgggagtatggactacggattcggatccggagttgcagacaaagataaacccataaacatatgcatggctcgcgatctgatcggggatggaataatgcacttgatatttttctccggtcgattaatttaattacttcctttctcttttagaatataagatattttggtttttgctaa

SEQ ID NO: 5199 - DNA, 7997 bp, Oryza sativa
caatatttgtctatatttatttagattggagatggtgaagatgatgttgagtctattgaattcccaaaatgcgtggtggcaagcaattagtgtctagtgggtatatgtgcttattgtcctttttttgttatttgttggcttgttgttgttgcttatcatcttgttaacacagtgctgtttgttgtactattattgaccctataggaaagggaggaggactgaaggagagacattttgccatggatgagaagtgttaactgaccatgccttttgtgtgtttgcatggaaatacagaatgatggaacttaaacaatgtatcattctgctatgttaacttatgtagttatatttatgcgcccttcctgtctagctgatgtagtcgtactttgcaatttgcatggatgatagttgatggatgaatatgtgatggagacatggacgatggacctaatttgtactctattgcgtgtatgcgcatgatgcttgctgctagcctgcatgatggataaatatgtgttatatgactcattgaaatgtatggtagtttacattttacatttttttgtccctggctcacgagccaaacgagctagctcgagctttttgccgagccgagccgagctagctttttagctcgttagggttaacgagccgagccgagccagctcgttatcttaccgagcctgaccgagccgagccgagccgagccgagccagctcgatatccagccctactcccaagcgatcaaagcccatcgtttccgccagccccagtcactgcccaggcgggcccacccccgtccacgtaagcagcagcgccggaaccacacgttaaaacaacaagcgcgcccgcgcgcggcggaggtgagagcgaccggcccgaccgagaccggtccggtcctcgcctcggccggcgcggttcgaactcgaactcgacacggctcgcgacgcgagaagcccccattcccaatccgcaaattcacttctctcctctccccaaatctccacctccaccacctctccaatccaatccaaccaaaccaaccaaccaaccctaacgcggcggcgcggcgagcgatggcgtcgatcccgccggatgacgacgcggcggcggcggcggcggcgggggcggccgagaacgggtacgggaacgggaaggggaacggcaacgggccggcgccgcgcccgccgtcggcgaagcggccgaggtcggtgatctcggcggcgcagatccgggcggagttcgagcaccacgaggccggggtggcgcgcgtcaacaacggcagcttcgggtgctgcccgtcctccctcctcgacgcgcaggcgcggtggcagcgcctcttcatcgcccagcccgacgacttctacttccacgccctccagccggggctccgccgctcgcgggctgtcgtcgcgggcctcgtcaacgccggggacgtcgccgaggtctccctcgtcgacaacgccaccaccgccgccgccatcgtgctgcagcacgccgcgtggagcttcgccgaggggaggttctcccgcggggacgccgtgctcatgctccactacgcgtacggcgccgtcaagaagtccatccacgcctacgtcgcccgcgccggggccaccgtcgtcgaggtgccgctcccgttccccgtcgcgtccgcggacgccatcatcgccgagttccgcgccgcgctcgatgtggccaaggccggggggcgcaaggtccgcctcgcggtcatcgaccacatcacctccatgcctagcgttgtcatcccggtgaaggagctcgttgccatctgccgagaagagggtgtcgataaggtgtttatagatgccgcgcactccattgggcaggtccctgttgatgtgcgcgatattggggccgatttttacaccagcaatctccacaagtggttcttctgcccgcctgccgtggctttcttgcacacccgaaaggatgatccgatagcctcccagctccaccatcctgtggtgtcgcacgagtacggcaatgggcttcccatggagagtggatggattgggacaagggattacagtgcacagcttgtagtgcctgaatctattgattttgttaaccgatttgaaggtggcatcgagggaataaggagccgtaaccatgaaaaagtgatcgagatgggtaagatgcttgctgaggcatgggggacttttcttggcacaccaccagagctgtgcggtagcatggttatggttggtcttcccggttgccttggtgttgaaagtgatgatgatgtgatgagaatgagaacaatgttgaggaaggattttatggtggaggtgccaatatactacaattcgagaagagtagaagctcaagaaatggcaaaggataagaatggtgatgcagtcacagggtatgttaggatctcacaccaagtttacaatgtaacggaggattatgagaagctgagggatgctgtcaataagcttgttgctgatggattcaccagcagcaagttgcggccttcgcagaaggtaccatctcgctaaagttgcattcgctttaattatttcgttttctttgtttgcttactctggttatccattgatggttgccctgactagtgtagaatttgatagatgccattacaactccatggttgttttatccactggtaatttggttactcgatatagttgcttttgagaagacatgtctttacaatccatttacattcttaggcattggttacttctgatgaacatcccaaataagcttcaggttctaaccatatatttctgaatagatttgggtttggtggtaaagagtcaagacaatctgttgcaagaaagtcactttctttttcgttcatccatgttttgtcaaatgcccacacataaagttttacggattgttccatagtcataataatttagaatttactaaggtttcattgacactaaacttcactagattttctcatcaataattgatcttatgcaagtatatggtgatctacagtagcatgggtttatctatgtatggattgtgaacattccgatggtatgcagtacgaatctttgctttatgtccatagaatgtggaaaagtttgtcaaaattgttctatgcatggttgaagccacatttttttaaaaaaataattatgtgttagcattctggtagatcaaaacaggcaaaagaggtgctgtagtactatgaagtgtcaagtaaaaatcattttaagccattttaaacatatttacttggaagtacatagtgcttactagatttctttgagcagcataactgcataagtatgtttttacctgttagtgtaatgtttgcagaatcaaaatgaactggacattttgactttttaagaggtgttgatgtaatcaagagaacaattgatattaactatcttatagaaaatacaactgatttaaaattctagaactgatcgtgtttagttgtactactccgaatgaatgattccatttctgcattagccttattatactcctgattgtatagaaacttagttctcatatggcatgaggtgtttacatcatcgaaataaaaaatttacgatgaatgctagtaatgcttactacattgggcatttatactgggactaaaatgttggtcatgatgtcataatatctttctgttttgaaattcaaaaacagctttttgtgaattattattgctggttcttgcttttgattagtgcacattgtacttaaggaggattatatttattcataaggaacagttattgtatttggatattgttctctgtgtgcataacctctgtttgtagtcttgttactggaaattagcgaaaaaagcattgtagcactccaaagcatatgcaatgattctgattcactgtttaagacctttgtgagaccctgtgttctactcaagttaggacagttgttcatttgctacaccggtaactttgctagtacctgtaagatagggagctgtgcctagaagcaaaattctgtgttattgtgcattttgtttgtggaaggttccctcactagaaaggtttaaagtattaagtttcacattcaaacctgaaaatcatctggtccttaacttatcacctgatttttgtttaagaaagtatgcaatcagcatttctaggttaatcgcctgaatatattggcttgcccaacaaactgtttattaattatgctaaattgttctagaggaaaccagagaagatgcattttctacttttattggctttatgtagtactagtaataagggatggaatttttcttttattttgtattgcacataattgaaagcagccaaactttggtgtagcttggtccagctagtcttttttcatgaatgaaatctgtattttgtcatcagggtgccaaatgttccttaattttgttggtaaacagtctatggattgtatgggttttcttcttcacatgttgtgtatctggggctactattctaatatttcattctgacataattttgaggcaaagctataatgcgatctaattttttatgttctatggttgcagcaggaaacgatggcctgatgaacattgcagccaaccagcactctgttggaagttatgttgtggccgactacttagatgtggatcgccgtgacagccagcgctgcggtgtgatctagatttagcccgccaatggcgttgccagttcatgtagtgtactttcagaaactgacagaagtgttgtatttgcaatccgtccgtcacaataatgcactggcatgtcttcccccttaccctcattttcaagctgtaatgtaagaacaacaataatctgaatccaaggagaattgccgccgctgtagattgaattgaatgctggctaccgatgatatcgtcaaatggcaatggaattgtggtgaatcatcttcagagagattaggagggcctggagctgtgaaacattttgaagcctggagcccctacctcatgtagagattagagctggggacaagggaattgatggcttctcttttgtggcatgtgtttcttggtgacggctttgttgctttctcgcagttagggtcagtcactatatattaactcgattcagataagtttgccgtgggctgatgaaaaaaattctgatgtgtatgaaattgcttttcatctgccggcgggtcgtcgccggctggagcagtctgctctccggcgagcaggcgaccaggcggcggaagagaaggacctgtccggtgggcgatggccgtctcgtgcttggcctttccacggttcgctcgcaccaaagtaagcaccctgtaaccctcaaggtccttaagaaaaaaaaaaccgctttaaattagattatccacaccattagatgaggtgaaagatttagtaaggacaatttaaataataatactaaaacatgtctcctggatttgctgtctttggagtttcccttcgcctgaattttgatgtcataaacaagaaaatattctgaaaacaacgggtggatatgatattcttccttggcttatccgttcagttgccagccactcaagttattgcaaaaaatataaaactccctctatctcattttaagtgtaaccatgatttttcgtacccaactttgatcgtccgttttatttgagaatttgttgaaaaaaaacataagtcacatataaagcgccgaatctaaaatcggacggaggtagtattgcctcgcctaagccatcaacaacgtacagtatgtatcaccaagtcagtgaacaccttacctgcagtgctgctttctcaaatcttgcgacaccctacttaaaaaaagttttccttggcatccttgtctaagcacgtctttttctgcctctaatctaaacaatcaacaatggccatttcttttaatcttctctgtacttgaaattcttgtcattgacatgtagggcagattgcatttgagcccacatgtcagtcgaactcgaagagtactagtagtagcaggtcggtgtgctcttaagtctaaacaaatatcttcgggtggtttcttctggactggacagagccatgcgaacaacgcttttatgaatcgtctcatcttcatgtcctattactcctaccactgagagagggccactctttcccctcgagttcttcaccggcttctttcccctcctctccggaccagggaagcagctaactgtctgcgcaagaaaggtatgagtccaggttcctcttagcttcttaaattacttgcaatcaactctgcagttaagttatttgggatcctatcactctgtggtgcataattatctctactgtgatgcctcagtatgagccttaaccttgacatattggtatatcagttctttgattctcactctctttgttcttgtgaactttggtgcctttcttgatatttgtccaaggatgatggaacttcaactccatggctccatttttacatgtcaattaaatatctatgtccaatttctgaatttcctgccataatagcatatattcgacactggaagtcaaacagctcaacgtgatgaacccttcttaatgataccggtttacaatttcaagatatccatgcgctcttccttttaatttgttgtctatattttccaaatgataacctatcataggataatttgttgtctattttcccgtattctgctgattaattagcttttataccttaggtggttcaagcacgatgggacggaaccatctttgcctggtcacttgcttgtggattctgtcatgcgcagttctgcttcatgcttctcctgatggattgctgagaattagcctgaataagaagagattggacaagaagaccttggacggtgcaaaattggcaagggaggaaagccatcgtctgagagccgacggtttaggtgatgacatagttcctttggacaactacctggacacgcagtactttggagagatcggcatcggcactccaccacagaacttcactgtgatattcgacactggaagctccaacttgtgggttccatcagtgaaatgttatttttcggtaggttcatcacctaacagacttatgaaactattgtgcacgtatacagtagaaaatgactgtatttttgtaaggaagaatgtttgatgttttgatgtctatgctttccagatagcatgctacttacaccacaggtacaagtcaaaagggtcgagcagttacaaaaagaatggtatgatagatccagtggcatctcaatattgtagatccttttggcaagtaaaaccaatgtctattaagacccttatactgttattgggatttttattttcaggagaatcttgcagcatttcctatgggtctggatcaattgctggtttcttcagtgaggatagcgtgctagttggggatcttgctgtgaaaaatcaggtgacttatcgcactattgtctcagtaaaacatttagatgcatcattgttgatgctgcaggtccatttttctttcagatgttcattgagacaaccagggaaccgagccttactttcatcatcgggaagtttgatggaattcttggacttggatttccggagatctctgtgggaggagcccctccaatttggtacctactcagaccattttataaattgtgattatgtcactacctaagtgatgattatgttttaacactgttctatgtgatatggggaaaaacaggcagggaatgaaagagcagcaactgatcgagaaggatgtattctccttctggctcaaccgcgatcctgatgcaccgacagggggtgagttaatctttggtggtgtagacccaaatcattacaaggggagccatacatatgttcctgttacccgcaaaggctactggcagtttgagatgggggatcttcttattgatgactactcaactgggttctgttctggtggttgcgccgctattgcggattcagggacttcattgctcggtggcccaacagtatgtaaccttcaatctctaactaatgttatgggcctttagtgtggtcctagaagtta

SEQ ID NO: 5200 - DNA, 1572 bp, Oryza sativa
ttttttactgctgtcagaatattgttgctcaaattaatcaagcaattgaagctgaggaaattgttagtatggaatgcaaacaagttgtgggggactacggggacatgatcctcgagatgctcatagcacaggtttgccacttgtctgaacattggattgaatttttcttgtgatgcttcatttttttcattgatcttggattctctgaccaaatataaaataattttgtgactgagcaggcaagccccatgaaactgtgctctcagattggtctctgtgcatttgatggtactcgttctgtcaggtcagcacaacacatacatgacattttaattgccatcttaatatatctatgttcctcctttttgttccctttccatgacagacttgtttcacgaatgaatatgtagaaacaatatagagtctgttgttgataaaaaaaaggtgggctcagatctttcctgcactgcttgcgagatggctgttgtctggatacagaatcagctccgacataaccaacaagggagctcattttgcaatatgctgaccaggtaagtagtgatcattacgtcctttgctatgtcgcaccagcctttcctgattgcaaagcataacattccaatcccaatttaccgaagctctgcgagcgtctcccaagccccaatggcgaatcggcagtcgactgcgatgagatctcaaacatgccgaacctttcattcaccatagcaaacaagaccttcaccttgacaccagagcaggtggctccctcagtgacacacttggcccatcctcttaagctatactcatgcttttctaaatctcaccgtcgtcttcttcaactatgcagtacgtagtgaagctggagcagcaaggtcaaactgtttgcatcagcgggttcatggcgttcgacgtgccacctccacgcggcccactctggtacacaaattacactgtcatcaagaagcgggagctccatgttgttaggttctttgaccgtttgacgtttagcttctcgttatctgacccatcttgttgcattgcgtttttgcaggattcttggagacgtgttcatggctgcataccacactgtcttcgactttggcaaaaacaggattgggttcgccgagtctgcttgaattgcttggctagggccttcaggatcatacaacatatcaagtattgtaatgtttgttaggcagcttgtttactcggtattgtaacctgggaatgtctaaaggtatagtgcattagtagtagcatgcaaaaccttgtagaggaataaacgttttcacgatggagctgtatcagctatggatatgcagatatggatcttggatggtgcaatgcagatgtaatgagcaaatgagcacgatgagaattagggctttttaatctgatctcatcatataggtaatggtttgtctggcatataatgatgggcctaaaacttctggcgaggttaataatggctgtactgactgtttatgcaccttaacattcagagttcaaaatctctcattaaccaatttgtgatggatgcagctatggtgatctttttttttgtttgatgat

SEQ ID NO: 5201 - DNA, 24737 bp, Oryza sativa
  unsure (1)..(24737): unsure at all n locations
gtgcaaaaatcgggtttccgccttccgtaaaaaaggaaaaaaatagtgcgaacaaaatattttgtccgattcttaaaaaaaatcccgtcctccgtgccaaaaaaaaaacaagcgcgaaattttttttctatccgattaaaaaaaagtgtgttcctgttttccttaaaaaggaaaaaaagtagtgagaaaaaaagatttttgtcctatccttaaaaaaaatagtacgtataaaccggtcctcccgaaaaacctccgtgcccgaaaaaaaaacaagcgcgaacaaaggttcccgttttccttaaaaaaagaaaaaaatagagagaaaaaaggttaatggaagaaaaagtttttgtgaaaagttaaaaaaaaatctgattccataaaaaccgatgcttttccaaaaattcctccaaaaaaaagaggttgatgggaaaaaaactaagagtccataaaaaaaatccaatacgagattagtaaaatttaggaacaaaaaagttaaaaaaatcaaaattagaaaaaaagaaaagaaaacaagagttaagtagaatacaatttaaaattaaatataatcagtatagaaataagagtacatatcagaacccaatagtagatgaattaaaataaaaaaataaagtagatgaattaaattcggaataaaaataaaataaaatctaaaattaggcaaatgaaaaagatagttaaagtaggaatacaattttgaaacggctgatgaaaataaaaaataaaaagaacaaaagaacacaataagaaaaataaaataaattctaaaattggtgataaaaagtaaagactattgaaagaaaagaccatctaaaacacatgacgagattaattaagtaacaggcttacagtggagcagagtggtggctgttgatgtgacatctaaaaactattaataaatcaccagataaaatcctaatgacgattaaaaggaaggacgacgggcatgtcgtgaagtaatcggtcaaggcggttggcgggacttctagaaagtaaaaaaataaaccccaatgaaaatcatatttgatttttaaaatctcaattaaaaaaaagagaggcagcgggtgggtcgtataggagtacaatggcagagccgctgatggttggtgggtcttctagaaagtaaaaaaatgaattccacgatagttatgttcgattttacaatcccaatgagaataaagagtatgcggcggacgggtcgtagaggagtatagtggcaccgtttgacaggatttctataaattataagaaaaaataaaacccaacgagacaataaactctaaaaaatataaggtctaatttttaaaggtttgggcttctaaaaagtaagaaaaataaaccccaatgataatcatgtttgattttaaaatctcaatgacaataaagaagggcggcagcggacaagccgcagaggagtacagtgacaaagttgctgacgttttggcggaattctagaatgtaaaaaaataaacctaaacaataattatgtttgatttttaaaataatactccctctatcccattttaaatgcagccatagttttccgcacgtaattttgactgtctatcttatttgacatttttctaaaaaaaaattaaaaacattagtcacgagtaaagtactattcatgttttatcatcttataacaacaaaaatactaattataaaaaattcaaataagacggacgatcaaaattgggcgcgaaaacttatggttgtaattaaaatgggacggagggagtaatgacaataaagagaacatgcagtggacggtcatagaggaatataattgaagcgtttgacaggacttctaaaaattacaaaaaagaaacctaactggaaaataaactctaaaaactataattttttaatccaatttttaaaggtttgaaggagaatgaatagaaacaatggtggatcgagcaaacaaataaagaataatatgatagaagtaaacggtagcaactggtgtgacttttaaaagttataaaattataaacacgaggacgataagatttggtctttcaaaatcttaagacaacgaggtaactatttaagaaattttaagtaaaatcatgttaaaaaatataattttatatgggtgctagccgcgcaattgcgtgggccacccgctagtttgtataataataaggttaatggtagaagagatgaagtagtactaattaagctgactgaaattaaacgctgcatgcggcaaatcctcccgattaataaaaacaactcgtgatcagccaatgtgaaggctgagaaaatcattatacgacatcatcagaggccactacgtaccgtaccctacccgcgaaatgacaggttcgtgctcgtgcaggtagtaataataatctaaccaaattaaagagataaaaccaaacaaaaatatctcgaccgatcgccgccaccactactacgactacctccttcccagtggatgcgcagatcgatccaatggctgactacctgggtgcgcaacgatcgaattacgcgaaaacgacgacgaaatcgtcgtgaaatctcacgtttccggcgcatgcatccatgttctgcccttgccctggccgccgccgggcgggcggctaacctcacctcgcgtcgcaagacgcgagtggctccactcacccacccacaccgccacacgcacgcgcctttcctttcgcgtgaaaaggtagcagcagcaagccactcaccttgtcacgtgatcccgtcgtccgtcccggtcacctcgcgacgcgatgccatgcgggtccacctgtcagcgacggacgaaaaggcctacggctgtgtatgatttatctactactattagctagaatatttttaaaatagattaatatgattttttaaatatttttttatagattttttttaaaaaaacacagtgtttaaccgtttaaaaaacacaggagatgtgaagtcggaaaactaagcttaagaccagataagtggggcgggcacggatcgatggagaaagtgcatcggatggtgtttgtatgcatgggaccatttctggtacgcatccaccgtaacaaactagcaacacacttatatatattaataaacttgcacagatgtaaactgaaaaatcgttgaaaatgttttgcatctgctgcctttttttttatctccagcccaaatttgaaaatctgaaaagtagcgcactcacacacacacacacacgatgtttcgtctggacgcagtggagacagattgttagttatcgtcttcatcaacgtgacaacatcgatcgatcgtccacatggttgttttctgctcgatgacacattggccacgttacgtgcgtacctaactacggccacacaatactgcatctggaccgtgcatattatacacttcttttttttttccttgtagaggaagatgtgaactggaactctttttttttaggggaagaaattaaaatcttagatgttgaatttgctgatgcaagcgtctcaatgagtgagacttgactgtggggtgagtaggaagcagttgaatctcgtggtcgatcgatcgtgtcgctacagcaagcagctgtgcatatgactatctccaatttttttttaaagtagataaatattaataagtatagtttttttttatatgaaaggctagctcgatccaggatttggtgacatggactcggataacgggataagataaggtcgccgccgagtatctccatcgatcgactgtcatcagtcagaagaccgaaataaattttggttttgacaaattttcgttgctcaatttcgaatatactactacttgtagtgaacagcgatgcacctaatggacttttcctcgcatgcaacgactttgaatgaaggtctgaaggacagagagatatatgatcgattgatcatttgatcattgagttagctaatccatcactgtttgttacaaaaatgcatggcttttagttcatgctcgcccttgataactcaaaagagacggagaattaaggaaaggtccatcatatcaaacccccaattcgatcttgatcatggatacggggtatattatatatacaggtgtaaaatgaaaaggagctatactaaccaagcctctctgtgcaatttcgagctgtccctaataattgcgagacagaggattatttgcctaacgatggatcgatatgatcgaaccactcaatattgtttcccggacacaccttttggcgagacgcatcatcatcatggagtccaggaaaccaaatcaaccgtaaacaaaaaacaaggcgtgcataattaattagtcactagtaaattaattagattgaaacaagctagcagatgcgtacctcgccaattaagaatcccagcaagtggaataataagcatttatcatatggtataatggtaatgtgacccttatcatcataattctaagtagtagtagtagtacttctcctgttgaccaacaactctactgatggagtgatgtggagttgctgtgttttgtcctttggtggctggattttgaggccaagaaaatgcagatggatggatacatggtaacaccagggataatagtacagttcaggtatagtgactacggtcataacctaacataacaatgatggtcactcaggtgttaaattgggagaggacgattgcatttgtacctgaagctgaaaggaaggcttttggagtggtacacgtaacacgtactcgcggtggttcagagatgttgttgcaaaataagggaagagagatacatgggagatgatgatcgattggggaacaaaagttggtggctttttctcggggtgttagttaccaagttagttgctcgtgtgggtctcatggacgatctctcgatctccttggaggtttcctcctgctggtaaatcccctcgtcgattcggacagaacggtttgattattttactgtgttttcggtaggagtagaagagctcgctcgtgacgcatggttgaccgatagctccgtctggtactgcgtcgcatctatacaaaatacggtacactcattggttggtacttatggtttttggagagaattttgttgtatgtgacaaacagagacatgtctgttttcgttgatctgggttgggaatccatctcttacgcccagaaaacggaacgtcccgttaacacgtgattaattaagtattaactatttttttaaaaaaggatcaatatgattttttttaaagcaacttccgtgtagaaacttttttaaaaatacaccgtttaatcatttgaaaagcatgcgcgtgaaaaacgaatgaggtgagctcggaaaactagcaaagaactcatgccgcggcgtgacagaggcaagcgaagatttcagttggactaagagcaagtttaatagtatagccaattgttggctccaaaccatttataggctgtgtttggatgcctccctttcccaacccctccccatcgttttccgcgcgcatgtttttgaaactgtcaaacggtgtgttttttacaaaaagtttctatacgaaagttgcttaaaaaatcaaattaatccatttttttaaaaaaaattagcaaatccttaattaatcacatactaatgggtcgctccgttttctgtgcgcggtgtttgggttgggatctgcctccggcgaacacagccatagtcaacttaatagctaattcgtacaatagttacctataaatatatactacacaattaatatctggtcccgcctattatacaggcgtgcatcttggagtccgtgttgtagcagggtataaatctgtagccgctgcttttccctctcttcttttatctcttagaattgtgtttatagctggtttatagtttgctattgtacctactctaatcatggttgaagtgaaaacacggcgtataacattaacaaatacatggaggcatggagtgagcgtcgttattagagccgtggttgcgacgcaaaagtgcaaaaaaaaaaaaaaggaaggagggaggcgtcgtggtcggggtggttaggttagcggcctcgtccgatccggacgacgatccaatcgtccttttgctctctcctcctgcctgcgcgcctttgactcccgtggaaaacaaacgccacgacgagagagaaaaggcaggtggtggtgggggctatccacggccgcgcgctcgcgcgcgtgcgtgaccccgaagcaaaaaccaaccaaccaaccaagccaagcccgccaagcgcaagcgcggagccccgcgcgtcgtcccaccaccaccgcgcggctgcattcgacgcgattcacgcgatgcggccctcctcctcaccgcgcggcgccgctgtcgcgctgcgccgacacacgcccccgcgcgctcacccgcacgcacgcaccaacgcgatgcgtgtgcgccatgtcgctcacgcgcaacagcggctggctcgcgcgtcgcggcggaggttgtgtttttcttttctttttgggctaaggtgatcgatgccgatggggtggatttggatgggctccatgtggtggtggggggagatcaggagatgagatgctgcctcggccacgtgagttaacgagggtgtgcactgcacggacaggacacgacacgaccatgcgtttgtcaatgatcgcatttgcccggagctaggggctcacgcgcgcgcccggattgcctaacaaaaatacgtgtatttgtatatcgtcgtcgtcggtgtagatgtaaacgaaggaccgtgccacggaccgtagcataactagcacagctaggagaagattagctcacgtatatccatacacataataatgctagttgatactgctgctgctgctactaaatgcaagctcccagggtccccaactagcaaccaccactggtacgagtacgtctttcggaccgacacacgcgctgctcatgacaaaatcactgcatgcgagcgttctgttgatcaaatactgtcatggcatcatatgtttggacatgaacaacttccggtagctatagtttctctcagtaatttaaaatagttgaaatttggtaactatataagaaatcctgccaaaatttgataactatataagaaatcatgccaaaattttggtacagttgtcaaaatttcgacaatgccaaaatttggtaatgttttttttggcatcaaagtaaacatgtcactaattaaaaatcaaaaactgagttttctcagtttcctcatattcttactggtcgcttctcgaaatctaaaattcttaaaaaatgggcgccgccttaattgtactactaccatgtttgaactgttgtaattcggatgtaacaaaacggcatcgtactagcatgtgttaatctaaagttaatctcggatgggtcgttttcaatcagcagggcagatactgttctcatctcgcagttttctttttctgtaactgtgtactactagtacgagtacccaacgtatacgtacgttttaacagatgatttttttgggagtttctcctgtggattatacagtatagaaatgtgcgctttgcttgatgacagtgaggcccggggcccctgaaactcccccaaaaatcccagttatctatatatacccggaaggaaccacagtccctgcctgccatcatcataattcgcagggcaaccaccgctgggcacgcacgctgcctgctggagagcaccacccaatggaaactgattgatcctgcctctgccatggtgagctcgagcttgagctgagagccatcttcttgtacagctcgtcgtcagctttggtgttgttttgtgtagtgtagtagtggagtacagggtcacagtagcagtagtagttgccgagttccttctttgtttgctcccactctccctggatcttttttttaaatttgtttttttatttgttccctttttttttcaccggcttctatcttttcccactgctgctcgtagtggcatctgctgcttctttgtgcggcggcaaatgcgaaagctgccaactttgcgctcggttggttgttgttccttctccaacttagctagctggagtactcttttgcagctctccccaatcccccctccaactccaacctcctataaaatcagcggctcgtggttttctctctttcctgggtagattggattagaggaaggtgttgctctcaagtgactgatcagttgcttagattcagattcgtagtgcttgcttgcttgctccctgttcgttctgagttctgaccgtgcgtgtgtgtgtatggttggtttcttgattagttgttcttgctttggtttgagttgccgaggtggatgaatccggctaatgtgggagcaattattggggttttgtggcaggtgaggtactggtatgcaggagctcggtgggattaatcgattcttgaagaagagcagctcggcgctgcggttgttgctgtgcccaatctagcggcggcgccaggaaggaagaaaagctgcgaaaatctttggttggtcagtggaggtagcagcgagagtaggaggccatgccggagtcttggagagacgcggaggcgaacgcgtcgtcgtcggcctccgtcgccgcggcggactcgagcccggggaatggcaagggcggtggcggcggcggcggccccgcggtggcaaggggagagcgggcggcgtcggcgtcggcgtcggcgcgggtgccgttccacaagctgttcgcgttcgcggacaagacggacgcggcgctgatggcgctggggacgctgggcgcggtggagaacggcgccgcgctgccgttcatgacggtgctcttcggcaacctcatcgacgccttcggcggcgcgatgggcatccacgacgtcgtcaaccgggtgtccatggtctccctcgagttcatctacctcgccatcgcctccgccgtcgcctccttcgtccgtaagtgctggaacacaccactgtactctactctactctactgtctcgccgcaaagattgcaaagctgaacttgttgttggatgatcttgtggccagaggtgacatgctggatgatcaccggagagcggcaggcggcgaggatacggaacctgtacctcaagaccatcctgaggcaggagatcgccttcttcgacaagtacaccaacaccggcgaggtcgtcggcaggatgtccggcgacaccgtgctcatccaggacgccatgggcgagaaggtgagctgagccaccaggacacactcctccacatgctcaattttgctctcaagctgtaggcagctaaccattccccccatgtcaacgtcgggctcaggttggcaagttcattcagctggtggtgacgttcttgggcggattcatcgtcgccttcgcgcaggggtggctcctcaccctggtcatgatggcgaccatcccgccgctcgtcgtcgcgggggccgtcatgtccaacgtcgtcgcaaagatggcgtccctcggccaggcggcgtacgccgagtcgtcggtggtggtggagcagaccatcggatccatcagaacagtaagcatcaccagcagcaaagtgatcgatgaaaaggagcacacaaatagacacaggattgttgtgccactatcatatagctgaaagaacccccactaatgcggcaatgtttgacgcctcaggttgcatctttcaccggggagaagcaggcagtggagaagtacaacaagtccctgaaaagcgcctacaaatcaggcgttcgggagggcctcgcagccgggcttggcatgggcacggtcatggtgctcctcttctgcggctactcgctggggatatggtatggtgccaagctcatcttgctcaagggatataccggcgccaaggtcatgaatgtcatctttgcagtgctaacaggatctctgtaagtcttatttcgggttatttttgtgcatatatagtttcagtaatatttatgcttgatttttaccaattgcttggaaaagcactacctttgtgttgtgtcctcaatgcttgaagtttctgcttcggttcccagtttcattttttagaaatatagttaagtcatgattccaaccttcaaggcatgctcctaaattacagcagttggtaggtgggaaaggattagaccgacgattagaatgtttagtacacacatgtacttcaaagttccaaattcctctttttgggatggggataagggaagttacaacagctaaagttttgtgattatgatgatttcgacgtgttaggctacaagcacaaactaaggtgcatgcctcttttttttttggtgatggtgatagcacttatcatgggtaaatagcttaacggattttgggtgtttggcacattggcaagtgatttggtagattcacctcccttttgttccaagttttgtactacctaactaccaactcccaccagcagcctcaggtagcatccaggatgcttttcatggtcaacaaaatagatgatgctaatgaaattgaagaatttactccaatttataaaataaatgaaataggtttttgctgtgaaaaattattggttcgtacactgtttttttagtctttttgtacctttttgcttccattttagtgatggtagccagtttgtacttcagttaaattgaccaagcaaactgattataataccagatgctgacttattttgttatcatatttaacagagcactagggcaggcatcaccaagcatgaaagcttttgcaggtgggcaggctgctgcatacaaaatgttcgagacaataaacagaaaaccagagatcgatgcatacagcaccacaggaatgaagcccgatgacattcgaggggatattgagtttagggacgtatatttctcctatccaactaggcctgatgagcaaatattcagaggtttctccctttccatacccagtggcacaacagttgcattggtcggtcagagtgggagtggtaaatcaacggttatcagcctaatcgaaaggttttacgaccctcagcttggtgatgttctcatagatggtgtgaatctcaaggaattccagcttaggtggatcagaagtaaaattggccttgtcagccaagaaccagtcctatttgctgctagcataaaggaaaacatagcttatggcaaagacaatgcaacggatcaagaaattagagctgcagctgagcttgcgaatgcctctaaattcatagataaaatgcctcaggttagaagtctactctatatgcaagttttgtgtttccagtattcagaatttttagatcattgggcataacatactgagatttcttccttctccttgccaatatttacagggccttgatacttcagttggtgaacatgggactcagctttctggtgggcagaagcaaagaattgccatagcaagagcaattctaaaagatccaaggatcctactgctagatgaagctacaagcgctctggatgctgagtctgagaggattgtgcaggaggctcttgacagggtcatgactaacagaacaactgtcatagttgcacaccgcttgagtacagttagaaatgctgacaccatcgctgtcattcatcaaggaacattagtggaaaaaggtaaaattcccaaaaggctcatatcaatgatcaaaatcatccattttatgagctctcagttgcccattgcatctttccttaaacatttaacatttttggtcaggtccacaccatgagcttctgaaggatcctgaaggagcttacagccaactgataaagctgcaggaagcaaaccggcaggacaagtctgaccgaaagggtgactctggagctcgttcaggcaaacaattgtcaataaatcagtctgctagccgcagccggaggtcatcccgtgataacagccaccattcattctctgtaccatttggtatgcccctagggattgacatccaggatggttcctctgataatctatgtgatgggatgccacaggatgtgcctctaagtcgtcttgcgtctctgaacaagccagaaattccagtgctcatactaggttccattgcatctgtcatcagcggagtaatcttcccaatctttgctatactgctgtcaaatgtgatcaaagcattctatgaacccccacatctgctgaggaaagattcgcagttctggtcatccatgttcttggtgtttggcgcagtatactttttgtcacttccagttagttcgtaccttttctctatagctgggtgcaggttgatcaaaaggataagattgatgacatttgagaaggtggtaaatatggagatcgaatggtttgatcacccagaaaactcaagtggagcaattggtgcaaggctatcagctgatgcagctaaagttagggggcttgtgggtgatgcacttcaattagttgtacaaaacacaacaaccttgattgctggtttagtcattgcctttgtatcaaactgggagttatcactcatcatcttagctttaataccactcattggtctaaatggatggatccagatgaaattcattcagggtttcagtgcagatgcaaaggtttgtcctctactgaaatgtttgttttgctggattattacttccgcaaaacctgacttctttacttgtttatgcagatgatgtatgaggaggcaagtcaagtggcaaatgatgcagtaagcagtataagaaccgtagtctccttctcagcagaagaaaaggttatggatttgtacaagaagaaatgtgaaggccccctaaggacagggattagaacagggattataagtggaattggctttggtgtttcatttttcttgctatttggagtatatgcagctagcttttatgctggtgctcggcttgttgaggaaaacaagacaacttttcctaaagttttcagggtaagtattctgtactccggcagtggtaggagaatttaaacttcagctacttcatatataaacttttaacatcgctcacatatttttgaaatgaagaactcaatttttctgccatctgaatgcaggtttttcttgctcttgctatggcagcgattggggtgtcgcaatcaagtacccttacatcagattcttccaaagcaaaatcagctgtgtcttcgatatttgcaattgtggatcgtaaatctaggatagacccaagtgaggatgcaggggtaactgtcgaaacactgcacggcaatattgagttccagcatgttagcttcagatatccaaccaggccagatgttgagatattccgagacttgtgcttgacaattcattctgggaaggtacgaaaccatccatacaagaacctctttacattcaaaatgtttatgcttgctaaagctaactatccaaatcatttttatcagaccgttgcacttgttggggagagtggtagtggcaaatcaacagcaatttcattgcttcagaggttttatgatcctgacgtaggacatatactgctagatggtgtggacattcagaagtttcagctaaagtggctgaggcaacaaatgggtctggtgagtcaagaacctgccctcttcaacgacacagtacgagcaaatattgcttatgggaaggagggagaagcaacagaatcagaaatcattgaagcagccaaattggcaaatgcccacaagttcattagttcctcgcatcaggtttctttctaggtttctttcttttcattggtgtttgctattgtgattaaatgctagaaacatttttctcaaagatttgttttacctgaaaatttgtagggttatggcacaacagttggagagcggggagctcagttgtctggaggccaaaagcagcgtatcgcgatcgctcgtgcgattgtgaaggatcccaagatccttcnnnnnnnnnnnnnnnnnnnnnnnnnnnnnnctgaatccgaaagggtggttcaagacgcgctggacagagtgatggtcaaccggacaaccgtgatcgttgctcaccgtttgtctacaatacaaaatgcggatttgatcgcagtcgtcaagaatggagtgatcatcgagaagggaaagcacgataccttgatgaacatcaaggatggcgcctacgcctccctcgtcgcccttcattcagcagcttcttcatagccgccggtagtaaggctcctgcaagtgtctgctgaacatatattaacagaactggcacacacactgcaataattctgcaggtgctagtctttgttcctcttttgatggcatacataactgcttatagccaagagggaaaggctatacagatagtaaggaccaaatgtaaatgcaacaagttggtccttaacatatatattaattcatatatatatatgtaacacggatcatagatacccaaatagatgatgattatgattacctctcatgtgtttgctcttattttcccttggagattttattttctaccatgcaaggaactaccgaagggggaactgttcaagaaaggatgaacacatcagaaagatgcaccctggaactcaaatctcatcctgccaggctgccatgttaaattgttaatcagtcaccctcctctgacaagatgaaagaaactcgatggaaatttttatagacagaaatactgaaccaccaaacctgatgcatggaagagcagagttaaacaagactccgcagaagcatgatttttcttggcgatctccttgaaggttgcaagatcagatccaaaaaaacagcaggtgttttttggtgaccaagaaacaccaactctgttcggcacaatcgtcaatggccatggccaccatggcaatcgaaaacctactggcttctctgaatttatcaggttttgtcactgtcatgtactagtatactggtgtgtggccggggttgattcgtgcaagtaactttcaggacctaacccctctacttccgaatgacaacaaaaaaaggcccaatttcaaagcgaactgttgttgctgagagcacaccttgcaacctttgctcgttgtgaaaaagcacatataggagtgtacttcccttctagaatctggttaggaaaattactacaaaatcgatgnnagtatagtcgagaggcctgagatggatctaggtatctaaacgattcagacaacccagcggaatagtaaaacgagatcccccaataaccaagacctaatctcacgatatattagacggtgggagaagagcaattgggggagcctcttcagttgaaactccgaactggaagctttcccgccacatcaaacaggaggacacaggggaaaagcaacaagaggaggaggaagaagaagaagaacacagaccaacgcgacggcgtggcggaggaggcatcaccatggaatcgatcgatctcatctcaccaacgctacccgtcggcgatctccggccggcaagggcgacggcgcgcgcgccggcgtgatcgatcgatctccgcgtcggccatcatggatttgccccccgatgaccctccccaccctccctcggttgctacccctggggttgaaaaattgttgtcgtgcgtgcgcccatggattggatgagcgaagaagaagacgaccatgggggaatgtgccaaagcccgttgacattttgcgttcaaccgcggctgtttactgaggcggttgctgtcgattactagttttttttcttgtcaacaaggattttttttttttggggtcagtgagctgtgttgacaaatttgttggccggccaacttggttgtatatttttattggattggattgggctcttaataaaaaccctactagatcagttggcgggtatatttatattttgggcttcctccctctagtagcactgaaacaaatcgtttttaaacttgtgaagaaaatttaggagagtactcgctcaaatgactatcgttgtacatttacactgaactggaaaaagaacgcaagccatggaaggatgtgaaaaggcgagcgaaaaaaattgacaaaaatagtttatatttaaaacgaattataattagaaccgaagtagaattgccatggtgaaatagcacagttcctctaaatttagttgtgtaaaaacctgaaaaacgaaggtaggctctctttataaaggcaacgcaaaatatatctatacaagtaattccacatgagatatggcctattgatctggacataaaattcatgtgtaaaagtgaacttactttgaaactacttcctctgtttcagattataagatgtttttgactttagttaaagtcaaactactttatgtttaactaagtttgtataaaaattagtaacattttcaatccaaaacaaatttattataaaaatatattcaattattgatttgattaaactaatttaatattataaatattattatatttatctataaacttagtcaaactttaaaccgtttaactttgacccaagtcaaaacgtctcataacctgaaacggaggcagcattactcttacaaaggtgtcctcaataatatataccacagtcgtgcagtcagatctacaacagctgcaaagctctctggaagtccgggttcagattattcttacatttttttttacagctcaaaaatgaagggggaacagactttcagttcagatttcagaatgtattctatatcaactgaacatgaaggtgccaatcgcccgaggaggcaaggagaactgccacttgccacaactaagatttcagtcacaatgccttccattgggccggagagctggctagctggaatgctggatgtcaactcctcatgccagagtttcttcctgcattcaacaatcgataggcacatgaaagttagtactactgactacagtgtgattagccataatagtttgtttcaaccacttgcatatatgtcaatggctagagtaagggttagttgtgagaagaatcacagagaacgtgatagttgctatcagaaactgcaccagaatacacaatgcagtgccaccacaaactcacaaagtaaactgcatttatacaagcaaagtttttaccaagctcacggctatttgaaattttgcatgaggataaaaaaagagtactcaaacaggtcgtcttttgtcattgaagttgtagtaaagacagtaagatgaataaaactattcttgccaaaaaaaaaaaagaagaagaaaaagaagaatagaactaggaaatgcatagaaaccagagtgtaatacccaagatgatctgaatgagaagctggtttagtttggcatgaaaatttgtggccttgccccgttctagtgagaatcttttcattatcacagcgaacaataaaattctatatttctctgcaacattatccatgatgcacagaaaatgaatgtacatgtttctaacttgagtagaagacgagattttaaaaatcaatgaatcataaagtttgtcacatgcgccttgctccttccatagaaacactagacttaagattttaaaccatagaattcagaaagttttgtcatgtgcgatgttgaagaactctggtggggaatttccaacgaatccttccatagggaatgtatcatgtatgggcctggtcagtggtcacacacacacatatcttcatagatgcgcagcccaacaaacacaatgtaaccttaatccttccataaaagcattcatcaactttctaatgttaattattccctttgcgaaccagaacaaagcaacaatcaaaagcagaaaaagttttaagcgctccatgccgtgagcactactgatgagaggacaaaagcttccaagaatgctttgagcaaatctccatattcctcgtggcaactggcagccttatcatcaggcacaaccatatgcttttggaccgaaaactgaacacccagaccctgtattgctagtggaagtccagggcatctttccatcacaagtacagaatcactgttacttccaaattgtttaatactccctccgtttcgaaatgtttggcgccgttgactttttatcacatgtttgactgcttgtcttattcaaaaaatttaagtaattattaattcttttcctatcatttgatttattgttaaatatatttttatgtaggtatataattttacatatttcataaaagttttttaataagacgaatgatcaaacatgtgctaaaaagtcaacagtgtcaaatatttcgaaacggagggagtagtaggtagtaaaacagcaacagatcgattgtgtaatacagtataatgaggcaaatagttctagatacgggtgagtggccttccaccgtttcgcatcggacatctgtcatcgtattcgtggtgctatgccaacaatctctgatctcatagaagtatgcaacagaaacatctctaacgtaaagtatgatttcgaactttcaatcgtgcaaaagaaatctatatgctgacaaaccgtcatatgttctatacttgtccggtgcgacagagtccatcgatataaaaacaaattgtctctcatgtaaattgcggagtgtgagctgtgaatactgtggttccaaggtaagcctttctatggtagcaatttggcaattactataggatgtggattttcatccctcaagggggcatcccctcgttgtttgcatgtcatctaaatagttattaaaaaattttaaaaaaattgataacatagattaatacgaaatatatcactccacaaacatgaaagtccaaattcaacttctataagttgcaacaaaaataacaaattaaactgaaaatagttatggtatattcacaactgtatttgttatttttgttacaacttgtagaagttgaatttaaacttgcgtgtttgtagagtgatatatttcatattaatctatgttgccaatttttttcatattttttgatgactatttaggtgacatgcacgaaaaggggatatcccctcgagggatgatttcactttcccattgctatataaacataggttagtgaaatgaagatcttgaagtcttggtacacatatgatatgcccattgaatttcttaaatatatggacaaaaccaaatagaacattgcaaactatatttcaagtacttaaatgcaaattgcactactttaattgcaattattgattgtttcagttaataatttggtacttcgcaatccaacagctttgtataatcggcggttgagccatcactgaagaaacatgtcccagcaaaggcttagaggctaccacatcaagcatatcaagaaagaacacgcgatgtgttccaggtgttccagacaaacaatttgtttttaccaaattacacagtaataatccatcaaaattcagaactaaattaaccccaaataaaaaaaacagcagctaaacagaatgtttcagcgagatgatcagttcagtgtaccttctcaggaggccgtaactttctgcaggtgaagccgtcggcgacgagcttggcgaccgcgtccctgagcgcctcgtattcctcccggacgttgtacacctggtgcgagatcctcacgtaccccgtcaccggatcgccattgccgtccttgaccatctccggcggcgcatccgccgccgccgccttggagttgtagtagagcggcacctccaccttgaactgcttcctcagcatcgtcctcaggccgacggcgtcgtcctcgctcccgacgcccagcgagccgggcagccccaccatgagcatgctcccgcacatctccggcggcgtgccgaggaacgtgccccacgcggcggcgagcatcgtgcccatctcgaccaccttgtcgtggttccggcggcgtatcccctccacgccgccgtcgaagcgattgacgaagtcgacgacgtccgggaccacgagctgcgcgctgtagtcgcgcaccccgatccaggcgctctccatggggaggccgttgccgtactcgctggagacgacggggtggtggagcttggaggagacggggtcgtccttgcgcgtgtggatgaaggcgacggcggaggggcagaagaaccacttgtggaggttgctggcgtagaagtcggcgccgatgtcgcgcacgtcgacggggacctgccccacggcgtgcgccgcgtcgacgaacaccttgtcgacgccctcctcgcggcagatggcgacgagctccttgaccgggatgaggacggtgggcatggcggtgatgtggtcgatgacggcgaggcggacgcggcggcgaccgccgtccctggccaccgcgagcgccgcgcggaactcggcgacgatggcgtccggggaggagacggggaacgggaggggcacctcgacgacggtggcgcccgcgcgggccacgtacgcgtggatggagttcttgatggagcagtaggtgtagaggaacatgagcacgacgtccccgcgcgcgaagtccccctcggcgaagctccaggcgacgtgctgcatgatgatggcggcggccgtggtgacgttgtcgacgagggagacctcggaggcgtccccggcgccgacggccgcggcgaccgcggcgcgggagcgggcgagcccgggctggaggtggtggaagtagaacgcgtcgggctgcgacaggaacaggcgctgccaccgcgcccgcgccgccagcaccgacgccgggcagcagccgaaggtgccgttgttcaggcgcgccacggcgcggtcgtggtgcgcgaactcggcccggacctcggcgtccgtgatcgccgccgcgcccgcgcccgcgcggggccgcttcgccgagggcggggacgcggcgccgtcgacgtcggcgtcgacgccgttcgcgaccgcgtcgccgccggactgaagcgaggccatcggaggttagaggagatgttgacttgcaagcttggagccgtcagaggtgtcgggtatgggttgggccgttgggggcgttatctttgatgggattagtatgcaattatgccgtatgtggatgaaaaatcacggttgtctgatcaataataaaccaaacaagcgaaacaaatttttgtaccgttgggcaaaatgtatctgaaaatggttccgttggagcatgaccaatatgagaggagctgttttctttttttgaaaatattttgattgactcaaagttgttgaagcaagaatcacaaaagaagaaagattttattcacttgacaccggaccattagctttctccgtagctaagattcttttggattaaggctgcgttctaaatactagtacatcaaaagagaaacacgtccgtgtcgctcggccggctctgcaaggacggcggcgggcagagctccgttcttcccccaagggcactattcagacaggggtttctaaggcgacctaaaaagaagaggtggcggcgccgtccagatctgtgctctccctagccagatccggtgaggggtagcgacgcagttttgaacagcggtggaaggtgacacagatgggaaagagggtgccgaggcagccgctcgtgcagctggatccggcaactcctacttgcgtgggtcgacgcggcagcggggaagagggtgcagagcaaaggtggctccttcagctgggtcaaggctggagggagtggtggtggagggcgctggcggtggggaagagggcgtggaggaggcgacttgtgcggctgtacctagcgtccccatagccaaatccggtcgccctcattccatcccgagggcgcacggttcgcttgtcggtggcattagagggctagcaagtgtggcgacagaggcttggggtgctggccagcggtgacgaccccgatgatgatctaggggggaagttgtgccggcatggaggagcattgctggcggagggaggctagcgaggcgcatagagtatgcggcacgaaggcccgtggctggcgagcacggcgcggaggcgacgaggccggcgcgttggatggagtggtgtggcagcgagcctaccgtggtaggagcatggcatggctagggcggtgcggcggtgaggctactgcggtgggaggacgaaggcgatggtcatgcgatcaggtggcccgttaggagacacgagcaacctggtcaaggcaacagcagcaccatgaggtaggcgttgaaggctttggtgagttcctttctaagtgtcaatcctcttgccgccacaagatggccacgttggacggggtagcgtgagggagaggtgatccattcttctctcttaccctcttcctctctaacccacccacatgtgatcttattcttatgactctttctctagtagttatggcagtaaccctatcaactatcgacattcacttccttctagtggcagagccgaacaccatgaagcctagtaggagtataagacgaggattctctattgaccgtaaaatgtttttttttggtctatgaacaataatgcttgttaactggcactccctaacttagaggtggctcttcatcacatttaaggtccattacagtttgctattgtaactacacataatactagtcattcatttttcaacccaatggctcaaatcgattgcaacactgctatttatgtttttatacaatgttttgctatattacattgccatagtatctatgcgaatcttacctcttctcccttgatcctatattcctatggcacaatagcaaccgtatgggatctaaattgctccaccaatgtctcattttctacttttatctaccatggtctcatctttctaagggctttcacagtgtaacctccacacttgaacaacatggaatatcacataagatgacgctcctttaaaacaactcattccatagtgcaaactagttttaatgggtctcactcctaaccgtattcacttttcatctccctctctctctctcctctctgccaccccacggacggaggatccgggaagcgaggcgtggattcttcttcgccacctctacagcgcacctcgtctctgctcgccattgtcagccacatccacaccggcgccccctcttcgtcggcgccgctctctatcccccttcccctacatcaagacgacccacaccgtcgacaccaccgaaaaccacttcgtgcattgctcccgtgttgactaggtgttgaggacgagctcatggtagagattggggtggtgggcctacgagctccatggcggcggtgcgaatcaagcgacatcgacggtatcaacggcacggaggggggaagatgatgagctttgcagggtgaagagggtgacgacaacgaggagctttgcggtgcggagaaggtgatgacgacgagacttgtagcgtggagaggaggaggacgacaagctctacaccggtgaggtgaatgcagtgcccccaatctggccagcgagcttcgaggccgtcgtcccctcctcattttgcctgaagtggtcttggtggccgtcccctcctcccgagcggcattgcggcttgggccaacgagctccgtggtggccttgatttgcttgccgaagtctacaaggcgccactcccatcttcttgtccttcctccttttgcctattttagaccaccccttgtgcttcactctccagaggaactcgtggttcaagcaagaatgaaaatccttggagaaccactgattccccctcctctgtcctccacggcagcagacatctaacgtggtgcatcgaatccacacaacagctagatgcacttagaatgacctaatagagcccccatcgtacattctttgccctattttagtaataaagcagccacatcacatcacctgttttagtaagagcacgtcatgtctccttgcatatttgcacaacacacctttaattttgcaaaactgcggatgggtgcatttgtttttttttttcattgtgtaaattgcatagaggtacaacggaattgctctatgcaggtaatgtggattcattaccgacgtgcctgttaacgtggaaaaaatttatcacgcttgacacctttttagataaaaatacaatcatctaagtatctaaccaagttatttcacttgaatgcttaattttgatgacattattgtcaattatatcattttttatgcactccgtactcaaagattgtactatactcaattatacccatcctccaacttcttacacatatatgcttaatttttaaatttttatcctatctacttgtaagtttatatatgcacaatagaaattttacacgtttacaagttgaacataacttttgctgctatttcagacatcactccgtataaaaaactagtgattcgaaaagcttacgtatcgatgtatgaattgcggaacatcggcgcagtacgagaggggctaaaattgttcctagtggatatattatggcaagtggaaagtaattaaacaggaagctgtcgatgaagacgagcataaacttcaaattagttgctttagtgacgtaggagatggcgattagtgcgcacagccgtgctcccaacaaataacaatgattaagttttgattaggacaacaattcattcattgagtaatactaagaatttaggggcaattgcaaatttaccaccgatttttttaatattgcaaggatgccactcgaatgacaggtctaatggcatttttgcaattttctagtggcagttttgcaataacgattcaaagtagtggtaaatttgcaattgccccaagaatttaagtttgttattaggtcgagcggcagataagaagtcgtcttgtattgcaatttatttgagctgcgagtcgtggtttcatgatagtcgtgttgaactcagtttttatctgcccgctgccgtgcggacaatgagcgcccaccaatccaccgtaactgataactcttcgtcccattttaaatacagccataaatttttatatctaactttggttatccgtcttatt

SEQ ID NO: 5202 - DNA, 1788 bp, Oryza sativa
ggctggacggaaaactcgaagctcgttagctcgctcggctcgtagcaggctcggctcgactcgactcggctcattaggataacgagccgagccgagccaagattttagctcgttagtataacgagccgagccgagctaactcgcgagctgctcgcgagctgaacgagctgcgctttctggactgcaggccgcatccacctgtgtccgcaggccacaacccagtagcccaaaagcccccccagcccacacgcacatataggagaaaaaaaaaccttaagcctcttgcccttctcacttcctcagtcctcagagtctcacgcgcggccgcacaggcacctggccgccgcaagctcgcggctagggttactgcaacagcgccagcacgcgacgcggcgcgccggcgccgtgaccagcgcctctccgtccgtgagtccacgagcaggtcccgttccgatcctcactcggtcactcatctttcctttttcctctagatagatctacatttgctgattgccgaactgctactgaactgctgactactatgctccaggtccaagccctcagtcggggtcgcagccatggagggtgagaataatgcatcgccgcatcctccaagtttggagtcgaggagtaagcttcgtggacgacgaggaacaagcactcggtcttcatcgaatcccactgtgtccttggaagtggtggtatgttatctaatttaaaattgctagttcgtacagtatagacttgaatgttgatttaattattgctatccagagtgctgtccagattatttagttacttccatgtagatgtagataatgaatttatccccaaaaatgaagaatgtcacacttaattttaatgcaatggcaacgattcagctatacattaatacatgtatatttccttatgcagccattggagaaagtttcagaagatgaagacgatgataacagcttcaaccatagggatgatatgtctgaaagcctacctacagttgatggtggaagtggaagccagaagggtgatgatgagtttgatgatggtggatcaaaggctaagaaggcaaagacaggagggaaaaaagctggtgtcacagtgtctcccaagtgcaagatagcaagaggcaaaagagctgagtgctggaaacattttaaggttatcaatgtcccatccaagaaggagagaggtgtcatggtggcaaaggcaaagtgtaagttctgccatagaagctatgtgtatcatccaggtggtgctacaacaactctgaaccggcacctggctggttgcacacaatatcagaacaagttgacaaaggctaaagctcaaggtacactaaactttggtttagaagatgacaactctcttattgttaatcctactgagtataatcatgagcacactagagaactgattgccaagatgataattgctcatgagtattcatttcggatggtagaacataaatggtttaatatcttgatgaaatggatgaatggtaactacgagtttattggtaggaagtctataaaaaatgaatgcatgagggtttatgaatctgaaaaaaatcaactcaagaagagtttgaaagaggcagaatcaataagtttaaccactgatttatggacgtctaatcaaaaccttcagtacatgtgtttggtggcacattatatagatgagaattgggttatgcaatgccgtgtcttgaactttatcgaggtggatcctccccacactggaattgtcatagctcaggctgtttttgaatgtatggtagaatggaaaata

SEQ ID NO: 5203 - DNA, 930 bp, Oryza sativa
ataaaaaaaattcgtttcatagcgtcatctacaaaatctcatccgtcgccgtctccgcgctcgcatggtaatccgtcgtcctcgccgggtcccagccggacaacggcggcgccggtgccaacgccgacgctgacgcgcgcgcgcccctcgtcttcttcgccgactgccgccgtcggctggacccgcccgtcgacgcggcctacttcggcaactgcgtcgccaaggcggcggccgcgcgcgaccgacctggcccggccgacccccggcgcggcgtcctgcatgcgcgcgcgccacgcgatccagagggccgtcggcgttcgtggcgtttgctccggcagccgaggttcgtggcggcgtccgcctcgccgcggtttcgggcgtacgacgcggcggattttgggctggggcgcgccaaatcccagccaggtacgagctctggcaacaacgaagcactaccaaagccgtagatatgtctccattgattgaacacgttcgaccatgagatcgcaaacatcatgcttgttaggaaattataggcaaataaactataaaaaacaatagatcaatcatagaagatatgaaatttaacgtgaaaaaccctcccaaattagaagagaaaaaaaccattgaacgtgaaaaacctttccaaaatagaagagaaaaaaaccattgacgtcagcaatatatcttcactatatcaaggtgagattaccacactgaacggcagcttacaagatatatatacaaaggtgaaaccctaaaatataacgatcacttctgctcaccctctagcatctacgggcctccgcttcgctctggtaaaagctacatttattatgtataaatgaatttggatcacagctcaacggtgctgtcactcaccagtaaagaagttgcgacctaaacgcctccatatgctccggacggagc

SEQ ID NO: 5204 - DNA, 1444 bp, Oryza sativa
gagctacaaatttttacggaaattcagttgaacacgttaaaaatcagacgacttgatgaattttcgtcgaaaatgcacgcgcgcacatacaaaaatggagattaccagtggtagctccggtgtcaccttccggaggatgcgccgcgccacgtcagcggccatggggtgcacgatcgccgaccggtcgaacaccggcgcggggggagatggccggccgcgcgccgccgccgaccacacgtccatgaaccgccagaagctcagcccatccgccacggcgtggtgcacggccacaccgaccgcgacgccgccccggtccccgccgccgacgaaccgcgtcacctgcacggcgagcaccggcgcggggagctcgggggcctccaggctgggcacgagccgcaagaacgccgggacgtcgtgccgcttggcggccgacagcgcccgcgcgtcgccgtcgctctccgcctccaggaacgcgaccccgtccccgacggcggacggcgagcagtcgacgacgacgtcgccagtggaggggacgtacgtgagcttcccggcgagggggaagaagaccgcgacggcgtcggcgagcgacgaccttagcgactcgacgagggacgggaagtagtcgtcggcgccaccgccgccgccgtcgtcgtcgtagaggaagaggcgttggatcggcggctgcggcaagaaccagacgtcgaagagggagagcgggatctgctcgaggtgcggcggcgagcggcggaggagcgggacgcggatggcggcaacgactctcacctccgcaccggaagccattgatccgatcaagctagctagctatactagctagtgactggcaaagtgacaatggtggttcattggttcaagtgtgtcgtgtaatcttgtcgcattgcctgcctctcgatctgtctgtagccaggattattttgcagttggggttttggcgtaggccatggatccaaactttcgtggatggagaatattgtctcatattgatgtattaaattaaatattataaagcgaacaaatagtttagaaaaaaaattatgtaaataatgttgatgtatttcttctgttctaaaatgtaaatatttttttagatgggcacgggaattaaaaaagtatatagaaataattggagggttatgattggtggagaaaaaaagtaggtgaaggggaatgtttgtggttggttaagaggagagggcatttgaaaaaaaaaaaagttttattttgagataagttactgtgatagaaatagctacattttacaatagaggtagtagaaagttttcgaaagaacagcatggcacgaataacccatacttccataccacaatgataagttctactccatatggattagacaagcacaaatgatgctatgccatttgatgcgggatatattgatgaatatgtatgctcaatattataaaaa

SEQ ID NO: 5205 - DNA, 1131 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccacttggcgggcactctcagtgtctatcagaatgccacgggcaagatctgcggtgtctggcgacgagttccacgtgattacaagcgcatcctgcgcgacgatcgtctccctgttgtcctcctctggggcaacaaaccgcaggccgagttggctctggccggaaaggtggccaaatacgcggcctg

SEQ ID NO: 5206 - DNA, 605 bp, Oryza sativa
tagtccatcatgtttccggctgcacggctggcctttatgccgccggtgttgggcgcctacctcttcaccgaccggccgccttgttcgccgacgactggtgcttccgcctgcacggctgacttattatgccgccgttgttgggcgtctacgtcttcaccgaccggccgcctcgaccgcgccgactggtgtttccgcctgcacggctggcctattatgccgccgttgttgggcgtctacgtcttcaccgaccggccgcctcgaccgccgccgactggtgtttccgcctgcacggctggcctattatgccgccgttgttgggcggctacgtcttcaccgaccggcttgccttcgccgctgccgactggtgtttccgcctgcacggctggcctttatgccgccgttattgggcgtctacgtcttcaccgaccgacttgccttcgccgctgccgactggtgtttccgcctgcacggctggcctttatgccgccgctgttgggcctctacgtcttcaccgaccggacggctcgttcgccgacgactgatgctttcgcctgcacggctggcctttatgccgacgttgatgggcgtctacatcttcaccgacc

SEQ ID NO: 5207 - DNA, 547 bp, Oryza sativa
gcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccggttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtact

SEQ ID NO: 5208 - DNA, 975 bp, Oryza sativa
ctctctcttctctctctctctctcagatttcaacacctttccacatcgaattaagaaggataatgtaaagtaagcagcgtgtggcagatcaagtacgtgtgtttcatacatggagatagctagcaatcgatccccatgtttggtttgtcgttttagtaccatgcaacgtgcgccctcgggtgttgggaacgtcaaacgagtacatatttgccttcgatgggaaagggggagacaagttgttaacatagcactgtcgataaaacggctgctagcttttgtaaaagaacaaatattagctagataacctctccgggttagggcccaatgtaacaggcaaaaccatagcttatatttttcggaattgctaaataattgtcgacaattttttgtttgcagaactatcgatttgtgagccgttagatcggcatcaagatgcgcacaagcagattgaaaaaaatcacatccacacttgtgggcatggatcgaacccacgatctcataggtgcatatgcttgggttcctaaccaactaagcaacaacatgattctgagcagtttttttgccagttacatagtagttacattgtacaatgtaactacgctgtaattatatatagtgtagttacatttgaaagtttttcatctaaaaaactgtcgacaggcttttatttgcaaaactgtcaatttgtgagccgttagatcgacatccagatgcgcacaagcagattgaaaaaaatcacatccacacttggggccatggatcgaacccccgatctcaccgatgcatatgcttgggttcctaaccaactaagcaacaacatgattctgatcagtttttttgccagttacgtagtagttacgtatattgtaactatagtctagttacaacgtaactacgctgtaattatagagtaatttcagcgtagttacaattaaaagtttttcataaaaaaactatctaccgttatatagctaa

SEQ ID NO: 5209 - DNA, 2397 bp, Oryza sativa
atcttaagccatgccaaagaatggatatagtaggtcgtttagttagttaaatcagatccatccttattgtgaatcattttataacttttgtcttttccacttctcttctatgcatgtttgcctttacctaacaaaatactttgagctaccagctttgtcgtcttatcatagatgtaaagtcactcacatttgaaatcagcgagtatttaacttggtacatccacgtgagatgtcgacatagtcgacctgccaagcaatatagggcaatcacactgagctcgatcgttggcaaaactaaaattaatatttacatatactatccaataagtaaaacatagagtaggtgaagactaattgtaccttctcgaagaaacaagtcatcatggaataaaaacacacaccaagaaagaatcaagacgctacctagctagcttctctctttgcagaaagcaaacaaaaaccccaccaaagaaaagaaatgtcattaaccctctcctgtggaccagcgtagttagaatgttgcatcagtgtgatatatgggcactggaatcatttgaaggtccttgtaccgtgtgtaagttgcacaagaaaatacggaagaaaacaacagatcgatgagcgtgtagactcgtgtagactcatcagacagtgatttcgtaatattaattagctgcatttcttaagggggaaatttttttatagatatatttaacgtatatttcatattatgaactagggagtgtgtcaattaataacaaggatatcgtattggatggaacttattttttctattttcttacatcgatcagatggtttgtataaattggaataaaattaattgagaatacatataaagaaaaaacatattcccttgcaaacattgtacatcagatatatcaactttttttctattacagggtatatgcgcacacgcatttgcatgtgtttaagatctttgtgggcatcaaaatttaaaccccagtgaatggtatataatacaccttgaaaaatatgcgttttgatacttattctagtagaacatattcattatattattaaacaagggtggaaagagacattttgctccaaaccatattaatcagagaaaaaaaaagttagataaagaccgataatcatggtaagtaaagactataacattgtatttatgaaaacataagtaaaattcatatgtcataaccaattcttttttttacttgaatccaattatacttttaggtctcctttgaaatgagggattgtgaaaacatagaaatagaaaaaaaatgcaaagatagagtatcatgtctgtcgttgaattcctatatgattttaagatcacaggaaaattccaagactattgtttggatgattacacgcatgaaattacaggaactttatcattggaaggaaaaaaaacatgatgcagaacctcatttacttcaaaatttctagtccatccgtcctgaaatataagcctttagaatttgtctcaaaatataacaacttctccaccaatattcttttttcaaccatttataatcctccaccattcaattttcccacctacctctacttcttctccaatcacaacactcccccatttaattttaccaattttcttaataaccgtgtcgaactctaaaaatgtttatattctgggaaggatagagtattgaatagcccattcgataagaattttagagaatttgagagaactatctatttattccaaagaagcgcatttttttcataggaaacaaattctccaaaattcctctggtttttgtttgttccaaatgagcactaaagctttaaaacttgtagaaaaacccacaagttatatcaagagcaaaaagaatccatcatgcttgttcggatgaacatctcacaattatttgtatttacagactgtatctgatgattttttttcgataagctagctatagtgcggttattgctcgttactctcacaaacgacttacataaagtaacagaggtaatagaagaaaactccaatttcaaattgaagcattaagattttttttcatttttttctcttaattaattactccatccgtcctaaaatataagcatttttagccgtgtccagattcatagctataagttattatattttgagacggagatagtacttaattagaatcaaagtttttacatatatatgcgcgaaaatctcgtcagctagcgtacgtctagactagaccgcgtaataacagcatgagattattgactagcacggtaaaacaaaagccacaaaaaaataaattcacaaagcctgagattgtaattgaagtcgtcgtcgtgtcgtcctccggcgccaacttgatcccaactgaaattgacttccttgaccaaaaacctcttctctgatctctc

SEQ ID NO: 5210 - DNA, 7829 bp, Oryza sativa
  unsure (1)..(7829): unsure at all n locations
tgcccctcccagcccacgtcatgcagagctcggcccggcccacctgtcatgctgacgtagcacctgacgaggcctggcccacccctcctccggctctcccgattggtccacgcgctcacacgagtttacacttatgcccctgggtttattttatttttattttcacggtgcagtccaaagtccaagtcctcggatcagccttgggcgaaactttgacccctaaactgataaagcccatagcaattcttgccattttggagcggtgcaactttttgccatatggagctcaggccgccgccggccaagcaccaccaccaccgccgccgtcgcggcggcggcggcgaaaacggcggggaggaggaggaggaggagactggccgcctgtcgctgcgcggcggcggcttctggcggcgccacnacngngaggaggaggaggagaagggcggcgggaggaggggcgagatcaangaggtggacttcttcttgggcgccagcggccgcgatgtcgtcgtggcctcccggcggggacgacaaccgctttcgcgggacgacgcatggcggcggcggtggctgcgacgtcaacgtgagttcgccggcgttggactagagtagctgaaacttgagctcttgattgattggttgcttaattgatctgcagatcgggctagacttgctgaccaccaccaccgccggcgcggcggcgggtggtgccgcggccggcgccggccaggaggacaccgggaacaatcatatagttagttgattttgtcgatacccttgtgtactcttccattcctcttggtttttaattaaattaattgcttgttgtagcttaaattatttggtgtgatcccttgttggctgacacgtatacttatccatgtgatctagaaggaggcgacgacggcggcggtggatgtggagctccggcgagtggtggaggagaaccggcggctgcggggatgctggacgagctcaaccggagctacagcgcgttgtaccatcagtatctgcaggtcacgcagcagcaaaaccatcgccatcctgatcatcacctgattatgaacaacaacaacaaccggccttcactagctcaagtgagtaccttagcttcttgttctacatgttattatcatcacaagcatatgcacataaaaatgttccccttaattatcccggtaaatggatgcatggatgcaccttgcttagatcttcatttcttgattcccattttgttttttcggggcaaggatttcttgattccttgattgtatttgcctttccttaattattttcaagaattcttattttgggtagtttgttcctctgttgatctttcagattcaattttaagggtatacctagccggacttttttgtgcacaattaatggtgttattggttttatccccccctggtttattatattttctgaattctcaatgcacacgtacacattggagatcgaattgtctagtgacaacaattggaaggcatgtgtagatttttccccatgatcaagatctctggtgcaataatgtacaggtcaccaaaagcacacacaccgatgtaagatcctgtagatcaaacgagcttatgtcaatgcctcggtctgctaattaattaactgattaatcttatagaagcctgacactttccaaagcaaatctttccgaacatgatggagtagaattactgaattagatattataaaatgggcatagtagttacaaacatatatgagcatgggcagagcatggcatcaactcttgatcacttgcaagtattataagcttcggggtagtatattacattatttcctccgaaactatcgggattttcccaaatactacactgtttaatccgttttaggtacttcctccgtttcacagtgtaaatcattctagcatttctcacatttatattgatgttaatgaatttaacatcaatacgaatatgaaaaatgctagaatgacttacattgtgaaacggagggagtactaaataactttggctttcattaattgtccatccgattaatcctttttgaacgataggcaggtatacgattaatcatcatcattaatgctgtagctcacaattaatcgtgtgaacaatgttccaaaagtctccaagcgttagatcccttcccaactgcttagctttgctttgctttgcagaggacggacatgtactgtacagtgacacactaacacgagagctagctagctagctaacaaagctaactactactgctacttataactgtaggagtagtagttagcgtgtgctaatctcatgcacgtaattttcatttgcccctgctcgctttcgcccttccttttgactaacgaacacaccacgtactaactacgtacttgttgatcctaccaaacatcgacgcagacacaccggaccgcggcgacgacgacggcgacgacgcagcaattcctggagccgcgagcgtcgtccacggcgcaggccaccgccgacgcggacatggcagcgtccgacgacgaggccggccgcggcggcggcgacggcgacgcgtcgtccccttcgctgagcaacgccgccggcggcggcggcggcggcaacaagatgaggagggttggtggtcaagacgagactgcggcggcggcgccggcgagggagaacggcgagcagcaggcggcggcggcggccgagctgccgtgccggaaaccgagggtgtccgtgcgtgcgcgatccgaagcaccaatggtacatatacactagtagcagtaactatgttttgattgagatgatctagctatatatatatatatatatatcatgcatgcatgtcatggcaacattatttaattttctttgatttgaacattgcctgcaatttaattcattaatttgttcagtcaaaacaaaattaaacatggccggtatagagtatagacaacagaaagcgattgattttacttctagaagtgtacacatgaaacaaattgttgttgttattgaatttacaattacaaatccaaaagatgggacgacgtacgtcgttgctagtttaattattttgaccttttgttgctcttgcattcaattaatgatgagcaactattgaactcctgcagattagtgatgggtgccaatggaggaagtacgggcagaaaatggcaaaggggaatccatgcccgcgagcgtactaccgatgcacaatggctatcggatgcccagtcaggaagcaggtaactaaattaatatatatgcattctcataatatgcgttttcttgtgtagctttaattagcatggcgctatatataaaaaccagctgaaattggaattcatatattttttaaaaaaaaattaaagatgtttgacatagtaattatattgatgtgatccatttttttggaacattgagacgcaagttaaatttatattagttatatatatcttccgttcgatctcccttttttaaaaaaaaattgtggtcgatctcactatattaatggcgctcaccacacgcaatcttcaaaaggaaaaagaattccttgggattttcttactccattaatatgtgtcttgactctttgttaacggatttctcatcttatcgataaacaaatcgttagctctccccgtcaaaaaagaaaacaaattattagctctggttacgtgttttcattgcccctcacaaactatatatctgcatatcgatcggttattcaaactggaaaatataacaagctagctagggacgtcctctttgaccggccggttaagcttacccgatctcacaacataaaaaacggatagctgatttgatatgtgtttgcccgataaccgatctcaacacacatgcaaactggaggaccaactgattataaattgcctttaatttgatctcctacgatctttgcactgtcacacacacacacacacacacacacacacacacacacaaaagtacctgttctctgacacatatatcgattaactaagcaaggaatcatgatactgttgactttcaacacgtctagtaaatgatcgtgtaaatatcaattcatgtttatacacgtctatatatattgaagaatacttccaatagtccatatgtactgatgtgaactcatgcatccagtgagaattcagcatctctgcatccttccttgcatacgctagatatgactcctatcattgcatggacttgcatatatttatgtttctccatctatccagctagctgtatacccatagcagtactcctacataatatgcgcacacaaaactagctacgagctgtgcacacaatatatatatatgctgcgaggagacacgtatgtttccgttgttttccgtgctgacatgacgagatagaagacaagaggaaaaactatcaaatcaatttccattgtttaatactagttcatttttgtgagatatactccttccgagctgataatacttgttattttagacaaggttgatgtcaaactttaaaatctttggttatgaataatttctaaaatatttgtctttgaaatatggtgactatatatatagaatagtcttaaaaaatactttcgtaaaatcatatagttgttaacatctatatacatattataataaaaaataatggtcaaagttagtttttgaagactgtgccattatccaaaacgacaagtattattaacccgaagggagtagtacgtacgtggttataaaaataagatgccaatgcgtttttaaactttttataataagtatcggatttgctaaatgcctttagcaagaaaaaggggagtgaaatcttatggtctctggaccgttgggttcacgctaagatgttgtgtccgagatgctcctcctttagctccaaagaactcctctttctctggcgtcaaggacaccaactttgtcatagtacctatacggactagaggtttggaattgggataggggtaagaagagagagtgagttggaaaaagggaagaaaggggtatcctgtcttgaagagatggcttcgtggacaatggtcagaccaacggtgagcgacgaacacagataggtggtaaggcagtggcgctataccaccggagcagggctggagctgtggcggatccaggatttatgtgatgggtattcggaattctaaaatagcagatatatcgataccgattgacacattgaatgtacgatacattattttgatgcataatctttactacgaattgtgcgcatatataataaaatatatagaaacatttataatttcctataatcagcatcaaacatatttctattgatctaagtatgagtgaagagtaccaaagaattcggaatttttggagattgtatagcataggtcgacaactttatgtagtaaaaatattctgatttattgctaatgaaggaaaacactcataaaccacgaagaaactagtagctagcaaaggaatataacttatttccgtaggacaattgatatcaattagacaacaacatgtagagaaaaacaaatgagtgggcaatatatagatgtatatacaatttgcaaagataactatttcctccgtttcataatgtaagactttctagcagtgtccacattcatataaacgttaatgaatctagacacaaaatcttacgttatgaaacggatgaagtaggcattaaagtaattgcttattaattgccacaaccaaaatgtaaacaagaaaattaaattagcatgaatacaacccatcccgaaattgctccaggccaagcacgcttaacctcatagttctttcgcgatcagcttccggaaaaaaagttgcaacttattgatatgagtatcctatcaatcctattaagccatgtgctaggatgtcacaatatattacaaaagaaagggagggactaggaagactattgatcttattgggctgaggagagctagaaaagggtggaattgaattgttagggtataaatatcacaaatctagatagagtatggtagtacatatatattatggtcaatatatattaggtttgtgtccaaaattcatgggtattcagctgaatacccatgaattatgtgggatccgcccctgggctggaggagggcaatggacgagtcggcagagtgattaagaggcggggcagtggtgatgtctccgttggtggtgagccgccaaagaaaagggcggtggggcacctcgtcaccgctcggttgaggaggagcaggacgacatggcgttgatggtccggttgacgccttttggttttgtcaatgttaaggggcaacccgctgggcaggggaggtggcggcgatggttgaggagatggtgacgccacgacttgcgagaggaactaggggaggagagaaaatatgattagagtggtaactggtactatagctacatgaattcttggtgtgatctagaccatctaaatgtagctaattcagatgagataggcagatcaggaagtatttaacatttgagaaacgagaaccctcaaactatatatgaaaaccaacttccgaaaggagtctaatatacttgccttaattaattactccatccgttccaggttataaaacgttttgactttggaagttaaactgttttaagtttgtctaattttatagacaaatatagcaatatttataatactaaattagtgtcatcaaatcaataattaaatatattttcacaataaatttatcttgggtaaaaaatgttactacttttttctataaacttggtcaaacttaaagcagttataacctaaatcggagggagtacatagttacatgattgcatgcggccggtgatgcggtgcccgatgctgcatgcatgtatttgccttcattagtgcatgcgagaaagatgcatgtaactagcgcacacattggtaagtagcacagtaattgacatgggagtggattctaagagcaggtacaataagatggtagatgctggcgataggacgaccatgtcagtgttgatgcttagctagaggtgaaaaaggtggtgagagagattaacgggcgactaattagggcaagtgctatggtagatgtgactaccacctccaaatttatctattttattcactcatgaactaagaggcaacccatacaatgtatcacctctaacacacaaataccaatatctctaatactctcacacacttcttaaaatttgtgtggaggttgcctcttgatttaggggtggttcatcttctctctctccacttctctcctccactcatcacccaatccattgtggcattcttaggggcaacatatgagatattatagtacttgcccttagtcgctagctgctcacactatccaaggcaaagtatttaactgctgttggctgcatgctatggcaacgcaagaagctgggtggggtcacctcattctaccgcatgcatttgttcatggttgatgggaactgtgtagcaatagaagatagtagatatctattgtatgcactagctattagcactaactataatttgctgatgtggttatttttgtagcctttagctagctatttactattgaccttgctctaatcctccaggggattttcttttaaattcgatgcatgcaattagttgtgaaaaattgtgaaaaaaattgataaattagagtatagtgatatgtactaatccaaaaatcaaatttaaattagacctacacatcgagaaaaaaaaagataaattgagatacgaatagtacgctactatttatatattaaatgcatatatcatctgtgtgcaggtgcaacggtgcgccgaggacaagaccgtgctgatcaccacctacgagggcaaccacaaccacca

SEQ ID NO: 5211 - DNA, 5260 bp, Oryza sativa
caaacttcacgacggcgttggcggccgccatctcgtccgtcgtggcgggaggggctcatcatcaggctctgtccaccacaccccgtggcagcgccgccggcgccggagacggcaacggaaacgggagctccgccgcggcagtcgccaccggcgccgcctcgccggcggcgacggccgaggcacctgcggcgtccggatcacctcctcggctcgcgacgcagtcctgcaccacgtcgaattgatcgatcacagagacatacgtgacatatatcatatactagtatgaatcattcatgcgtgcacgcatgcgtgcatgacgcccacacatacttgacatacataccgttttttgttttgagatttgagatcgatacatatacttcttgtattatgtacagtaaaacgtatggagtaaatagtagttactagtagatgaattgattatatacacacagagttactgagaaattaattaatatcactgtcttagtgtctttattaattaggtttatttcattcatattggggaatttcctacaacatgctacaagcattgctgtacggtactgacataaccgactgagatgcaaacgttgtttagtggactgggccagctcagttttcggcccacactacgaacgcaaatatgcgtccaactgatcaaattaattaacatggacgccgttgatttcgatccatgatctcccttaggctttgttggggaacattactacaccagcgggcggacggatggaaggcaccgccgagatcgagacgcgatgaatcctcttctcattttaaagtccaaatataccccccaaacttttggttgaatttcgtctaccaccgtgaactctaaaaccggacatgcaaccccgtaaactttgtcataccatccatattatcctctaagatggttttgtgaattttgaaagcttgaacgaacaattttcaataactaatataacatatttgcatattatcaattacaagtaatcaatttattcgtatacagtgatattataatattattatgttggcatttatttgaaaatgagagctaataaggagaaaaagaaagacttaaatcaaaattttaatatatgtgcctaaagtgtatgacatgtgatcaaactcatctaacttatatacaaattagataaaatcactatgcaaaaccatcttaggggttatataaacggtattgtacgtaaagtttagggggttgaacatctgatttcaaaattcagggtgctagatagacttccatataaagtttaggggttatttggactttttcctttttcaaataaaaccgaccgaaagggagctaggcggccgcaccaaatgctggaagttcaggtctggtcggggttacaaacggcgtccacacctggacgctacaatagccagcatccatcctataattaaaattttcatatatgatttactacatatttgtaattaatgggttattaattatctctaataatataaaaagtacccgttcatcaaacacaatctcttcttccattcgcccagctgaaagttcgttctcctgcgcctgatttgcattcaagagacttcattaccctgtcttgtcaaacccaacctctagccgcacccgtatccaatggcattcactctccacgtctcaaatctcctttctgccctcccttgcccttgcccgcctttacttggcttaactcccctaaacctaccgctcactcctttcaagctactcttcttgcccacccaactcccagtctttttcctcctcgccctcaaccctcgaaaaccaaaaccactcgccccaagcccatgctggatcgctgcttccgttatcctgctcgtgaccactaagtcaagaagtgcagagactcgttgatctgcgctgcttgctgcctctcctggcaccgacaagactcctaccgatcttctgtaggctcaaactccactcccagacaaccaccttccttccccagcctccgctcgtgccacctagcatcctttgccgctcattgggtgcgcaaaacctcctcccagaaaccccacaaaacctcgcttccccactgccccaggggaggaggtagagtatgggaggggagtacccaggaacctcgtcaagaaatatttttagctatacatcacctattttcaccatatgtacacccctctcaatacaaatttagacacccgcatcaacttaaacttgatctaaaatagagtaaatcaagcaagaggcaccctcctccatttcgttctagctccgcccctgcactgccccttaccctagctccaccaaaaccctaatggcggacaaggcagtgactgcatcagatatggcggtgatccctctggaagtggtcattggtctgcttgaagccagcctggcgaggggctccccccccccccccagctactgacggcctgtctgctgctgctagtgcgacggctgaactcacctcggctgtccccatccccgcgccttctactgctaaagccctagcgcgtcggctgatggtttgacggccgatctccccactggctcttcccagctgggggatttgcctgtcgtgcctgcctctctgaccgcctctcagggtctggtcggggaaggggctccgctggccttggtcccggaaagagaccttgtgccctccgcttctcctcctccgctagaacaccagaactcctccacttacaggcgtaaaaacaagggcattctttccattgtgggtgccaacccctctctcctggagcacgtgcctgaggttgcacccccctccccccccccccaggatgtctttgtcctggggagccctagtgcctttcaccccctttctcccccgccacaactactcataactttcggtccctccctccaaagaatgaagccccacctacccccttggccactctgatcggctgtgctctctctggcattcctctgggcacaaagcatccctctcatggctcagatgacgatgagattgagtatgcttcaagggacactcctgggggctctggtcctgcacaagcagaaccccttcttccgacaaatctggcagaagaagatttccaagacgccttcattctgtttgttgacatgcgtatcactgcgcattttgccacggcttacaacaccccggccagtgacactcctgcccggatcatcacgaaaactatggaagcggctcatcctaccgccaccttcaaactggttgcctcctctcggggcaccatggctcttcgctttgccagtcgggctgacagagagactgccgtcttgaaccaggaaggtctagaggtgaacgatcacattgtgatcatggaaaggccaaaggcttctatccaaaattcaatctaattttggaaattccaagggtaggataaaggtgacatacaaaagaaagaactaagatactctcactaaaatataatctaagctaagtggagaaagaataagaaaaaaatccattcatatacttctagtatacaaacatctttagtctatactagctagtatatagtcgtgcaaccaataccccttaacagtgctctcctggtgtttcgagatgaccacccctgattgccgagttccttatgacaacctgttatggttgtccaaccggggctaaatacggaggagtaccctccccagaaaagtgtcttaggagtatatactaacgtggaggaatactcatactgagctgtcaccatcagcgatccgcctactgtcccgcaccatatatgcccaattaatgatatctaataattctggtcaatgatatctaataatctaagcaccaggctcatattattaaatactactctacatccgagctcccgaccttgatggtgatgtaatttcatcattttgctctgaaccaagacaaatgttactttcttattttttgtgaaattagttgttaagaagatttggaagctagagaaaaatatttgtagaacatgttgatgccatttttccaatctaatagtggattagagtttccaccttttgctgatgaactgattaaagttacagtaactggttagagtttccactgcatctcctacagtaaatgattaaagcttctaaattactgatgaactgaactctaaaatatttacctttctcagcatagcagtgtttgggatgcaacaccatgtgaagtgcagttagactgaattttggagataaattactgaggtgctgaactctaattgtgaatgcctttgtactttttgttcttttaaccctgatggatgatgtttgtaagagaagtacatatgcagtgctatttcggtgaccaaggttcagatcaaatcatataaagtaaggctctaaaagtcatataaaatactatgattgttttcctttttctaaaaaaaaaaacccctcaggtttgcattttggattgcatctcaggctactttggctgctgctctaggtaatttgctatcattgctcgttggtctgtgttttgtaatccagtctttaagatttgtaaaggataagatacaatctcaggtaaaagattcatggatgctagccaattttaactgcgtaaattgacatcgacagcggcattgaatcattggcaaattaatagatgattacactgtaatatagattatatatagtagtagataattcatgttgtccttgcacctgcagaatttatttgttataatcaaatgcaaatgggagtattaaatactggaggttgcataaaggactaaccacagtccaaacattcagatatatgttgctgttagattgcgtctctggatttcttcagagtctgaaattttcttaggtgcttgtgccaatcttacatggccttttattgcttctcatattgggaagtatagttctctggtatgccctactcttaaatgttcttttctttgtaatttcaggttgtttttgttctaatggtctctgagaattgattttgcttgactgtgtgccttttgcaatctttatgctctgtaatctcgaaggatacactgttaaattgagttttatgggtctaagtataaatgggctgtttatatagaacgtcaacattattactctgtttgccgctgcataaatttccaggggtcaaaacatccatttagcttttattggcatgaatccaatgattttcagggttcaaaaaataacaccaatttggcgtttatgactgcagagatatgataagttcattttcactgtccttattaaattttcaaatgaatcagcattgat

SEQ ID NO: 5212 - DNA, 3801 bp, Oryza sativa
atcttccttggtaataacaaactgtactaagcctaccatgaaaagttgttacatattgatatctcattcatatattttactaatacctcttagcccactaccgcctctccaaaagaatctgggacgctgtacgtgattggtcactccttcatatccaaccatcggaatgggccaatgttgaaacagtacaagattggtgaattcaaatcacctcagcacaaaacatgccaaagaaagctctcaagttgataattatacttgttgcatgggaattatggaagaaaaggaactcaaggatcttcagtaaccttgcaaacactccggcctccatcatggcaaaaataagagcggaagtgcacaggtggctaatggtgggggcaaagtgcctaacagagctctacccgttatgtgagcagtcctttttactcccttggtctgggatgaccctaactcccatttccttatatctatggattctacttctctatcaatatataaggcaaatttcttgccttccttttcaaaaaatatatatatatattactaatatttcttgattggcatatacatatgtcccgttcgaacagtacggccacgcaaaacgaaaaagtcaatagcgcatgattaaacgatttttaattatttcaaacttattggatttatctaatattttaaagcaacttctaaataaaaaagtattttttaatagtttaaaaaagtgctaatggaagcggaagtaaaatctgtatcttaatcagaaaagaaccaaaccataatgtacatgtttggttggatatttggttttggagatttttcaacatttatatcgctaacatatatatcattttcttttggttgtctgtttttaccaggttcacttcctgatgaccctacacagctactctctccgtcctaaaaaagaccaatcctagcatcccaatgtaaaattagtggggagaaaaaaaatgtccaaaatagctcattattggaaaaagtagtaattgtgataggtaggtgaatggtatttaagggataaaatttctcgttgtatgtgttgagggtaggtaggatggtagaagttggttttttgtgggacaaaattcaatctccaaaagttgggtttttttagacgaaggaagtactatgaataatatgaattatagttctttcattgatgtcttgataaatgtgaattacgactacaatatccaaggctctgcctatatataaaataccgaactctaggtctgatatcttgtatcctattagaccacgtggcaacatatattttcagctaaataccatctagaaatctgccatgtgtcctcatcatggtcacaactcacaaacagttcccaccgaatgtgctagagctattgtgcctaccggtcacatgctgctccctccgtcccaaaaaaagataaactatggattcttgtgctaatgtttgactatccgtcttatatgaaatttttttataattagtatttttatggttgttagatgataaaacatgattaatactttatacgtgacttatcttttttatttttttttataatttttttaaataagacgaacggtcaaacgttggacatgggaatcaggtttgtcttttttttttctttgggactgagggagtactacttgtcttaaagaataccagtgaacagatgatgtgtcttaataaaatgaatagttaaattacttggctcttgggaaatatgaaggggcaactcatttacagggataagctaataaggccatcggtttggaaggtatcaaccagattatgagtatttggaagatattaagatgtaaaattaattcccttcaatccttttccatcatgattaaatgaataaggtctaaagaatactccctccgtttcagtttaataattcccttagcaatgggcatcaagaccaatgatatcaaaacatccatcattctaaaattaatcctcatcgatcaaggtgcactttcgcttcatgtttaaaaaaaattaattcacactttaaatattgcatgagttgaaaaatagaaaataattatggttggctacatgcatacagagcattccacaatgcacatttactctttccacaaataaacaaagagacatttcgaggaaacatcaaaaaccttacatgatgattaaactgtgatagagagaaaacctcaaaaagctatatattagatataacatatcagctcacaccttttcccgcctattataaatctgattatccacattgcttacaaaatttttaataaatcccttttattttatgattgggaataacttctatattagccatttttctggtctcttccatgtaagacgacctttttttaaaaaaaatgcactaatctatactttcttttgctttattataattttttattggatgtagcgtaatttgttcttctcttgatgggcccatggtgggcctgtggccttttttttttccaaacttccatttacccatgcttttaaaaataaacacatttttcaatttgtcgaaaaatttgtatgtttttggtaagaattttgtaaaaccttaaataattcataacttcaaaataagcagtactgcatatagaaaacgagtatatgtggttgcataacttttttgcataaaaaatcatcattaatatatattaaacatatcacaccaatgcaatgggtatactttatttcaagcattaaatggataaatacattaggtgtacctacaagcccatatcatttatattatcatacttgctagcccattgcacggcttttgccgcgtctattttctagtgcttcctttttttttctaaattacacagaaggcttttgccgcgtctattttctagtgcttcctttttttttctaaattacacagaacaacgcagataagtacgtcgtctaccactgaaagcacaacgccgttaaattaaatcctgaaaaattcgttcctatgggaagttgaacccaaaaccacaagtgctactgaggctcttgtaaccactaggttacaggccctttcgtattttctagtgcttcctaatcgcaggatctgagcagaatacttgtatgtaaacttaagcgcagtgcaatattgttatttcaatgtaaacatgtggtctgaggatacacacgttcttaactgattttttttctttttcattttcaaacattgattaagtgaatttttgtttttttttcattcaaagtaaaatatttgctttttctcgcaaatcatctcggccattactgttgttcctattgttgcttgggacattcctaacagcagtattagtattggctgttgattttggtggtggtgcttaatcatgatataaatttatgtcagctaatagtttctagattcgttgtatttggatatgtcacatccaaccaaaatcccttatatttagtgacgggggagtaagtccaagtatatataatactaaatatagaccatactaattaacctattaaaaaacaaattagggtactgaatacgtgtaacatatttgatttaatttatatttcattggcgcgcgttgcacgcgtatgattactatataaaaaaaattcgtttcatagcgtcatctacaaaatctcatccgtcgccgtctccgcgctcgcctggtaatccgtcgtcctcgccgggtcccagccggacaacggcggcgccggtgccaacgccgacgctgacgcgcgcgcgcccctcgtcttcttcgccgactgccgccgtcggctggacccgcccgtcgacccggcctacttcggtaactgcgtcgcca

SEQ ID NO: 5213 - DNA, 703 bp, Oryza sativa
ggtggttgtccagttttagcgtggtcacgacgtgacgttcccacgtttgtctcaagagatttgcggtggggatctacatatttggatgaagatttagttgatcacgccaaaaaatcacagattctgatgagctttttttgtcaaaaaagaaatcacaaattgcattaccagtggtagctccggtgccttcttacggaggatgcgccgcgccatgtcagcggccatggggtgcacgatcgccgaccggtcaaacgccggcgcggggggagatggccggccgcgcgccgccgcggaccacgcgtccatgaaccgccagaagctctggccgtatgccacggcgtggtgcacgcacacgcccaccgagacgccgcccccgcccccgcaaccgacgaagcgcgtcacatgcacggcgagcaccggcgcggggagctcggggacctccaggctgggcacgagccgcaagaacaccaggacgtcgagcctctaggtgggcgtccgtgccggcgtgcaaccgtcgaccaccacctacaagaacgcgaccccgtcggcgacgcggacggcgagtggtcgtgtcgtggtgtaaccacgatcgcttcaaccaattcgcggtggggagctacaaatttaaacggaaattcagttgaacacgtttaaaatcagacgacatgatgaattttagccaaaaatgcacgagcgcacatac

SEQ ID NO: 5214 - DNA, 7512 bp, Oryza sativa
tgtcttattctgcctaacttaacactaatatttgacacactatcaattgttagctattgatatggcagtttgacatcgaccctgctccatcattattactgcatgcccgcccattcgatgattgacttgaccaaacccacaagtgcaaattggaaaattaattaattaattaattagcaagataaatatatccatcagggattcaggatcaggtcatggatgtaatcactctcaaacatagctaatcattgtgcttatggtccaagtgatcattccccctaatcaacaactcgcttgctagcaagacgtcccttcgaatggattatttgatagctagagcatatcaccttgcacttcaccactccccttatgcagagtgtacgtatgtctaaccagaatctagtggtgagcgtaaaagatcaaagtgcccttatcaataacaaaatactccgtaatacatttggtggatatataggtatataagtattaaaggaataaaactttcaaatttgtggattctaataaaaactaatattaattttgataaacctgaattgtagatactctaacttagggtagtagttgaagcatgcaaagctctaaaaatatatatgaatttcggcgtgtttatatatatttctccgtggatataaaagcttaaaatttataatcattttatgatgatcaggtgacggagttcagttgcggagggttcgtggtgggcctgatctcggtgcacacgatggcggacgggctaggggccgggcagttcatcaacgcggtgggcgactacgcccgcgggctggacaggccgagggtgagcccggtctgggcccgcgaggccatcccgagcccgccgaagctgcccccgggcccgccgccggagctgaagatgttccagctccgccacgtcaccgccgacctgagcctggacagcatcaacaaggccaagtccgcctacttcgccgccaccggccaccgctgctccaccttcgacgtcgccatcgcaagacgtggcaggcgcgcacccgcgcgctccgcctcccggaacccacctcccgcgtaaacctctgcttcttcgccaacacccgccacctcatggccggcgccgccgcctggcccgcacccgccgccggcggcaatggcggcaatgggttctacggcaactgcttctacccggtgtcggtggtggcggaaagcggggcggtggaggcggcggacgtggccggggtggtggggatgatacgggaggcgaaggcgaggctgccggcggacttcgcgcggtgggcggtggccgacttcagggaggatccgtacgagctgagcttcacgtacgattccctgttcgtctccgactggacgcggctggggttcctggaggcggactacgggtgggggccgccgtcgcacgtcatacccttcgcgtactacccgttcatggccgtcgccatcatcggcgcgccgccggtgcccaagaccggcgcccggatcatgacgcagtgcgtcgaggacgaccacctgccggcgttcaaggaggagatcaaggccttcgacaagtaaaatgcttgtgaaatgtgaactttgttattgttactacttctatgggctcgttgctcaatgggcttttttttgcttttgttttgtgtgtgtgggccgacacgattggtcaaaagggatttggtggaggcccagttgtaataagatggtccacgcatcatggattaatcgttaattgtaaggtagtactacacggatttgttaacaaggaataagttcacttggtgacccagtgatcggaatctaattcatctaaaccgcaaaaccggatatctcgaccctcaaattattgaaaccggtgcaatttgactccctcggcggttttggagggcggtttcgctgacgtggcgctgatgtggcggtattgacctagtatgtgtgctgacgtggcgcttaggtggcatttcaattaaaaagatttacgtgggacccttttgtcatttacacacgcagttgaggggtccactgacatgtggcccccacatgccatctcatccttttcttcttcctcctctcctcccttctatctttctttctccctctcccctacggccgtccgcggggagcgagcggcggcgggcgagggctgaagcaatggcggccagcgggagtttaagcggcggcggcagcggtaggctagagtccatgtcgcgccgctcgccgttcctctcgcaccaccaccatccgcaccacccgacggccggcatcgagatgtcgtcggcggccgagctcccctcaaaacccgagagatgttccgggtgtcgcggcggctggcggagactgcggcgagcggcggcggctgcacggagtcccgagcggcggaggcgcaggtgtggagcggcagccggcgagcggcgcggcggagacgcggatgtggcgacggcgacctgcaggtcgagcagggcgcggccgagctcgccgtaccccgccgcgtgtacctcccaccgccaccgttgtggtctccttcgtcttcgcggcggtgaagctcagctcgggcgccgccgccgcccgcaggcgatcagctacgccgtccgctccggccgcctcgacgggcacgcgctgctcctccttctcgcagcggatattataccccacggtgaacgacactatggacacgcagtatggcgacgagctccaagccgtgtgcctgccggacgcggaggagacggcgtgggcgcacctggaccacggctcgccgggaaggtgctggctattcaacttggatcactgggcgctgatcagcgaagcggcgacgaggcagatggtcgaggacaacgcggtgaaccagtcagccctttgcttgttggcttgccgcttgacgttagtacacacatgcagatgcctcccaacacgcgtgtggtcacgtcgttgtcggccggctcggcacgccgaccgcgtccatcggcggcggcgccgcctcccccgcctgcgccactcctcccgccttcaacgccgccgccgccgcaggtgcagaagaagccaccaccagatgccgccatcttcgaggggatgccgacgcgagtcgcggtggcgagacgtaggcggcccttacacgttcgtgggcgcggcgggagaacagcggaggcgggtgcatcgtggccggcagagagggcgtggagcacagtggaggatagtgcggtcgcggggccgagggtggcgaggacgcgaccgttctgatggcccgttttcttccttccgacggccaaccttccacggcggtctcgatctccgccgccaccgctccggccctcgcccgcacgccaccgtcgccgctctcgggtctccgccgccactggcccccgtcccacactcgcggagagaaagagagagggatatgatttatgtgggccccacatgtcagtgggtcccacccatacttttggtgaatgaaaaatgggtcccacgtatattttttatttctaatgccacctaagcgccacgtcaacgccacatggacagaagaccaagtcaatactgccacgtaggtgccacgtcagcgaaaccgccctccaaaaccaccaagggagtcaaattgcaccggttttaagagttggggggtcgagatatccagttttgtggtttaggaacacggattagatttcgatcacttttgagggtcacgaagtgaacttattccaaacaagaatatcttatcatccttttgtggctcacggtgaaataatgggccgcctatgaggcccaaaaaagattaggcaggttaatggactggaataagttccccggctcccctcccctctccctctccactctcggatcttcctctacctctcaactctcccccgtcctcacggcggagcggcgacctcgccaaggacgccgcgcgcacctccgacgcgagaggagcggcagcgcgcgccggccaacgggagggagggagaggagcggcagtgcgtttgggtcggcgaccggcgggagggcgagagagaaacggcggtgcgcggctgccggcgggagagggttggcggcgcaagctggccgatgggtgggcgggagagaagcggcagcacacgccgcgccggcggagaggacggccgacgggagggcggaagagagggccgccgagcgccgcctccctcctcgcccggccgccgcgagcggcccctcctctcacccgggcaccacgcgccgctcatcccaccgccccccctttgcgccgccgcaagctgccccttgtcgcccggccgctgcacccaccgcccaccctctgcgccgccgctcgccattctataagggagggagagggggctgacatgtgggaccacatgggccccaccttttcttataattttttgtgtagctgacatgtgggtcccacgtttttttattatttttccgggattcatttgccacgtcaatgccacgttggacgaggacctagtcaaagaaagccacgtaggcgccatgtcatccaaaaccgcgcaaaatactgccgagggacccttttttttttgtacggttttgtaagttgggggacccgtcatacccggttttgcgaccgagggacgaaagtcggactgggcgacaaatagagggacctaatggactcgatgctatagcccagtattaaataagccttggctctggcccacgtggaaagggctagattgtaagctgggtaagatgaaccgtggcccgtgggcctggattgtgcatagctacggttacttaacttggcccggaacaaaagtggagattacaccacaaaattaatacataggactcttttggttttggaggggtgatgatgggtgagaggatgcatgattatttttcttataatattcttatacgaaatgttgtcattcttacaaagagggagatctttgcaaaaacaggagatgtacaagctgcaaagtatggtgtgataacaagacgtatattgatgcatgaatatgggaagccaagtggtaggctagagatttaccgttgtctcttagacagaatttatgcctggtcgtagtcgtgggcgtgtgagtgtgctgtgtacacatatgcgtcgctttctacgtaatcagaaaatatataagtatatacccaactgaagtcatgtagacatacgtgagcagcagcagcagcaacgctagcaatacaccattcagtataagccattgggcccaagcagagcaacaagattatcagttagcagcccaatcatagcagaagccagcagcgcgcaggagctgcatcagtagctagctagtagcccagcagcccagatgaactttgatgctttgggaacttattagaatatccgaatatattcttcccagattattatcgatcggctcaaaatatcagatagttagggcagatgtttggaggtatctatatctgtatccaacaagggatcccatccaacaactactccgcccgttatgcatattataggttattttgtgtttattctaagtaaatttctttaaattaaatcaagtttattgtatgaaaaacgtagccacatttataacatcaaattagtttcattaaagtcatcatgaatatatatttttataatatatttgttttgtgttgaagtggtgagctctctcgcttggcaacacgtacccatcgccgacaccaagccctctcctcctctcagccatgcctcatcgaaaggcccaccaaaccacaaagacgaaaacacaattttgtctggacggatgggcgggggcagtgtgcttgacattgtgctgtttttggtgatgtcgccattaacattctttcgtgtgtttgtttggctaccaactgactaattttagtcagattgatggatcgaacagtcacttcgggccttgtttagcaagggatggtcgcaagagtttgggctttttgaaggtcgtcttcggatgggttttttgcgcggcagggataaccaggtagtagaagaccgttctttagtattacatttcttgcaacaaagtttgtttctaacactaatacaaaatcacaaataggggacatactcaaacgtgacagttcatacagcacatacgaggctttttccatcattccgatcctcaagcaggcctaaaatagaaaaatggcactaacaataagtgtcgtcccccgcaaaaaaaaataagtgtcgtcgtttttttaataaacatgcatgtatactttgagatactaggtgaaactccgcgtgttgctgcgggagttcaatatgataacaataagtaaaaataatgtgtaatatagctaaacaacataaacttacataagcactaaaatcaattaatgtgatatggcttaattagaaaagagagaaatatcattaaccaagtgaggatgaacttacataggtacataagatatataaaaaataatgaagatatgtattgaaatattatgttaattatgtgggatgatgatttaacatgctttcattttaaaagctctaaaatgtaatatattttaaattatagataatatagcatgtttgcatgtgatattaaatgtattgattgttagtggatgataatgtgtcaacttgttagtggatgatgatgtggcatctttgtatgttaagctttaggagttagtgggttataactttatagtaagataggataagtgccctttttttttaaaaaaaaaatacttttagtgggagctaagccaagccgatgccaatgtcaagcgtgcgtgaagtaggcgtccttatcctcccatagcgtccttatcccctcggtcactccatctccttagctctgcatcttccgtctctgttcatcttctcggcatggcatggcgcgtcagcggctacctcttcctctcctcagccttgcgtggcggccactagattcagctagcacgaactcgaggacgatcatttccggccaccacaagctcgggacaacaaaatccatgtgcggctgcctcttcctctcccttgcgtcgcgtggtggcatccgcctcatcttctccccgacacggcggcgacaatggcctcttcctctcctcggaccagcacgatggtcatcagatccagctagcatgactccatggcggagatcaggtagacttctaattggagtgatggaactattcatttgtgccaaaatttgtaatcaatttatgtgaattgtgatgtatgattctttattttggtgggggtgttcttgttggatggattgatggtgatttgtgttgtgtgatttgtgcggggatattgttgttggatggatcaatgatgctatgtggataaatcatgaaggtgttcttcaatgtggcatggtctgtgggtgctaagtttttctttttattcatggaaccttaaatgtatcggtttcagaatcgacacctttaattttacctcatcagtaccacctaagaggtgttgatggaaaatttggtacttatgtggggttcccaactgacacctattattgttctgtagtagtgtaaataggcgagtgatatgcttgatgaact

SEQ ID NO: 5215 - DNA, 19640 bp, Oryza sativa
  unsure (1)..(19640): unsure at all n locations
aatatccaacctgtttacattccttgcactattggtgaaagctatataggagtacatgtaagtggctagacgcactaaggatattgacgtcgaatttggtatcaaatccagttactttgcacacgtccatatgcatcaacaaattagctactagcattttccactagacaatctatgggcgtggaaatgtggaatcgatcagcatgatcaagactagacaggacagacgaaaacgacctgcacgatgctgctcacaacgacaattgatcgtgttaatcgcgtccattgtcgatttatcgatttgcttggtttcccccatcttgctacaatgcaacacggacagcaagtcagcatccggtgtgtttcattttttgttgctgaagttttcagcatgacgtaccaaaccaaatgaatgaaaagatgatcatcaccattctgatctagcttgagttgctcagaagcaacaatcaatcgtacgtacgtgtatgcatggaatggaacgcaactactcgtcggacactgattgccctgatcgatcggcatgcatatattcatggctttttttttctgttgcgcatgctagcttgattatattggtccacactaaaggtcgctagctgcatttgcatgcaaccaaccaccctgcatatatccaagctacatgtgtgtactgtacctaaagcagagcagagaaactgaaaaaagggaaaaagagaggacatatgcatatatcatcagggagaggaagaaagaaaagcaatgctaacatatctcaaatcattagagagtggtaggtagattattattcactcacagtcccagttcgccattttctcccccacaaaagtctagctcttgggctgactactaacagcacaaagtttgcagctagctcaagtcgtaatcacacattcacaacgctattagaactagctagggtcgccaatctcattcagattaatggctttcgcctacctacatgaatagcactagctccagggttcagacgattcagcggctgatacagctaggtcaatgctgagcagtgacagttttgttcttggcctcaaaaagcagctccaactttattgactactaaattaaaacgcgaacacaaaatggcgatatatatgacagtctagagacaacagtgacactaattttggtaggtataggtcaccgatccggccatgtcgcgctcgcaacaggaaaattcgtgtggattatgtcgctgaacgaagaccggcgatttgttggttggatttttttgaacgatttgttggttggattttggattggatggtgtgatttggagatgcagtcattcaaaagtctgaggcttttcagtttgtaatctctcggtcagtaggtaagcaagccatggtgttagtgaccaatcgatccctgccaaattgatggaatctcgttttcagtttactgagccgaagcaagtaggagtaggagtggcagtggcaggttgtctatgcgtgtgggtttatatgatttgaagctgtcatacagtgaaatttcagtcacagtagaactttcaggtttagtggatcgaagcctgacagtttcaataggctcagcatgttgacgatattttttttaagaaaaaataaagataagtttagaagacttgaagaagacctaatactggatttcagaaaagttggatcggttttccgtaagttttaaaacaatgaaatctcaggaagcataacaatgaaacgtgagatttagtaaaaaaaaaacaagagagtagctatatttatggcgccatatttttcaccaaaaaatagtcggttttacattgtaagtttacaaattacattgtaattttagtgtatttacattgtaagtctcaaacttacatacgtaagtcccaaaaatacatatataattttagtctatttacaatgtaaatctcaaaattacatatgtaagttccgaaattatatatgtaattaatatataatcatcactcatcatgatgtatgatgtatgtgatgtatgtgtggaaataatcttcaacctcacagaagcatagttgggaggcctcaagcccgtgcggttgtgaggcatagcgcataaacatgtaaaccgactgtaatcaatggaattttatggtgccagaaatttagcaaatccgaaaaacaatgaaacgtgagcaaaacatatagtatgcttcgtgtacttaactgttggaggtcacctcactccgtccgacgttcgtccatatcgtgggtcgtgttggatgctgaaaatgattactactacatcgatccctcttaaaatataaatattttttattgtacatggatattaagaaagtaaatggaatgattgggaaaggttatgattcgtcacgcacatccaagtccatgcttttggacacgtcgtctccaattgcattaatacaatgggacgttgtaatagaatctggagttaacgcaatggacagacccatttcttttgccattccatttctcttgctgatcaaggaggtcgtgttcaattatcagattggatcgtggtgtgatttcctctgtctgcttcacgtagtttcaagcctagaccatgctatctccctatggataccgtgtcctctgtaggacacccctgcaagacacaacccctctctctgctccactcgaactcgctttcgacatgttgccatgaaaccacacgatagcgacatagcgtggaccatggttcatgcttaaacggctagagcatattcaatctgattgtggcatatgtcatgtgcacgtaaatatgattgcagacatatatcacttctacagaaacgatttttctgtacgagaacctctttagattgtaggcagatcgtaactgatcgcgtctgtaaaaatcaacctccattttcccatacggctccttgagagttccacatgaaaaaaaaaatctatttttgtaagcggacctcttaaggggccgtatacaaaaataagcatattttcgcatacgagctatttaagtaatccacatgtgaaaatacccctctcctgcacaaattttttttctccccaacactctcttttccctctcaatacttcaaattttatcatccttatctcctcttcctcccctctcctcatattaatttcttctctcatttctctcttcctcccctccaagcgggagcgggcggcggctggctcggtgacctcgggcggcactaccgccacagccaacgaggagcgacctcgtccctgcccggctctgccaccgccgatgacgatgaggaggcggccaggagtggctccatccccgtccacgcctggtgctgccaccaacgacgacgaggaggaggaggaggcggccaggagcggcgccacctctgctgacaataaggcagcccgatccgtcgccgccgccatcggtgagctagggttacgattttttttattttattttattttttgagatttttcttttggatttttgtttttgtgtgcaacgacataagcactcccgcataaaaaaatcgctagtaccgcataccttttcggcagataggctgcccaaccacatataaaaataggttttgatcggaaaatgcttttttcagtagttatatgcttccgttgcgagctcatggtgagtttggcaaagcccaagcgtagagtgtgttagcacacaaagttgcatgggttttatcatcaattcaagtcgttttcgttccatttaggcaatccaaatatattcatgcatgttttcggtcgcttttcacagtcttgctagtttagcttgctcaaaacaatggcacaccgtatatatgcgatcgagtcaatgaagtcgcacatcgtatcatggcccacttttaagtggattattaatattagtgtagtgaattatctacactattatagatatataaattaaatactactttaataaataaactaaataaataagtttgaaccaaaaatctaataagcaatacagtagaagaagagatttgcttttaataacatatatttaccggattttacaaataatccgcgacaataatcaatctgtccaaatgtataaattgttaaaagatcgaccgatcgatcacacgattaaagtgcgagagagctttaggcgttgtcctcccttgttccggttgccacaatccatggaagccatggctggaagtatctccagtgacgatcttccacaggatggttttcggattatctacagatgccttcaactgggagtggggcagttatatgcgacaagaggttgcgccggccattggcttcatctccggcgacctaatcgcagggctactgatctccttccatgtcttcggtggtggttcttcaaggggcagctaagttttcctggtttcactaaggtaacctcaacctccaaccaagagggcccttttggatatgcatcttggtatcttacagcactgatttcttcatcactggtgctgttgtcatcaatctgatctccagccatgagcaagaagcatagggcctcaacttttcacttatgcttatacttatcagccaaaatttgaatttttcaacctaaaatttggatttgattttggggtttttttcatcaaagtttatttttcagcttttatttttaggtcgctaaaaacacgtatataaaagttttattcgctaaatgacggggccaaaagagaaggacgggattgcttttttttttttactttttattataggagtcctactttattactttcaatacttaatgcaatttgcccatcttgaaggggactctttgtaaaactgcctgttcttgcagttggttatgaatagtactcctacacctcaggttgtgttaaaaaaaacaagaagaagaagaagaccacgcgatgtcagtacgagatccgttcttagtctgaactctgaacggagtaagaattctaagccatcaacgtctcagcattcagcaattgcagctttgcaagccgccgttgcgtgatgaactcgtccgttccgtatggggaacatgtactgtatagtactcacctactaccaacgaacgcatggcccccatgccaatcagaatctcaaaatctggtgaaatcattggagacgaaagttctggactaataaatcgctgactacgaccaacgtgctccgagactcggaatagagtccagttgaatcattagacctctgtttaaatcaactctaaaatttttcaccatgtcatatcgaacgtttgaacacatgtatgaagtattaaatataggctaaaaaataattaattgtacagattgcgactaatttacgagatgaatcttttaaacctaattgcttcatgatttgacagtgtggtgctacagtaaacatttgctaatgatggattaattaggcttaataaattcgtctcgctgtttactgacggattttataattagttattttattagtgcccgagcaccctatgcggcaccctacatgtgacacgccaaaactttacatcccagaatctaaactagttctattagtagtatgggaaattttactacaggaaattgtgacttcgtggttttagctgcagggcatcgcacgaagtgacttttgggggaatacactctataaatgtggtaatttgcacccattaaaataataattttccgttaaagaagagagagaaatcgcgtcaaatgtcagaaatacccacatgtcaggtctcccatctctcttctctctctgtctcctccttccacaccgcgccaagaccgacaccgccgcagtgttcactgtggaaggcatcggtgtacatcctgggcgcggcgggtagcaatatcgtgttcatggcggtgctaagcgatagcgtcgtgctggcggtgcacaggatcaacagtgacggcaccggcgcgagtcggtttagcgagttcaacgcccagatgagcgccnnnnnnnnnnnnnnnnnnnnnncagctccatgttgcctccgcccgaaccaagcacgtggtaagcctccccatagtccataggccctcccttctcctttcatcgagccgccatccaccatagccatatcaccaccgccatcccgaacccacttccaccgctggcccatggcactcgctgcctctagccatcctcggccgcgtcgccgcctctagaaggtgcgggacgacccactctatctgtcctggccttcggccgagccaccccctccaccacccgtcaccggtgggctcgtgccgagtcgtcacgcttgctcaccttccatctctcggttggaaggaagaagaaagggacctttttgtaaaaagcgtaaatcccagggttcctaatacaaatgaccgaaacacttactcgtgggaccctagacttatatgcaaataaagaaacaattagggttcgagttataaattgcgatgggtaggagagaaaagagatgagagcgctgacatgtgggtccaggggtatttatgacagttcacgtgattttcccctcccttttaccggaaattattattttaatgggtgcggtatccactagcaaattacaacgtttatagagtgtcttccccaaaagtcacttcgtacggtgtcctacagttaaaaccgcgaagtcacaatatctggtagcaaaacttgcctagtagtatctatctcctttagagacgccggctgatcgacacaagagttctttttttttcatcttgagctacactggccagggccggcctttgggtattgaagatgggaagaacaaaggatggcatgatcgattggtgtgtgtactggtttttacaaattaggtcctatttagtattgtcggagatatgggcccgggggtgtgcggagtgagggaaatttaccttcccatcctgccgcgtggccctacagcttgaccctacccccgcaccttgtggatcgcagaagtagccgaggggcctcgaggtgccacatcatgcccctcgggccctcgcgacgttttgccccgaggcccccgcccggctgccatgtggcgggaggagcaagcggggaagggacccaggctgtaccgctttcaatgcgtgcgacgccccaactgcccctcgccgcattaaatgcggtaggggcagacgtgcggtgccgtccgactgacgcgcgtcagtcaggaatgactggtctgtgaccggcctgtcgtcggtcgcatctgactggacgggcgaccatgccctcacgtcgcctttgttcccggcggagtggaggtaggtatgacccgtcccatcagagcatgattcggagctccctctacgagaaggacggtcgccacaagtcttcacacatttatgagggaatgacaggactgtcccccgtgtcaggcgggagacggcgttgggtctcactcaaggacgagctgcggcttagcttccagacgaaggcacggatcgaggtctagtcaaggtagggtgggtaccccacccggtagaagagtaggtagaggcggtgcatgtggtatccccttgagctataaaaggaggatcttgcccaccgagaaagaggatgactccaagcagacctaagctctagggaaaaagagacgagagcattctccggagcttagggacccttgtaacactcaaccataatccctcacataggagtagggtattacgctccatagcggcccgaacctgtataatcctctcgtctacacacaactagtaacgttcagggcagatactcgatctctaggggcgagccctttcccccggccgaactcacaaaaggggatctcacgatctcccgctagagaggttcactcctcgacagctggcgcgccaggtagggggaaatcgcgcgcttccaagggaggtcgtttccttccgccccaagttttcctccgccttcgacgatcatggtcgaggttttggaggaagaggtgctggtgcacacccccgctccctctaggagtgaagatgctagcgggagtcgcagcccccgtcaccgctgccgcaactctcggactccgccccgctgtgaccccctgcggagagaggatcccacccgatagggtggcttggccctctccccgcctccagacggggggcggccgcggctcgtcggagcgcgccgccgcctgacatatggcgacagcggctcgccccgaggtgcgcttcaggtggcaggagcccttctacggcatcctccggtgaacgcagagccggaggcgtccaacgatggttggacgacgtcgccaacctggtcaccactgctcagcggcagctggctgcgggtggccgttccaccgccactggtacgtcacgtacctccaccgccctctcatcggcaaggaggagggcccgtcggacggccccaacgtcatcaggggcctcgggaagtcagaggcatcacgatggcctctacgtggagcaggacgctcgaatcaacatcgagtgtcgccgggacaagcgccgcgctgcccgcatgggagaaggcgcctcctcgtctggagtgccgcgttcctcctcgcgaggcggccctcccctcacatccacccctagagggactggttgcagggccttcgtggcgagtctccggaatttccggtggccctcgaagtttcgccccaatctcacggagaagtatgatggcagcatcaatccctccgagttcctccagatctataccacgatcatcgtggcggcggggggggggggggaggggaagagaccgggtcatggcaaattatttccccatggcccttaaggatcaggcgcgtggctggctcatgacccagccccccgactccatccactcttgggaggacctgtgccaatagttcgttacaaacttccagggcacataaccccgcccaaggaaggaggcggacctgcatgctgtgcagcggaagcacgatgagtccctccgctcgtatatacagcgcttctaccaggtccgcaacactattccgtgcattccggcccacacggtcgtttatgcattccggaacggcgtgcagcacaactgcatgctagagaagatcgccaccaaggtgcccaagaccaccgccgagctcttcgagctggcagacaaggtggctcggaaggaggaggcgtgggcctggaactcccccaccaccggtgcggcggctgcggctgcccccgaatctacttcccgctccaagcggcgggataggaggggcaaacggaagccggcccgctccgatgacgagagccacgtccttgcggctccgcgcaagaagaaaaccactgggaacaagccgagctccaccgctccctctagtgagggtcggtcggcggacaagtagtgctcggtgcataacacttatcggcatagcctcgccaactgtcgctcggtcaagaacttagccgattggtttcggaaaaccgatgagaagcggcaaagtcgacaggagggcaaagcccccgcgacccctgccaatgaccggcgaggagaggccaagaagaagcccccgccgatgacggcgacagtagcgaggatctggaattccagatacctcaggaaactgtcgccacactcgacggggggggggggggggggcttgcgctcacacctcccgccgcagtttcaaggccatgaggcgcgagcttctggccgtcgtcccaactcatgagcggcatggaacgcgcgctggtcggaggtgaagctcaccttcgatcagagcgaccatccgacagtgctcgctcggggtgggaagttggccctcgtggtctccccggccatccacaacgtcaggatgaagcgcgtcctgatcgacgggggggccagcctgagcatcatctccccggctgcctttgacgcactcaaggccccggggatgaagctccagccgtctctgccaatcatcggtgtgaccccggggcacacgtggcctctgggtcatgttgaactcccggtgaccttcagcgactccaacttccgcaccgagcggatcgacttcgatgtggcggacctcaatctgccctacaacgcgatcctgggcaggcccgtgttggtaaagttcatggccgccacccactacgcctacctccagatgaagatgcagggccctagtggccccatcaccgtctttggcgacgtcaaggtcgccctcgcctatgcggagcagcgtgccgacagcctggcggcaagtacagagccacaggccccggaagcctccgcgccccgcgcttccaagaagcgcctcacctcggccgacgaggtgcccgtcaaggagatcccccttagcgatgatccgtccaagaccgccaagattggcggtacattggacgccaaataggaaagctcgctcgtctccttcctgcgggcaaactccgacgtcttcgtgtggaagccgtcggatatgcccggggtcccagcgaggtgatcgagcaccgcctcgcagtgcggccagatgcacgacccatccgacagaaagtacggcgctaagccccagagcggcaagccttcattcgagaggtgacgcggctcctggaggccggcttcatccgagaagtcatccacccagagtggctggcaaacccggtggtcgttccgaaggccaacggcaagctccggatgtgcatcaactacacggacctcaacaaggcatgccctaaggatcccttccctttaccacgcatagatcagatagtcgactctactgcagggtgcgacattttgtgtttcttggatgcctactctgggaatcaccagatccgcatggttagggaagatgaggaaaaaactgctttcattacgcctgtaggcaccttttgttatacaactatgccttttggtctcaaaaacgcaggtcctacttttcagcgcatgactcgcattaccttgagtaatcaaatagggtgtaatgtagaggcgtatgtcgatgatctggtggtaaagacgcgccaccaggacacattgttgcaggacttggctgaaactttcgacagtcttaggtctacgcgcatgaaactgaaccccgaaaagtgtgtgttcggcgtgccggtgggcaaactcctcgattttctagtctcatcctgaggcatagaagctaatcccgagaaaatacgtgcgatagagaggatgcgcccccccagcaaactcagggatgtgcagtgcgtcacgggatgcatggccaccctaagtcgattcacatcgaggctgggagagagggcgttgcccctgttcaaactcctcaagcgtcctgggccgtttgtgtggacggaggaagcggagcaagctctcaatcagctgaaagtttacctcacctccccccatcctagtagccccggggcccgacgaaccgttgctgctctacttgggccgcgacccccccacgcggtgagtaccgcccttgtagttgagcgcggcgagggtgacccgcttcgtgaacccggccatgggaaggaaccaggggtccccttaactggtgatggcccctcgtccccccacggctcggagcccaaagcccccaacccccgagagggcccctaggcccccgtgggaggaagagaggctctgacggatggccccaaggcctataacccagagatggcccgagatccccccgaggcccctgagcatgggcgccccgggccaacagcccctgacaacaaggaccggccccatcgaaaggtgcagcggcccgtctactttgtcagcgaggcactccgagacgcgaaaacccgatatccacaggcacaaaagatgctttacgcagtcttaatggcctcaaggaaattgtgccattacttccaagcgcaccgggtttcagtcgtgacatcttaccctctcggtcaaatcttgcacaaccgagagggcaccggtcgggtcgtaaagtgggccatcgagctcgctgaattcgacctgcacttcgaaccacggcacgcgatcaaaagccaggttctggctgacttcatcgcggagtggacgccggtggacgaccctgttctgtccaatcttccctccctccccggaggcggaggagacccgaacgccgacattcgcgccgggcactgggttatgcactttgacgactccctcaacctccatggtgcgggggccagagtcacgctgacttcaccaaccggggatgtcctcaagtacgttgttcggctcaatttccgagccacgaacaatatggcggaatatgaaggactcctcgcgggattgagggcggggccggaaagggcatccgccgcctcctagtcctaggcgattcccagttggtcgtaaatcaggtctccaaggagtaccagtgcaccgacccgcaaatggatgcatacgtctacgaagtgcgacgcatggaacgccacttcgacggactcgagctccggcacgtgccccgacgcgacaacgctatcgctgacgagttgtcgcgtatcgcgtcgacacgagccccactcccttcagggaccttcgaggaaaggcttgcgcagccgtcggcgaggttggaccccccgagggaacccggctccacggcctcggccccgacccctgacgacccgcgggcctcggggcccgagggggtcgatcccaacccccctcgtcaggtcgcctggatgtctgacatccaggcatatctcgacaataatactcttcctgaggatcgcgcagaaactgagaagcttgcgtgtatctctaagcggtacgtgctcgtagaagggaccctctaccggcgggccgccaacgggatacttttgaagtgtatttctcgggaacaaggtatcgagcccattgctcacgctcatgagggtgagtgtggggcccattcggcctcacggacattggtcggtaaagccttctgtcaaggtttttactggccaaccgcgttgcaagacgcccaggaatgggttcggcgatgcaaggcgtgccagttccacgccaagcaaacccaccagccagcccaagccttacaggtcatcccgctctcttggcctttcgcattctgggggctagacatcctcgaacccttcaaagcggctcgaggcgggtatcagcacctgtatgtcgccatcgataagttcaccaagtggcctgaggcttaccggtcgtcaagatcgacaagcattctgccctcaagttcatcaggggcatcacgtcccggttcggggtgcccaaccgtatcattacggataatggcacccagttcaccagtgagctgttcggcgactattgcgacgacatgggcatcaagttatacttcgcctcgcctgcccaccccaagagcaacggccaggtcgagcaagccaacgcagaaatcctcaaaggactcaagactaagacgtacaacgtcctgaagaagcatggggatttgtggctcgaggagttgccgccgcgagcagtcgcgcttagggctgagcaagctctcaccaatgtgggaaggaccatacaaagtgatcggcgttccccagccgggctccgttcggctaaccacggaggatggcacggagttgcctaacccctggaatatcgaacacctccgccgcttctatctatagcgacgcaattttttgctttctaggagctcgggccaacccccgcacaacccctcggtttgtgcgggcttggccgggggctaccactgtcaattactttgtaactttttccctttccaagcaataatttttttccgcttaagcggaggccgttgcacgccttttcttactctttcctatggcacgtcctggtccaaaggatgattcatgtttgctccgagccctacgtggcgttgggtgatccgaaaaccgccgaaagggagtccaaacgcgggccgtgccccgggctgcggcgaaccctgggggctcagaagggcctacacacggtcatccccgacctccggtcgtcgcagccttggtctggccagacccgctgggcggctccctcggggtaacgatcttacccctcgccacctaggtcccgcggaccgaacgcaaatttcccttttcaccagaacgagcccgaagggggggtacaaagatggtaagaacggcgacccaatcacagggaagctaactggatatatccgcctttgtttttttttcttcttttcttgccgcaggcattcaaaggagaaagcaagagtgcaaaacatgcgaaggggaggctttatttacaaacagggtggtgcaatggccgaaagattagaagcgttcactgcgagcacataacaaaataagagaagaaaagcagggatagtcacggagttcccaagcccccgaggccggcgccgctgaccacatcgtcccagtcgtcgctgccaccgccttcacttccgctctcctcgtccgaggtacccgaaggtgaaccgaggggccgatccctcgaagctggagatgatcgcgtcggccgcctcccggacctgctcccaagccctcgcctcggtccctggggggaaatcctcaagcgcacgccatgggactaagtcggggtcacgggcttggtggcttgcgagaactaattccaccgcagccctcggaatcgcccccgggaggggcactgccgctgacgctccccgcggccggttgtacctcggctgtggcggattcagagccggacccggcgtgtggcccgtgggccccgccaggatgctgcgaggactccatggcatctgatcagccgggaccaagccgatccgatcgctcggatttcaacccctgtgagggatcggacgtcgagaccccctgggatggaatctcactacaggagagccccgatcaagttaaaaaaaagagagaaagagaaagagaaaaaaacaggaaaccgaagtggatgaagagcaccgggttggatgctggcaatcgaacctgcgagggggccgtttgaaggtccactttgggggctcgatgaaactcccccggcacggctccgtttgccctatcttccggagccgcttcttcttccgtccgaccccggacgcggcagggcatttgtggcccgccggtggtcggtccgccgttcgctcggcgccccctccatgcggtggagaaggcggcccaaactcggacatttttcgcttccctttcgggtcgctggccgaatctcccccgggcccacgattaggaccgggcgccctggagccgtcgcccccgctggagccgccattccgaccgccacctgcggtcgcaccactgctgcccgtgccatcgccaccaccgccagcgccgctccggcgggaccgacccctgccagcgccgacgaccgtcatcacggccaggatactctcccggtcgcggtcgctgcagaggggaggatcccatctggaatcagtgtttgctcggcgatgtccagacccagcactcgccagatcaccatcttcgcgccctcctcgccctagtcccagcgctcacccacatgggtgcgcatgggatcgttgggcccagtgtactcccatgcgccacgggaccgctcctggaggggtgcgatgcggcaatggaagtagtcaccaaaaaccatcgcccccgttaggccctggtttcgcagacccctgaggcggtcccgcactgcgtcgtactcctcgcctagatccgaaaccgccaaccatgcggtggatcgctcggaagggccagtagggagccgaagtcacggatggtccggcagcacagtatagaaccaatccttcttccaatcctcccacttcttgcggaggtggctctcgatgtattgccccgccgtccctggccggggctagagatagcatccacccaccaccgcaccctgctacagctatgggacgaagaagtgctggaacagccgcattgtcggccgcaccccgatgaacatctcgcacaaatgaacgaagatggccaacgtcattacggcgttgggtgcgagatgcaaggcatggatctcgtagaaatccaaaacctcatggaagaacctggagaatggcgggatcaaccctgccatggcaaaggacaggaggtgcacggatcgctctgggtaccgcggccgcggccgcgactcccccgccctcacggcagtgtcctccggcatgatcttgcgggggaggctaaggtgcctctccgccgtgatgcgcgacgccgggagcacagcgtcaccagcgtcttgggcgatgatgactggtgatgaggagctcggtgtgcggagtagcgaggagcggcaagagtgttagggcttggggagcgagtgtgcgagtgagcagtcggcgagaggaagtaggcaaaatttccacctcctatccttttatccctgcctcacccgcgcttgcctcctcgtttcacgcccccactattgcccccacgattctcgcgcatgtggttgcctcatcgtttcctgcatccactcatcacgtcgcccactgaatccgcgccccgcgtttagtgcgcctgtcagcggcacactcggcgcagggcgtgcaatgttcacgggtgcaaactaggcaggctcgccgtcagttccatcgcgtgcaaggcgggcgagggagtcgaggcgtggtcttgccgaccccccgattttcgcgccccaagcgcccccgtcgtcagcgcggttagtggcggtcaaatcgccattatggctaatgcaccagcctgacagctcggcggcatctgtttagattccccaccgggcccacaaccacagcttgggaagtcgtgaggcgccacgtcagactgtcctcaaggggccaatgcccgacgtggtgtcgggggctactgtcagagatatgggcccggggtatgcggagtgaggggaatttaccttcccatcctaccgcgtggccctacggcttgacctacccccgcacctcgtggatcgcagaagtagccggggggcctcggggtgccacgtcatgccccttgggccctcgcgacgttttgccccgaggcccccgcccggctgcaatgtggcgggaggagcaagcagggaagggacccaggctgtaccgctttcaatgcgtgcgacgccccaactgcccctcgccgcattaaatgcggtaggggcagacgtgcggtgccacccgactgacgcgcgtcagtcaggaatgaccggtctgtgaccggcctgtcgccggtcgcatctgactggacgggcgaccatgccctcacgtcgcttctgttcccggcggagtggaggtaggtatgacccgtcccgtcagagcatgattcggagctccctccacgagaaggacggtcgtcacaagtcttcacccatttatgagggaatgacaggactgtcccctgtatcagccggggacaagcgctgggtcccactcaagaacgagctgtggcttagcttccagccgaaggcacggatcaaggtccagtcaaggtagggtgggtcccatacccggtagaagagtaggtagagccggtgtatgtggtatccctttgagctataaaaggaggaccttgcccaccgagaaataggatgactccaagcagacctgagctctagggaaaaagagacgagagcgttctccggagcttaggacccttgtaacactcaaccatgatccctcacacatgagtagggtattacgctccatagcagcccgaacctgtataatcctctcgtctacacacaactagtaacgttcagggcggatacacgatctccaggggcgagccctttcccccggccgaactcacaaaagggggatctcacgatctcctgctagagaggttcactcctcgacaagtatagcttcggactaaaaaaattttgaagccgagtattcctagctttataaatctatatatctaactttttttattacgttaataacatttggatgaatcattttattcctattttagataaaaattaaaatatcaaaccactgtaatttaacatatcaaatctagcatagacataagatatagagttgtgccaaataggacaatagaaagcaatcatcttgaatgataattaatcatgccatgttaacttggttgcactacgactacgttttcatcttcacaaacatcttctttctttttacaaacaggctaaagaaaactcgtatgtaaaaagatttaggagtgacccatatacgaaaattaattttcacaaaaaaaactacttaacaggtatatatatgaaaatatgtttatttttatagacgggcatgctaaaatgctaacatgcccacatgtgaaaatagaattttcataattagtgaattttcgtccacatgagaaaaggagacatcgttttcttctccttttctctcagtggcaagtcctgaagtgatcctctccttcttctcagtcctctctcacccaccacctctcctccccatcttcacccttcccctctccctcatttcctctttctcccccatcacttctctcacccagcggccaacgatggagcacccactacaggagcatcgctgatgaagcgcccatgacaagagcggccagcgtgcacctcaacacctcctcctccaccgccggttgcctcgcggcggtcgaagccagtgtcggcgtccctacgatgtcttctccctcagctcctcctcctctaccgctagtggctccgcggtggccggatttgccagaggtggtcccgagacgagcaggccgccagcagcagcattgaagcgatggatccgctggcttcagctggcggcggtggggtagcagcggatctggctagtggatcatgggctagggtttctgtaattattttgcatgcgggtgacttagcatgcccctatgcgaaagtaggtttattttttacttggttgcggtacccgtatgggataattggcatttctacatacacctagctagctgacggctgacgctaggcgatccttccgtccctatgaaaaagtgattctgcttgtttagaaaaagcattaatgtagtagcagtagtgttgacccattcatgcttatattactctctgctccagcaatgaagcttaaggggaaaaaaggaaaggagatcaagaacttgtgctcatctaaaagttgtgctccagtggaagccagcaggtaggttctccgtattcaactgtacacagaaatcaagacagacaagtgctcgtataaaatgagcagaagttgactctagaatgtgactagatgcgcggtccgatccaatcatctcgtcagatgaccaaagaagaaacatgtctcactaaccaagataatttgtcatattcgtacgaattatctatacctttctgacgtgtgtcttacataatgctactagatcagatctggcacataggctgtatttagttcacactgaagtttgtaagtttgttgaaattggtatgaagtgatagaaaagttatgtgtgtgtgaaagttttgatgtgatgaaaagttaaaagtttggaaaaaaaaactttaaaactaaaccgggcctagtaataatagaactgttctgaattttaacgctttagtgcatttttaaaaaaatcattttataaatagattatgtgtaaactaattccaaaatagctaacttacgacctcaacgacgacacatttctgacaatgacggggtggatgactagctacaattaatttttagtggagtctattcgcgaaacaaattttacaaaagaccaaatgtcaagatttttgtccattcatcttatactagattgaagacatgggaattttttagcgtgagtagtgtagaagtccaaagcacatcaaattagcattatactactgccttcgtccatgata

SEQ ID NO: 5216 - DNA, 1380 bp, Oryza sativa
aaactaaatagtttaaaatttattgattgtcaaaattttaattgttttatcttgatcttgtataagatatcatgaattatgaacggagaaaaataggagtagttatcgcggagtactatttcttaggtacggggagagaggaatcaagtcggataatgaactattttggctatatttttgtcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgggtgtagtatagatctgacgatcaggttgtctcatgcccctaaagggggctccctgccctccttatataggttagggggcagggttacaagatagaaaccttaaccaagacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatcttacagtagcccctgagatcttcacaggcgaaaatataatcttctctcgaactagattactctaaagccgagtgcttcaatcatcttcgccatgggctcccgagtacttttaccaaatctgaagactgtggagggctgaaaaataaagtcaggtgcatcgaatagatgcacctaataggtgtagcccccaactatgtgattagctgaacaaactaaacatataggcaaggaataaattatctaattaaccgagtggtttttgataattatagtcaaccaagtgacttgataccaatatatagcatatgcggcgtgaatccccgaataatatgaaccaagtgatataccgactgcttggcaaaatatgatgcgtacaacctaaaggtgacaacatctttgaaagatcacatagcaaaacaactataaagaagcttgaatgctgggaataaagaaatttccaaagtattgggcatacgccatgcgcacactgctttaacagatgtgcttaagtccctaaaagacacatggtttcaccacttctggaaatatatggcatatatgggataacatccgagcaagtaaactcataaaggatttaccaaccgcctgaaaaatgaccataatatataatcagcctaagccataatattgtcaattaaaatgcacactgacgtggcaaaaagcaatgatattggatccaatcaattgcttgataaacccaaacagcaccttgactatataaaaagtcagcggcgcagctatataaa

SEQ ID NO: 5217 - DNA, 4468 bp, Oryza sativa
aaatatatggtatatatggtataatattggagtaagtaatattataaaggatttattaattgtttgaaaaatgattataatatataattagcctaagctataatattggtcaataaaaatgcacacttacgtggcaaaaagtaatgatattgtatttaattaattgcttgataaacccaaacagcaccttgactatataaaaaagtcagcggggcagctatataaagctttactgtttgacaccttttaagatgcatggtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagttggcatggagatgaaatgaccaacatgaagacgaaattgctcatcagaagtaacggaagatgtcagtggtagtaaagatgccaccgatcaaatgtaatgaagttgcataaccatggaggcgaagaaaccagttggcaacagtcaggtcagctagcagtgaatatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagtgactcattggctgattaattgattttttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagatgaagtcgctccaccatgatgacaaagttgtattgccgtaatgaagtgaacacaagtcggcggcaacagaagcaaaccggtagtgaagacgcgcagttgtgaagataaaagcaccagtcggcggcggcataatcagtcggcgacggaagatgatgatgtccatcagtagtggtagctgtataaaccagacgtagaggcgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactgatgcctattagtagtgacagcgatgtacccagccgtgaagaagatagcatcagttggcgttataacaggccagccgtgcaggcggtgccaccagtcggcggcggacgaagcggccggtcggtgaaaacgtatacgcccaacaacggcggcataataggccagccgtgcaggcggaaacaccagtctgcggcggacgaggcggccggtcggtgaagacgtatacgcccaacaacggcggcataataggccaacgtgcaggcggaaacaccagtcggcagcgaacgaggcggccggtcagtgaagacgtagacgcccaacaacggcggcataataggccagccgtgcaggcggaaacaccagtcggcggcggtcgaggcggccggtcggtgaagacgtagacgcccaacaacggcggcataataagtcagccgtgcaggcggaagcaccagtcggcggcggacgaggcggccggtcggtgaagacgtaggcgcccaacaacggcggcataaaggccagccgtgcaggcggaaacaccagtcggcagcggagaaggcaagccggtcggtgaagacgtagacgcccaacaacggcggcataataggccagccgtgcaggcggaaacaccagtcggcagcggcgaaggcaagccggtcggtgaagacgtagacgcccaacaacggcggcataataggccagccgtgcaggcggaaacaccagtcggcggcggccaaggcaagccggtcggtgaagacgtagacgcccaacaacggcggcataaaggccagccgtgcaggcggaagcaccagtcggcggcggacaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgacgacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccaaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcatattaggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggca

SEQ ID NO: 5218 - DNA, 2718 bp, Oryza sativa
acgcctcgagtccatgaccagcatcaatcgcctcaatagtgccgcgtaattatatgcgaacaacaacaaaaaatagcaagagattaatctgggattaaaaatcaatacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgggtgtagtatagatctgacgatcaggttgtctcatgcccctaaagggggctccctgccctccttatataggttggggggcagggttacaagatagaaaccttaaccaagacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacaattttgaactattttggctatattttgtatgtgtccgcatgttgcagcactaggacatttttatgattcgttactacctacaagttgaccagaagattccaccaccagaacatgtacaaaataccgttcataggtgttcatggccagttggtttaatattgaattgactttgccagttccaagcggcattaccgctggttttagaacacgcagagtgctaaaatggtaggtaagctcgataaggactagcggtgtaatatattcagtgtaaaaaaaaattgaacacccgttttaactcactactaaaaaagagttttccatgctggctaaaatgggtcttttctggcggctagtcaaaccacttgaaaccaaaggctagagaaaatgtaagctcttcacaaataggacttcaaacgccaacgaaatcgattttcattggtggctgtgtcaagccagccgccagcgataattaaattttactagcagttatgttaagccagccgtcagtgataatcaattttgagacaaaaaaaattgaaaataaccgcatgcagttaccctctaaccgccagcaaagagcctgcattaccaaacccaaaccacaaatccacaacagagtcccgcattaccaaatccaaatccaaattcttgcctctgtcgtcatctccatgaatgcgcccacgccagacctgcccgccaacccaccatgaacgcgcccaccacccgccgtggacgagcttgcacgcccgtgcgactcgccggcgccaaatccattacgacgtgacttgtcacctgcaatcaatggaagcctaacgatggaagggcatgcggaggtcgacaagggagggacgatcgagtcgctttggaagtagtgggtagatagccaccttcggatccgtgttcccaaggaagggcgcggccagctggcagtagaaccgccttgctcccgaggtccggctccccgtgccgctgccgccgagccggatttgctccccgctgcccactcccctgcactgttactgccgagcgccgccccctcccacacacgagtgccgccaccaccccttcgttctcccatggaagggtgtggccggccagcggcagaaccactgctcccgaggtcctgctcccccgcgctgctaccgctgaccggatctgctccctgccgcccactccctgcgccactagcgccaagcgccgccccctcccctgcacgagcgccactgttgctgcccctccgtgctcccaaggtagggctcccggcacctccgctgcccctcccatgcacgagcaccgacgcagccgctgccccctccccgcaccgctgctgccaagtgcctcggctggatctgggaggcagagaagaaaaaaagaaagaaagagggggagctctggattgggagagagagagagagaggaaagagtgaattagaatttaagacccgctggattcttgcttgcggtggttttaagacccgcctgtaaaaattagatttttgcaagcagcgtcttaagagcaccgcttgtaaaaatcgtgttatttttaatggtggtgctcttaagacgatcgcttgcgaaaatagattttcaatggcggttactaactcggaaccacctgttgtatttttgctagcgatttttgcgtatggctgctagagaaaattatagggtgatgctatgaaaaatcgattgtttagtagtgactattgcgtttgtctaaactacactactcaactttaaaacaaagcctttaacccacctcaactgtcaaaacttttcagtgtacccctttactcaaactaagggtgaaaatagtacaaaaaatttcttgtccgtactaataccgtttccacaaaacaagagataatctaagaaataccattgacaagcgtccaagtcccagaaatgccatcgacaagtgtgactttcaagaaatgccattttacaaaccattttgtcccaaaaatgccat

SEQ ID NO: 5219 - DNA, 2969 bp, Oryza sativa
  unsure (1)..(2969): unsure at all n locations
catagacatgatagggttgttggtatttcttactaacattactagaaatataattcttagcaatggcatagaaatagtcctggtatatttatggttacaaatatgatccacaagcgcacagatataccattgaagcatttcacccggaagtattctaaggtatcgtatttatttaatcctaaggggagattgataagagaagactatgctaataatttatatgttacttgtataagtcagagtctaagcagggattaattaattcaagcatagagtgacacgaagaagaactaagttactctcattaaataaatcctagggtaagtggagaacgaataaaaaaaaagaatccatcccaatacttctaatatacaagtatctttaatttacactccctagtatacaatcatacagtcaataccccctaactattccctcctggtgtttcaagagacaacccctgattgccgagttccttacaacaacccgtcatggctgtccaaccggaaatgaatacggaggagtacccacaccaagaaattaacttagaactatatactaacatggaagaatacccgtaatgagctatcaccatcagcggcccacctctattattccgcagcatataccctcaaataatgatatttaataatctaagcaccatgcttacattatcaaatactactctatatccgctagcatgacatagaacaatcatttgcatgaacattatacccacaccattgcatatctctggtaagctagctacacaattatatcgagataaatgtaaaataaagtcggtactcaaataataagagtgaagaaaaatatcaaaattgaataaagaagaatatttcattaattgtataagtctcgcaaaagagagatagtggaggaggtgatgtccatttataggttgccaatgatggttgtggtggttgcaattgtagaaaatgccacacaaccattattggggagggatcctagacgtccatgccaaaccccagccttaatggctgagatgggggttcggccgaacccagggtgttcggcctagttttcggcaggcctcctctccggtggttcctcaggccagtggtaaggtgttttgggccctttgagattatttctttggacttataggcccatctatccataagtatacctcttgacggcttccgattgattgttcgtttgttttcgtcgattctccttctctctatgtagcaatctttgcaatcaaataggatccatgtacaagtggaaatagattatactanacanaatatgcattgcaagcatagctagttctctttattttggttatactgacagtcgaaattggtctataacgactgtcaacaagggtgaaaccctttcctcatgccacacgtgtcacaactgctcgagatggagatggcccctcgtcctcggagacaggtgaagtggaacttattcttgcacttctttttttttagaactttgaggagtcgcatggtgaggaggagaagaatgtcccttccctagtcttgcaccacctacaagaccgtgaatcatcaccaaatcaatgttgctgcttgaggaggacaggttgcgagtgagtaagaaggggagggagcaagaaggaacattgctctctgaacagcggtccaataaaaaaactcctcgatttggtccaagtggggtaaatttaatgttttaatgggggtttctatatccaagtttcaaagttgagtgatgcttttcaaagaaatgtaataattgaggggggggggggggcaaattgacttattccaaagaaagaaaagaaccaacataggagtagctctcgttcacgctggctccatagcactactttgaaaacgatgttcctagacacctcaatttcatttataaaggtgagttgtaagaaaatatgcaatccacttgtgatagtggagatggaatggtttaaacagtcaatgaaaatcaatgttcacaaatgatcccttgagagaaccacctgtgtaataggtgtatattcacaggcggttcaaactatttgtgaaaatcatgattttcacatgaaaatgtgtatttttgcaccaatttttataggagcttctcttatggcgtgcatttggttcaagggcgaggttggataagatatgaccatacatgtttagttggataggaagatccaagttatttgtttggttacgcggataggataagccatttttttgtttggttggatgggatgagattagtaaattgataattaataacaaaatatgttaactatcactaatattttcataatcaacactaatcaacaacaaaatatactaactatccctaatgagcactaatattgcaatgataatcactaattaacaacaaaacatgctaatcatcactaattagttcctaatgattaatggtagcgaaggtggatgagctcatctaatcaattttgccggatacacttatccaacatcgttggagaatattttcagggtggcagcccaatccatccctcgcccgtgaaccaaatactacgaaagtctggacgaccatctcccatccaaccccatccacccaactaaacgtacccttaagaagccgattttaaaaatgtacataaccctatttcaagaaaaaatacattaatttttatataaaaattatttccctcagtgaaattatggccgaaacttttttcatttaatataatttatgagcctaaatatttgggtgaaatggaccaaaagaataaattgtttgataactatcatttatatgagtgtgaggtgggatggtcggtgggatcgtaggaggcttgaggttgtgggtttgattcttgcaaacaacagatgtatattttgtgttaaaattgtggctttctacttcacgcatgagtgggagccaggtgaggcgctaggatattttttaatttgcaaaggcttctcaaggtggtgaaacct

SEQ ID NO: 5220 - DNA, 5162 bp, Oryza sativa
caagtagttcatcattaaaaaataaaataaaccgatttttaatgttttcaataattaatgcgtaattaatcatatactaggcctgcaccattagtgaggtttagtgtgtttattattaggtttctatcacttatcaaccggcaccgatgagaacgtacccctcattagcgccgctaagttggtgttgattgtcaaatccggtatccatatatggttgttattgttaaccgacacctgccgaaagggccgttctctactggtgagtgcaacaaaagactagccatatctcaaattaacaccccagttacagaagaaaaacaaacttcgtcgtcagcactctgggagacattcccttccaagcaatccattccatcaatttggatatgaataacaaaccaaactagaaacaaaatgaagttcgaaaagcggagcctagctcgatgctccattttttagtgtaggaaacatcgatagatgtatacgtatctgctattagtacgtagctactagctatctgtacagttagagagtctctgtcgtgcccccgtgctctcccatatcttttcttcacctatccccttcacatgagatattgataatgggatctcaatgcatctatatatattaataaaatcgtggttagttgttcaccgcgctgtcaacctacaccgactgggcatggccagtgagatgctctgcaaattgtacatgcatgtagtatgcgacactgaaagagatctgcgatcctctcctagctagtactaatatagctttgttgatgtctatatatatatataccacggaaataatactgcacacaggattccaccaaaaaggtgaccgttgcgtgacatgtcgattctacctgatctaatcggccagcaattcgctagtaattaagatattatatatatggtgcttgtaaaatattattgggcgacagctcagcttcaaattaaggacaaaatatatatggttaggtagctccagtttcccatcccacgatttttgtgtgaaaaatattattaggagacgtgcactactagaaaagcgttttccagacggcaaaaaatagtttttctaggcggagaaaataaccggatgtaagcaaaggcctgcaggaatagacgattttcgcaggcgacatctccatcttcacaggcgatagatccacctgcttgtgaaaatattttcagcgaaaaaaaattgccgacgccggcttccccctccgaccgacggctctcctcccccgtctgccgccattgcccgaggggagcgccgactccgccgccgctggtggctggctcccctcttccgtccagatctaggagcggagaggctcacgctatttgcggtggctattgccggagaacggatctaggtggtaggattggagtatcgccgccgcctcccctccttgttgctaagccgctgctggctctcctcttcatcagaccgggagaggagccaagccactgccttacctccttgtcgcggccgacgcctctcctccttggaaaaagtacgaattaccgccccccaactatcacggtcgaccgaattacccccctagactcaaataccagacattttacaccctaaactatttataccggactaatgaatcccctgaacaggctttgacttgagctagcacacgtggagccaacgtggcagactactcagcaaaaaaataaataaattaaaaacccatgggcccacctgccatccctctcttcaacccaacatatcccagcccccctgctctctctctctctcttgcgcgcacacgggcggccagcggtggaggtgggcggagctcgctcgagcgcacaggcgtccagcggcggaggtgggtggagctcgctcgcgcggctgggggcagaggctgaggcaagccggttcccccaaatccagccgccgccgccgccgcccggggtggcggcgcgggctcgggtggtgggcggcggcacggggacaggcgaatggcgacggcgcaggggcgggcggtgtgcagggtcggcgacagctagcttcatcgcggcgtcgtggttgcggagcaggaggaggagcctgtcgcagcagtccaggagctcccactcggcagaggcccagccgccatcggggaggaacgaagccaaaggcagaggcggaggtggcggagaggaagaccggaggcatgcggcccaggacgacaaagaggaagctgaggaggtgcgggggagatgtctagtggtgagcacggaagtggcagaggaagccggcatcgcgggccgcacagaggaaggatctgcccgcgagcgtggcacgcaccaacgcggcttgagaagggaagcggaggaggatctcgcgaaggaggtcgtgccgagcaccttgatgccgcccgttgcacggcctccccacgccaccgcccccggcatgcccttccgcgccgaccgcctgcgctgccggctcccgccagcactcgcgcgtcgccacaccccgcctgccctcgtgtgctgtccgcgcgcgtgactgcttatcgccggccctcgcgcgccgactgcttgcgccgtcggaccccgcctacccttgctcaccaatggctcgcaccgctcaacctgcgcccgtgcgaccgcgcctgacgagtgacgacgctagagagagggggaagaggaaaaaggaggagatgagagagtatgacaggtgggacccaccatgttaaaaaaaaagaaaatgtgactaggttgccacgcatacgccacgtaggacaaaagcgctctggattgggtcgagggggattattcgtctggtattgaaagttcagggtgagtgatgtctggttttcgggttcagggggaaattcggccgaccacgatagtttggcgaggtggggggggtaattcgttctttttccgaaaaataacttggatgcaagaattatacatcaaagtgaaggagaaatgaggtggtatgcaaagaaacacacatctggcgaatcaagtgcaagaatacggattgaagggcccacatgtcatgccaaaccgacctaaagtgagactaaacagctgtgcaccgccttaggagcccacaagtctgtcactggtgaaaggcgatggagagaagtagggccacgggggttcggccaaactgccatagccacttctcatcatggccctccacgtgttgcttactggttggctcccaatgacggttatgggtgtttaaccataacacaaccatcatcagtcacctataaatagagctcatctccctcacttgtaacacacacctcttggatagggatggcaatttccccgttgggggcggggacccggcgggtacccgcccctaccgggacggggatagggcgaattttcaacccgcggggctgcagggatggggccccggaactatgcgggggcgggggcagggccacaagctcacctgcgggtgacccacgggccctcggaatatagggatctaaaatatggcatacaacccataatcaaatttaagcccatatagcccaatatatatatagagatcagtaaagagaagccaaccctaaaatcaatcccgtgagtttgtcacctagccgccaccaatctctattctcgttccagtagttttgacttttgacgctatcccacaaatcacgcaacacatcacacgccgcatgctgcttcctcacctccacaaatcatgcctcgcgagttggtcccgcaccatcaagcagcagcggtcggcgctcttccacgctgctcgtatcgttgctctcacggacgccgtctcccaatcctgcaatccgccggcgccccatgtcgttctcctacctctctagccgtcggcgcctgtgctgttctcctccttctccgaccgttcctctcccttcgactgctgcaggttccccacatcattattcccttcctccacccggctgctgcaagttcccaacaccattctttccttcctccggccgctagcagtcgccgctcgcatctaggtgcggggacccggaaatggtgcggcgccctggaggggctgggggcagggattgatttcgccccgttcctcactccgggcccagggccgtgtgaacccgcaaggatgcgggggcggggccgttcctatccaacccgcacccgccccgtcccgttgccaaccctactcttggagtttgttgtgtgcttcacggaaagtgaggtaggcggcaagtggtggcagagtttttatgcactcttacgttcgggtatgacgtaagagtacataaatgccataaccacgctgggagaccagtagtgagtggtctctcagtagtgtgtttggaactaagtcctatgttgtaagcatgtatatgttaagtgtatactgaatatgattagtataaaagtaaagatgaattgtagttttctgatgctaatttcctactagcaggggcgaagctaggggcgggaggaggcctggcctcccccaatcagcagccgattcaccctaccccctaaaacaaagaaaattgatacagcatcacacttgtgttgatcgcctgatcccctgaattagttctgcatcagctacgtcatcattgatatctagttgtgagatgtgttagatttatatgtgtatgtgtatcctaagaaaccattatcagtttgctaatgacgcatggctgccgtgataagtatatatgtatgtgtttgagtttacatatcagtttccactttcctactaaatttgtagactaaatttgtagctgtagctgtaggtgtgtgtttttcttgcgcttgagccatgatgattaggaaactaattatacctattgctaattttgctaagtttttttttctaattactgtcaatttatagacttttagctctgatattttttaatcatctatagaaaatctttaaatttatatatatttatacaatttttttattgtaatcatttgttaagctggccccctcataattaaatcctagctttgccactacctactaagatattcttatagaggtgcatcttctcataattaaatcctagctttgccactacctactaagatattcttatagaggtgcatcttctgtgtgtccactacctattaattattatcctaactcatgtttgaactatggtgaattaattataagttaattaaggagatataataaacatatct

SEQ ID NO: 5221 - DNA, 1448 bp, Oryza sativa
cctattctatcgtcgatggtagaataaaactatacccgaattatcgtatataaaaccaaacagtctactacaaaatatcggccttaattacccactggacaatacttgaacaagcagaaggttagaataaattcttcccgacttttctccgttgggaggaaaaaaaaattgtaatatccttttaccaaaagttggcaatcgctgcatagtgagaagactcgtatattccatccgcgtttttcatgcagggaggtggagtttcaaactgccgatcaacacagctagtcgggcaagaaagatgaacgttgaagacgagaatctgttaggtaattagtcaaacaactgttcccaaacaaccgactagttgtttgattaactaagtttacaaaagccaatatatatagtctggccagaagttggacactaacaagcttttttcgaccttcattggttacctactaattaattaaataacaagtgaccagcctgttggtggaatagctccctaattttgaaatgtccttagctaagaagtcatcttcctgtccaaaaaaagataagttatgaagtctcttcatgtgaaatgttttctttcgttttactattgatgtttaattatcaagtaaatgctcgcaaagagatcgatcgatgcagacgtgtggttggtaagggatggaatcccctctcctgcaatactatacgcccattacttttttagaaccttatgacttctgacgtgggctctcgattaatttgatcctctgatcacaatcgatcatatcttaattaaatttggataagggggtgaccgttacaacctatctactccacaaattaactattgaaactatggctgaacatcataataagtaactaactaaatcatatcgccgcccattgccccgcgcacgctcactctctcctttttcttttcaaagattcctatttacatgtgccaactctactatatttctatataagacaaatttgttataaatttaatttgttagtggacattataaaaacttatcgtgactagaggacactcaaatagtggtagtttactgcagaatattttcgaaccaattaaagagaattttttttaaagaaaaactcccggggccacgagcttctaacatgacagaaatttgcatatagttgctcccgagcaaacaaattcgctcttgcctctacgatattggccgcacgagcatgcttcatgcccatgaacttacaccatgtgtgggccaagcatattagaaggttagtggaagttcctccagaaaattttgtatattaagtttttttatataccttttaattatgttggaaatttttttaataaaaaattttagttttgaattcgtaatagaatttcttataggaagttctaatccattgtcaagacgagtctcttgtacaatgttttaaaatctctaaaataaaat

SEQ ID NO: 5222 - DNA, 558 bp, Oryza sativa
ttggacgcttgtcaatggcatttcttggattatctcacaaaacaaatataatgataatatatttaccaacttttaccatttctaaaatttaggatttctattttttttgtcagcgtcgtatttaaattggcactaaatagttaaattcacaaatgaaaattgcatgtcctttttcataaaattaataaaaaaattgtaccttttccgatcatttccgactgttttcatccttaactcaaactgaggtattcttttttacatgacgctgttgtagcattataatcaccccgaaaattaatggtaggacacactagtcagtgacctctttctcctccaccgctctccctttctctttcaccctctcctaatctgtcctctcgtctctctttctaccgaagcaccgaggacactgtcaacaagctcgagggagttcctccctaaggcctttgccgtattgacatgagagggagatgtagagagggatctagcgtcggggaaggtggagctcgaggacatggtgtctcaccttcgatgctgaggtcctagacaagacaatgt

SEQ ID NO: 5223 - DNA, 379 bp, Oryza sativa
tccaaccttgacaacaataaatcataaatggcattaagctagtgcagagcagaaaaaaaatcataataatgtgtgagctcgacggcattaattaattagttcctcgccggcgagtggtacgggctcggcgttccgtacgacggcgtcagcatcggcgttgggtgcggcggctggccaaggtgcggcttgggcgccggcttggtcgacgacgcggctggcagatgggcttgcagatggtcgccgacgcgcacaccggcgacgtgcagtgggtcttgccggcgacggcaacgaaggttctttccgacagctgcatgatcctcgacggctcctgaccggggcatgccgcgttatgttccgccgcgctgtggagctgagccac

SEQ ID NO: 5224 - DNA, 870 bp, Oryza sativa
gtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaagtcgtagacgcccaacagcagcggcataataggctagccgtgtaggcagaaacaccagtcggcggcggcgaaggcaagccggtcggtgaagacgtggacgcccatgaacggtggtgtgaccaaccaaccgtataggcgaggacaccagtcggcggcgacggaggcaggccggcggtgaagtcgtagacgcccaacagcggcggcataaataggccagccgtgtaggcagaaacaccagtcggcggcggcgaaggcaagccggtcggtgaagacgtggacgcccatgaacggtggtgtgaccaaccaaccgtataggcgaggacaccagtcggcggcgacggaggcaggctggcggtgaagtcgtagacgcccaacagcagcggcataataggctagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccaaccgtgtaggcggaggcaccaatcggcggcgacggaggcaggccggcggtgaagtcgtagacgcccaac

SEQ ID NO: 5225 - DNA, 25822 bp, Oryza sativa
  unsure (1)..(25822): unsure at all n locations
gccactttgattttgcaaaagcaatctctctctcctttttctgtttatgaactaatctgaaacaaaaaatcaacaatatgtccatctttgccacaaaaagaacaagtatatttttcacgttgtttagacacattgttagaactagaagatttagcaacataagcagtaataggaggttttgcatgcacaacattggattttgaagaagatgcattcaaggtagacatgataccagcagatttaaacacagttttattggtatcaggtttaaccaaaatttcaccacttctagcaccaacacctaacacaacaggaggatgtctagaattatgagcataaggattaaaacctaaaccacagttatgtgtgctaacctttgattgatcttgttgaggttctttttaccatcagaaaatctttgcaaagaatttttcaagtaggaaacctcttttttcaaattagcacaattttcacaatctaccatgacatctttacttttacgacatttggggcaagaaaacacttcattatttttcacaacatcttacatatactcaacacgacctaaagcatcttttattttcatcttattcaaattacatgttgagcaatccaaaacatcatgaggttgttttaactttttagcagaaatcatattaaacatcaaactagcatgaaaagcaatttgatatttttgcaacaactttttagttaaaaacaattcatccaaagtgcgtgtatgcaaagaaaaactacaagtaagagaagatctatttttgaaatcatgtgcagctttaacatctctaatttttgaaatctcattcattaaaacctcacaatttgagcaatcatcatcattaggaataagagattttaatctagtaatttgagatttaaaagattcaatgataaattcctggtttctatacatcttctcacacttcttatttttttcactcaaaatattaatagcttcctcaaacgcacctacctcattatcttcaaactccgtgtcagattcaccacgcgccatgaagcaaacatcggagatgttcttccccttatcatcgtctccattttcaccatctacatcacttagtggctcgaaggcggcgcaaacttgttgaaaggccttcctgagattctccatcttcctctcttgggatgaacccttcggcttgttgttgttgggcttgttgttgctggtcttctcaccctctttgtcttctcttttgcctctcccaagcttaggacaatacgaatgaagatgatcaattgaaccacattcaaagcaacgatttggaccacctcttttcctgttcctggcattattcatagctcgagcaatacggttagcaaccaaagccaaatcctcctcctcgatctgttcgagttgatcatcggatgtggcattaaaaacagcaataaaagaaggcttagatgaagaagcatctacatacaaagaagaagaagaagaaaccaaagcactagacttagaattagcttttcgagaaagaacattcatcttatgtgttttcaatttggtgtgaagtgaatccaaagtcaaagtagacatattgacagactcctgaatagatgtaactttcatctcccaaatagacatatcaagaccattcaaaaagtgacgagaaatctcagattgtggataattagcatcataagaagaatcaacagatctaagatcactcaaaattttgttaaacctagaaagatagtcatccaaagcttctccaggtttcatctcaaatttaatgtactcatttttgaaaagatctcgatgaagctctttaatattatttgttccttgatgaaaattacttaaagcaacccaaatctcatgagcagtttgaagatgtgcaacacgatcataatctgaatgagaaataccactcaaaagaatgttgcgagctttgcaattttgttcaaaagcagttttttcaacagcagtattaatagcttcaggaatcacataaagatgagaaacttttctccaaatatcataatcttcagccataatgtaagactgcatcctactacaccaatgagaaaaattcgttccatcgaaaagatgaggcttagttgaaaacctagcaggagtagccatggcaaaaactctagattgataaaaatccaaagaagaaaacaaggctctgataccacttgtagaatcgaatagcaaaaactaagccaaccagagggaggttgaatggctggtatacccaaaaacttttagcggaaataaaagttaccctcgaaattgacggagatcggtctgaccgagattgatctgccgatctgaccgagtggatgccgccggtgtgaccggtgttgaatctccggtctgaccgccgagatcccctgccgcgcctgtcgcctagccaccgccggtctgaccgccgcttcccgccggtctgaccgtcagtatatcgacggttagaccgccgaaactcggtgaaacacaaatcgaagaactcttaaagtggatgacgacgttattacttctctctgtgtttacaaagtgcaccaacagcactccttacaaaaattttgactaaactcgaaccctaactcaaaactcaactcaattgctctcaaaagcgataccgggaagcctcacgctccccctctatttatacccgaggtaggcaggctaaagccacgaaccaaactcatactaggagtcctaaacaccttagtaaaccctctagtacaagaaagaaactttacatgaccaatcgtactaaatttggactccttccaaattcgactctgcatcccatacgcacacaataactccatcgtatgccatatggaatctccatcaaccacgtgcatcaactctagccttagtatcccgcatgatctctgaccaccagggacgtcgtcttatccccaagtcgactcccgattcatcaccgcaaatactctcccgagacatcgagtcacctacacatggaacaaacaaagaaaccatattccgagaccaagctatctccaacttgactcattagtagcaaacaacagtattacatacatatagtatccatctagaagccataatcatgaaataatcatggatatccaaataaacaacccgaaaccgaaaccgacacagcgttggccggtcagaccgcgggccagcccgtctgaccgcgcaatacacgccagtctgaccggtagcaccaacccggtctgaccggtccacataaaatcacaacaatatcctgtagattcacctgtaaatccaatcatctccaaaaaccacttcgtaaataaattccaaataacaaaaccaataatctccaatgcccaattgttcatcacagaataataatcaaaaacacctttgattttacacgaatttaatagttgatagtttccttaaacaaaatcagttgatgctctagtggaaaatttgtctcaagcagaatgccagagttttcaatctggttttcaaaccaagcgagttgatcataaacaacatcaagagagtttttatgtaatctgagtgtagagcttgtagccctatctatcagttgtttctgttacgtaggtccttcgacagtacattgtccagtttatttgtaacactttcccccaaatcttaatcaaataggttggccaatctttcggccatcccggccaataaataaataaaattagttgatgcttcaggcaacagcaagggacatcacttcatgtgtaactagctggtagtttcccaacttttattgcattcgctagattagtatattggaacggatgcataattttgagttttattgttcatatatatatatatatatatatatatgtcatagacactagaatatcgatgttgcagaatttgtagtctaaaaaaatgggatcaacctggggaatttatattgactttgcattaacaagaaaaccggcacccaaattcgccttaacgaggattagaatatgggtggtttaggtgtaatcccacaccattgaccaactgtgcccactacaacaggaacctcatttaacaacacatctatgtattgctagaaatccaaataagtgttgcaagggtctacaccaacgcttttagtatgcgttctatgctggtgttgcaatggtagaaatatatgatcatgtgttagtgacactaaaaataagcattgcaaagttgcaacagatagcaggattcaattctggttgcatagtactattatgtattgctactatcaataaatcataatattattttttatatgcacaattggaatcgaccagagatatatacttttcttgaaatcacatcgaaatgattatcaacaattgatttcattcataaataggaatggcagctttgttgcatatacaaaacaatcttacaaaattgttttttgttttgcattgtcaaaccaacatatcatttgggaaactatattgaatcatacaaaagaagaatcagatggatcagcctaacttctctcctagagaccaaatattgacatcaacactaatttcttgtagcttgtcatcttgagatcagcttgaagcttgtcaactgggtcatgactcaatgtaccttctccttaacaaaaggtaggcatattttagtaaatttattttgtttgaaccaatataaattgcatcgagtagaagcatgacatttcagtatgaagtaaatactcagggtcctttagagtagggggcggctactctacctatcatactgcagaaaacgcccgcgtcgcctcccccgagggtgactcgggcggcgacgcacctccgccgcctcactctcctctctcctcccctgcctcaccgctgctcgagcgaagccggccggccgcaacaacggtggcggtgggactctctcttctctccctccccacatcccgccggcgatctaggtgctgtcggggcctggggaggtgcctctggccagatctgcgccgtcctcgccaggatctggcagggagaggtcggccccggccagatccgtgcctccctccggcggatctggcggcagtgggtcgggacgacgatggggtggtggcctgcgcgcgtaggagctggccagccgctgtcagcggtgccaacggcttgtggttcgctttccctcgagtgggcggtgagggcggcccgagggcacacgcacggagtcggccgacgtcctcgggggcaccggtggctggtggcgcgtgggggtggcccgaaaggagtgcccgcggagtcggttggccatccttgctggcgccggcggctggtggcgcgcgcgccgctctctccggacggctgggctatcccttgttcatcaagcgagctcccgtcgcccctagaaaaccccctctcctcctctccccccttctttttccagccttcctttttccagcccagattcacccctaggtgcttttcccgacgtctctgacggcaacgacggtgatgggcggctgggacctaggacccggcgatggtggtggcgatgcaggtgcatcctgtggagccgccgtcgaatttggggccccgcgcctgaatcctgctgctcggcatcgcggacagcggtgatgggtcaatttcttcaccggctgtaccttcctcctctctgtcgtgctcctccccttttggccgttttggtcgtggggagccctgatgtgcactagggttcccgatcttccgaaaggttctgatacacagcgatttgggcggagtcgcgacataaatcgatccggcttcttgaacgcgcacgctcttgagtcccgcaatcgcagcaccacgtctcctctggttatcacccgtgtcgaaacgcggatgacctcgccgagaaggctaatccctgtttgctaatcgaagaacacaaacaagaacaagatagaaaacaaccaaaattgcagatgaatgattaagctcacgagttggggtcttacaaaccgatctagcggcgaaactgttctcgatagattaatctaagcaaaacccaaaaacctaaagatggcggcgggtactgatatatagagtttagggacatgcaaaatcctctcgatacaaccctaataggtttcaacacgatacacgggccaaaggcccaaatacggtgacgcagcagcgggacagattctggacgtcaacttgttcggtcaattcccattgactcggaaagaatttggacatgggacctaaaccattggaaaagttatcttcttagctttccatccatataatgaacgccccaattcgagcatgtatgcgacctaggcgcccgttttagtgcagactggttctggactccgaattgcacctgacgtcgacttggtttgggcctccaccttgacttggacgtcctcgatgatcctccatggctctaagtccttctccaagtgtctccttgtcccctccattgttcctaatcataatataatcattaggtagcaatctattctcgaattcatacaaagaagaacataggaacgagctcacctctaaatttaattgtcgtgcacgagctcttgttatcggtccttgaatgatcgttggaggattgttgtgtatatccgaggtagtgatgtccgcattatcctccccctcttgaattgaagttgtcctcgactcaagctcatcctcttctcccaagtatggcttcaaatctgaaatgttaaatgtggtactaaccccaaactcgggaggcaactcaagtttatatacattatcattaatcttctcaataattttaaaaggaccatcagcacgaggcatcaacttagactttctcaattccggaaatctatccttttgcaagtgcaaccaaactaaatcacccggttcaagcttaacctcttgcctacctttactacgagcaattctatacttttcagtcatcttttcaatgttgagcttggttgactcatgcattttcaaaataaattcagcgcgtgccatagcatcattatgaaccctctcactagtaggtaaaggcaaaatatcaataggagcacgagggttgaaaccatacactacctgaaaaggacttaccttggtagtagaatgtgttgcccaattgtatgcaaactccacatgaggcaaacattcttcccacatcttcaaatttttcttcaaaatagccctcagcatggtacccaaagtgcggttgactacctccgtttgtccatatgtttgtgggtgacatgttgtagaaaacaatagctttgtacccaacttattccatagcatgtgccaaaaatgacttaagaattttgcatcacgatctgaaacaatagtagaaggcataccatgcaagcgaacaatctcatggaaaaacagatcagcaatatgaacagcatcatcacttttatgacatgatatgaaatgtgccatcttagaaaaacgatccaccacaacaaaaatgctatccctccccctcttagttctaggcaatcccaaaacaaagtacatagaaatatctgcccaaggaatagaaggtacaggaagaggcatatacaaaccatgtggattcaaacgagacttagctttctgacaagtggtgcaacgtgccacgaacctctcaacatcttttctcattcttggccaaaagaaatgcaaggccaaaacatcttccgtcttcttagcttcaaaatgtcccatcaaccctcctccatgtgcttcctgtatcaacaaaagacgaacggaaccaactggaatgcatagacggttagctctataaacaaatccaccattcatcacaaatttgttccaagtacgtccctctttgcaatttaacatcacttcactaaaatcaggatcaagcgcatattgttctttaattgattcaagtccaaaaatccgacaatcaagttgagacaagaaagtatagcgcctagacaaagcatctgcaatcacattatctttccctttcttgtgtttgataacataagaaaaagattcaataaattcaagggaaaattggaaccatgccattataattttgcaaaatttgagatatgccatcctgacccacatgtcattgactcatgtgggtcttacatgtcattgagataccgatggcatatctcaaactatgcaaaattataatcgcatggtttcaatttaccctaaattcaacccatttagcatgtctacgatacaaattattttgagagcgaagatatttaagcgactcatgattggagtgaataacacattctttaggtcacaaataatgacgccacgtctctaaagaacgtacaagagcatacaattccttatcatacgtggaatgattcaaaacagaaccatgcaacttctcgctaaaatatgcaaccggcttaccatcttgcatcaacacacctccaatgccaactccactagcatcacattccaactcaaaagtcttaccaaagtttggaagttgtagcaatggtgcgtgtgtaagcttgtccttcaaagtgtcaaacgacttctcctgtgtctttccccaatggaagaccacccctttcttcgtcaactcattcaatggtgtagcaaaggtactgaaatctttgatgaaacggcgatagaatcctgcaagaccaagaaaactcctcacctctgtgatggtttggggaactggccaactttttatggcttcaatttttgtctcatccacctcaattccctgtggagtaacaacatatccaagaaaagaaactcgttccgtgcaaaatatgcacttttcaaggttagcaaacaaacgtgcatcgcgtagagcattaaaaatagcacgtaaatgatccatgtgttcatccaaagacttgttgtaaatcaatatgtcatcaaagtaaactaccacaaatcgtccaataaaaggtcttaaaacctcattcattaagcacatgaaagtactaggtgcattagtcaaaccaaaaggcattactaaccactcatacaaaccaaatttagttttgaaagctgtttttcattcatctccaagtttcattctaatttggaggtagccactatgcaagtcaatctttgtgaaaattatggaaccacacaactcatcaagcatgccgtctaacctaggaacaggatgacgatatcggatagtaatattattaatggctctacaatcaacacacatttgccaagaaccatctttcttaggaaccaaaattacaggaactgcacaaggactaaggctttgacgtatatacccgtggtccaaaagatcttgaacttgccgctgaatttccttagtctcctctaggttggttcgataaacagcacggtttggcaataatgctcctggaatcaaatcaatttgatgctctatccctctcataggtggcaagcccagaggtatctcagctggaaagacatcctcatactcctgcaaaaggttagtaacaacaggaggtatcgaaccagcaatatcatctagagaaaccaaagcttgtttgcatatcaaggaatagcaaatatcatcatctgaaatttcagcaatgtcacatttggttgcaagcataacactacccatcaacttaatcccctcaactttataactaggtgaaagcttatcttttttaggtggaaaaacagatttagcaactagctgattcttagattcatcaagtttcaaactagcagcttgttctttatcagcttctacaatttcagcaggggtcaaaggtagcaaagtaattttctttccattatgcacaaaagtgtatttattactcctaccatggtgtgtagcatcattatcatgttcccaagaacgacccaacaaaagtgatcaagcttgcatagaaaccacatcacaatcaacagaatctacatatgagccaatggaaaacaaaaccctgcaaacctgagttacctttgctcttccggaatcgtttaaccactaaatatggtaaggatgtggatgtgtacgtgtggtcaagccaagcttcttgaccaaatcagaactcaccaagttgttgcagctacctccatcaatgatcacacgtgcacgacggttgttgatgacaaagaaaatctgaaacaaattatggcgttgcaacctctcagactactatatctgcgtgctgagcacccgctgcacaatgatggtcctgtaggccattgtgtcatcacgaccaaagacttcgccatcctcatcctcaacttcttcttcctcctcttcttcttccacgtcggaggtggtaatgtagccatcttctgtaacaacatatgcccgttgactagggcaatctttctgcacatgcccaaacccttggcaacggtggcactgaatgcgtcctatcgaagcgacagatgaggcactcttggcgggtacctgcgaagaacttttacctaactctgctggtcgtggtggagatggttttggtggtgccgcagaagctccggatgcagctggtcacttgctcgctggctaggaaggcgcccgaaaagagacggccttgggcaatcccgcagatggcatcgtgtgaggagtgtatgtactcgccttgttcttgccctgctgctcacgcccctgcaattccttctctgcaagcatagcaaactgaaacaactggttgacagagttaaattccttataatcaacaatgttctgaatttcctccctcaaaccagaataaaaacgacaaatggcatcctcgaccccctccactatgccacaacgtctcacacccttttgtagctcaccatagtaatcttgtacagatttatccccttgttctaaacgcatcagtttcttgcgtaaatctctatgataagatggaggaacaaacctatcgcgcatagctaccttaagttcttcccaaatagtagataaagctcccttatcagataacccagcccaccacatgatagcaaaatctttgaactcactactggcttgttctactgtcatctcccaatcaaggtatttctcagcatcataatatcccgaaaaagatggtattttaaactttaccttagcataaggatcctcgggcacacgattattattaccttgttggtggcgagtaccacccatacttgtgcggtttgtgcatagacgacgtcgtagccgtgcttgccttgtaactggcatgtcaatatagccactagaatcatacaccgtgtcttcaggatgagcatcgtcgtcaccgctcacttcctcattggaaggtgtctccaacgcagcaacccgatcagttagcgtggatatccgcttgtccaacctctccatgtggttcaggaagccgattttagtgaaagtatcttggacagactttgcaacggcctccgtgatgtccttttgagtattttcttggagagttcgtagttgctcttgactgacacagtcagcaaaatcctggggactcttctcagcatcgttccctgccatggaaacaccaaaacatcaacaaacagtaaaggttatccctaataatctactacgcaggtgtagtggtgcctctcaatgattctcagcaatatggagtacttaaccaagctcttataaggttcttaccagcaatgcaaaggatacctggaagacgtagtcagcgattgcagggatcaagaacctgtgctgtcaagaagtaatatgtggagctagaaaggccagatatatgtatatgagtggtacacaatccaatgacagatagtaatgctgaataacaatcccaagtcacttgcccttagttgctggtctactcgtgtcctagacagtagtggtaacaaaaaaaaggctcaaggaaaatgacactagtaaacaacaaagaaggactggtaggcaagcttcggcgagtttcagcgaaaacaacaaaaccgaactggcagataagctcaacggagcgcgtcgtgagctcaatgcactagtggaaatcaacttttctttttctttcttttatttttttgatatttttttatttttctaggacacgaaaataggcacacctccaagttacagctcaatcggagttgatatgtggcctatggaattttctgaaaccactataaacaaggtgcaggaacatgtgagctcgaacagacaattttgcaagacaaatttcggaatattggattcgccaaacccaccagagggggggggggagaaacggatgtaaaaatttttctcttatccaaaaagttaaattttgcctgattccgagtccgtatgcaaaagttatggctgtttgaagtttcggcttccggctaggttttccagaggggatataacctagtctattatgcggtggaattgggatatggtggcagcggagttgtagggtgttctggtgatgcgtggtgatctgggtgggtgtttatgaaggtagaaacggctctcaaaggatgaaccctaacacacggtgaaaggtggcggctagggttacaaaggaaaaacacatgactagactaaaacacgcactagaccagcaacaggaactttaattaggactcaaactcaacactacggactctgaaaaagaatcatgcaaaggctaaaaacggtataggttaaggtaactaacgactaaatttttttttggcttttctatagactctaggataaatgcgaaaaaacaaaaactaatctagggtaaaggaactaagcgaacctgacggtgaacctagagctctgataccacttgatgtgcactagggttcccgatcttccgaaaggttctgatacacaacgatttgggcggagtcgcgacacaaattgatccgacttcttgaacacgcatgctcttgagccccgcaatcgcagcaccacgtctcctctggttatcacccgtgtcgaaacgcggatgacctcaccgagaaggctaatccctgtttgccaatcgaagaacacaaacaagaacgagatagaaaacaatcaaaattgcagatgaatgattaagctcacgagttggggtcttacaaaccgatctagcggcgaaactgttctcgacagattaatctaagcaaaacccaaaaacctaaagatggcagcgggtactgatatatatagtttagggtcgtgcaaaatcctctcgacgcaaccctaatgtgttttaacacaatacacgggccaaaggcccaaatatggtgacgcagcaccgggacaaattctggacgtcaaattgttcagtcaattcccattgactcggaaagaatttggacatgggacctaaaccattggaaaggttatcttcttagctttctatccatataaaaaacgcctcaatccgagcacgtatgcgacctgggcgcccgttttagtgcagactgatcctggactccgaattgcacccgacgtcgacttggtttgggcctccaccttgacttggacgtcctcgatgatcctccatggctctaagtccttctccaagtgtctccttgtcccctccattgttcctaatcacaatataatcattaggtagcaatctattatcgaattcatacaaagaagaacataggaatgagctcacctctaaatttaattgtcgcgcaggagctcttgttatcggtccttgaatgactgttagaggattgttgtgtgtattcgaggtagtgatgtccgcatcaagcccatgtgaaccagtggggcgacagttgggaagaacgctgctgggttttggcgtgtgtatatgtggcatgtgctggaaggttgtgcccgcgattgggtcaatgtgcaacattggatggtccttctacccatgtgtcgcagtcgagggttgtggtcttggtcgcgccggcgaccagacatcttgcagtggtcggccgatgaaggggcatcggttctctggttgtctcgtgcttgtaacactacaaaaatccttgtaatctatgacggacaaattctatcatagatcactaaaaaaccatcataaaccaatgtttatgacgcttttagattccgtcatgtattgagcgtcacggattaactcccgtgacggatttacaaaattgtcatagattgaacacgatccgtgacgtttcttaacggtaatagaagagttctaggccgtgtagcccaacccaaacccagtgtttattaatgggccaatataaaaaacagcccacttagtgtctcgacccaaccccccgggccgggcccgctaacacatggcagctctctaggatatcaagactttccagttggtcacccatcccaaaattactctaggtcaagcacgcttaaccgatgagctcatagaaaagaagttacaatttgttggtattggtattctataattgttattaatgggtaaaacaggtattatccaacgggtaagggtaaaaatgtgaaatgtatatgtgggtcccacattcaaaatttgctcaaaagttgtataaatttgcttttctataagataaatcaaccgtataaaatttaattgaatttgacaaaattttatagtgtgaacgcaagtttaaaaattttagagtccgagtttaacactatacaaagtataaaatgagtatgagcaaagcagtgggtcccacatttaaaatttgcccaaaaactgtacaaagttgcttctctacaagataaatcaaccctataaattttaattgaatttgacaaaaatttaaagtgtaaacgcgagtttaaaaatttagagtccgagttaatgctataaaaaaataaaatgagtatgggtaaaacggtaccctcttatacctaaaactgaaatggataatttctgaaatggataatttttttcctactcataccctccccaaataacatgggtatgggtatgggtatggattacccatatcgagtggtaggtctagatgggtccatgctaaccagatatgaaaagattagtccatgttgatcgtgacgaattttatagaacgccactagttagtgggctagattgtgatgaatttagtgaaacgtcaccatattatgggcctgatatccatactctagatccatgacgaaaaatagataactgtcatagattgtgcatagttaatgacgttttctgaatatgtcacaggaaatccgtcatagattaacatattttttgtagtgtaaggctggtggtcgttaagaggtcgcggcagttgggatgcaggcaggtctaggcgaaagctcagccagttcttttggccggcagcggcgacgtctttggacgccgcaaacctcttgagggcgctgtcgaggtacctctctcccccctcaatcctctgggtgaaaaccttgtccagtccttggacgggcgaccacaacgtttttagcgtcgcttccttcttgaaggcgtcgctttagaggtgttcttggtctgttctagtcccagcgaagattggtttgctttaggcggccgttttggtactaggtcacttccttagggtgtgttggtggagctagcacgtggcgtgatgtgttttttcttttttcctgattataatcctttttgttggattatagtcttgtaattctttgttactctcaatcttaatacaatgatacgcattccaagcgtattttcgaaaaaagtaaatactcagtataaagtaaatgagtgatgtttcttccttaccactgctaatgagggatgtttcttgatgtagcagtagaggagagcctgtgaatcatttgctcttcctattcgttaaagatgtagatgtggatgctatctgtattgataattcattggttaactcaataaggtgctgtgtcagtgagggatcaaagactattagtcacagaattttgatcaccatatacggtgaccatattatggttttgatcaattgatttccatttcttctaggtagttcatttctcagtctaaaccacataaatctaaagcatttagacgagggggtgttccctgaagtttacaaaggcagtgatggaaaatactgaaatgtgtcaatgggaagcgtgtagagatggctgtaactggttgcacttgtattgttcttatagtagcagtgcatcaatttgagtattgcttcaaccgagagagctgcctgtatggctctgataggcaaaacaagcaaacgcgctaagccgtataagtatcctgaactgaacggataatgatgttgctcttgtagcagtagagccagtagtgaattaatttcagtattgttgcccgtatggctctgataggcaaaacaagcaaacgcggtaagccgaataagtagcatgaactaatagtggtgttgctcttgtagcagtaaatccagtacttagtgaatcaattttagtatgagagcttcatccgagagatctgccgtaaacgtactagctagcagcttggtgctggggatatagagtggttacttggtaacaaagagtgactagcgcagagtaacctaccattgtagttcaagagagacattatattgccaggacgggcgctatgtaaacagggccatcgccgcccgtctttttcaagcgaccagctgagcgagatcatccatgaagtcctcccgcgtggcgagtgttctatctggtggcgtgcatactgcatggacgatcagtgtgtggcgtacgacactgatcctcctctcaatccagcacagtaagtcgatcatgttgcaacaatcaatggtactagctactccctccgtctcacaatataaaggattttgagtttttacttgtaacgtttgaccactcgtcttattcaaattttttttgcaaatataaaaaacgaaaagatgtgcttaaaatactgtagataataaagtaagtcacaaataaaataaataataattttaattttttttgaataagatgagcggtcaaacattgaaagtaaaaactcaagatcccttatattatgggatggagggaatagttattagtagtgtaattttgaactaattataaggagtacttcctccgttctaaaaaagacaaaccctggtttccgtgcccaacgtttgaccgtccgtcttatttaaaaaaattatgaaaaaaattaaaaagacaagtcacgcataaaatattaatcatgttttatcatctaacaataatgaaaatacgaattataaaaaaatttcatataagacggacaatcaaagttagacacggaaattcatggtttgtcattttttgggacgaagggagtacgtgcgtgctgtgtatctgcaggacctgccacctttccacatgacgtgatttcgttcgacgtcgcgcacggcgacttgggcgacctgatgtcgaggatgcgcgcgaagatcgatcattccgtactgcagcaattaacagggttgacggcaggcacgtgggtcttcttcctcagcagacgtacgtacaaccgcgcgcaagccggcagggtggctgatgctcgagctgatcgagaggcatcaacgagctaggaagatgacaagatcatgattgcgatccgcgtcaacaacctctactctctccgtctaaaaaaagtcaaaccctaagtttctgggccaacgtttaactgtccgtcttatataaatttttttataattagtattttcattgttgttagatgataaaacatgattaatactttatgtgtgacttatcgttttaattttttttatatttttttcaaataagacggatagtcaaacgttggacacggaaactagggtttgtctttttttttagacggagggagtacatcgcaggattcacggacaggacggggcgctagctggtacgttttctccaacaagctaggcgtgcttgcttcggcatcatacctggagcaacggtgctaatgaggctggacgacgactacttcagttcagcttggtcggcgggtacatgcagggcgctggggaacttggtagtcagcagggactccacgcttcgtgcgctggaggagatggcccgtcgccatccgaggacgccggctgcctcgcccgcgccgttgcggtcatggcggtaaccttctgtgagaccgacctcacgtttcatgccaatcatgctcatcaccagcgacaactggccggtgaacggcatcgacctaggtggcgcggcccctctggtggttaagtggaagactatgtcatgagctatcctcctcagcgttcagtacaacagccgctgggaccagtagcggagccatgataaaaacataaaaatatagtgggggctaaaccaaaagtgaccaataaaagtcaagacatgtgtcatgtaaattagctatatgtctaatccaaagtataaatatatagaattaacgaaaaataaacattatacataacaaagctttttgaaaggatctccattcactactttgccacttacgaggaaatgtgcaaatatctggtttcagatggataattctcaatttgtttccgtttccctagatcacgaatgatatctatgtgactaaactctgccctaggtctctttgactgacttgcaatctcattgttgagtggaggatcgctggtattcgtgttacttgaactaaaataatatatgagccgtgttctttttgacatcttcacaatctagcaatataacaaagtagcaaactaggaatcacaaataaaattttcaattcaatatctctatgatttcttgaagacttgaactattaataacaactagacttgacaattgaaattgattttaaatgacaaatcagaaattttatatacctcaattcctcaaatcctcgatctgttgttctgggtgcttgctgctaccacggtgccgccctttgctccttgcatagacgccgccgccgcgtccccccgccggcccgcctgccccctgcttgctgccgctcgcctgcgccctgcttgatgccgcgcgcccgcgcccctgactcccaggttcccccgccggcgccgcaactccgcttggactggaagccgtcgccccgtcacgcgactcgtgctcgtctgccgccgccacacgcgaacacgaacagaaggaggccaagagcgacgcctctctctacgctggaggtaggagattagggttgcgtggggttgtggggattttttttttggccttttcagccttttgggccttctaacaatctcaaacaaaatctatcttagctcccctcaggattaaaattgtagggggtattatgggggctttaataatttattaggggtagtgggggcttaagccccccacgctgtctccgccactggctgggacagccaggaagcagactctccgcggcgtgatgacttagggtacaaccgggcggacatcctgcatgacatccagctgctgctgtggccagtatggtgcagcaagcagataacctggctcagccccgcaattgaaagatggctgggcctgggctaatcagtagtactaattaagcagctattactagtccttctgcttagagagaatcccttatatgccattagaatttgaccagttctattatatgccacttaaaattgggttcttccttatatgccactagttcaagtttttccaccctttcataccactctcatcactatagtgttagttgattgttagtcaaaggttagttattttcgtaaatgaccaatatgccctctcaactaaaaaatatgtaaacttcagaaaatcataactaatttattttaaatcctttttgagtgaacaaaattttgtcagaaccagtgaaaaatgctctttatattaaaaatattgttggaaaactacatgtttcatacttacattgaaaatttatttgtgatggtaatggctaaaattgtatgtgatgtagaaaaaaaatcaatttttatatgttgtatccagtagctatattagtactaaaattattggttgtatactaattctcaagggcaaatgtatcttttttcaataaaattaacggtcaactgacggtggactgacggcgatggcataaaagggaggagaaatttgaatcggtggcataaaagggataagccaatttgaagtggcatataagggagccggttaatttagagtggcatataagggaggcggcggcggcgcaaccaacggccctggccgatggttgctgcatcatgcgcggattccccggcgaggctgagctctctctccctatttcttcttcagttgagccacctctcgatcagcacgaaaacccgagtcaaccacttctcctctttctccgctagtccttggttctgcagatcgccggcgacttgtttgccggagtcgtcggtggaatcaccttgtatggtgctggtgcatcttggtgtctgtgtccatcccacgggtgcaagcactacaacctgctcttaaagaaggtgttggtctctgggaggaaggaggagacggcgtgagcagctacattctccgtcttccttgccggtgagactgcggcacaagcggcggcaattggatttctgggacagcggcaacactaaacggctttgagtgcctgttcatcagtgagtattctattggaaatcttactttcttgtgtgctcaatgacgatatgggtctatagagattaaaggacaattctagttgcatatgtggccttaatcctgtgccaagcgacaaatttgctcttcttgtgatactagttaattatctgatctggtaacagctataaataaattgctttagttttgtgcttcagatttgcttttgatactgtatgtaatgtagagtattgctagtatttacacatagtattactatcctgtatcattgattcttagtctgtttagctgaatacattctgctcaaccgtactgcttgattaaatagacctttatgcacttctgacaccctacagtaggcaatttacgtgtgtactgttacctctgttttctgtttactgtatcacacattgaggaatatagttaatcagtgataattgaccctggtgttgtggaggtaggagaccagttctctggcagtccaacgcctgagttgaggaggctgaaaatctgtattttcagcagcccaacatctgagagccaataatgattagaattaatttgagcaacatgttggttgtcttatatctgttctttatcaattttagcacaattctatacaagtttggcatagaagttttatttttcaatatgcttatgaacatgtcatctttctgtactttgaattgtgttgtcatctttgtaatattaaatggaatgccgcacaggcattacaatagtatcaactgctgtacctaggattgtaatgctgcagtgctgcgctatgaatatttctactccttgttatacaaggtgtgtttgtgtgtatctgaatatttgcctattaattaattgccaccttcactcatttcgtttgatagtccatacaaagggattaacaattactccctctattctaaaatacaaggcatattataattgtacacgatcttcaataataccattaatttcttccataagatactattaaaaactataacatttacaccatctgaacacattcaaatacgaatctaatgatgtcgcatgcataacactaaacattcatattgttagtttaactattagtcaaaacttttaaatattgactttgtggaaaacaaggacgccttgtttttttaagacagagggagtactactgattaatcacacatgtcaattaatttcatttgcggattttgaaactggacttatacgtaggctgcaaaattcagagttgctcgacatatatttgggttacttgtatacaaaacttatttgaattacatgcatatgcatcgattttgttgtaagtcaactgtgccattcattatgactattatgcatgttagcctctttggttctgtcaattaatagccaatagagttcaagtgtacaagtactgtaaattaatcatcaagctgcattaatcaagctgaaaacttgaaactgaaagttttaacccttttacgtacctcattttccattgacttcatttttgtttctctacacattctagtgcagatcttttactgttgactcgaggtaaaatccggaaactgaaaatctcaaccccttttcaaattttcctaatcaataaagcaatttcttactttgatagctattcctttggcacaacatatgcatctacgctgcaatatttgcgttgtagtgtgcttatcatcaaatcctttgcttgttcttgtgtattatctaactaaattgcaataagtacaagcgtagccatattctagaattgcttagacaactccctgggttgagctctgaagttggtggttattttgtggcaaagtacaaatggtaaaaataaaagtagccttcaggcttcattttttcttcacattaaatagaaatgttatgtacattcttaatgtgcataaatcatgggcatcgatattttacttctttttatctgtttagcagatataactgacgactcaagggcagtcagctccttaccacaattttagattattgagttatgtggctcactgttgagtgttgatgaccgtaagatcattttccgatgtaagttggtatttacttccataggttgtgaaataaactgcagtgccattattatcgtaatatcacgtgactccctacagccttatgtgaatcagagtatcatatgccaaaaaagcattctctttgttcgtaggattcttatcttaattctgttcataatactaatatattcccctctgttgtggctagtcactactatgcatgacctgctgctagaagaatagacaaatttctttggtcctttatataataggggaatcgctagttatcatgccaccttaaaacttgaaaattttccgtcacctttttggctgcctgtcctttgttgatattcgtgagggatttgggcttctttatctggtttgctaagcatttttgtcagctcgttctgttcataactttatccttccctcgatctgcacgtttcacacccacatatagattgtttgttagataatgaaagctttttaccccgacatatagatagatagagatatagagagatcaaggactgtatcagccactcgactttgaaaaggagcccgctatgtgtgagggttgaagtgcctgtggcgtcgagccctccagccaccaggttggcacatccccgtctgtcaccagctgtcctcaagccatctgtttccctcgtgacattggctgttttgccaagtactgctagctgctcacctcatggtatgaattcttgatgatctgatctactcctgatggggatccaattactcaattttgtatggcagaacattttagctgttgcaaaattacttccaatttttgcttatttatgggctttattcttgctaactgaagatataaagatgatggaatgtatttgggaattttggtagtactcgtcctgctttactaattatactgttaacagtcttgcaagaagctttacaaactcagagatgtcactgacccaatcagacatggctatgtagacgttttggatgaatggttcaatgaagagcctagcctttttgcaaagatgacctgaactgggagagcatagacgcaccattttctgaaccagcttctcatgatgaacgacctgtcgctattgacgaggatgaagctccatcaacattgtcgtcccggccggcagcatcagcagtagatttatattgcccaacacctgatgatccctatatgtcatccaagagaatgaaattgcattcctacctttttgaaacaggaacttcttttccatattgaactatattgtcattaggagtaggacacatactaatggttttgaaactttccctatgcatgatttgtggtggtttgctaaatctggccatttaggaattgtaatctactttcttcctgttacagtctgtggcatgtgcagagtttctttttccttctttctctgatctgttagttttggttgccagtgcttcaggcatatgatgtgatgccaaaaaaccaaatatatgcgagttctaaaatgaagttgaatgtaaaggttctgaaattttgatttccatactcccaaactgtacttggatttaacgtgattcacaattagtttctgtacatgttcatactcacttgtgattcacattgagcacacttgtcatactcaaaaaatgatttgatcagccaattcaaactcttgtactggtgcctataaaaacagatgtcgaaatgttgatgggtgccaattcacactacatagtccttggttacaatcattacaaccaatcattacagacgcaaatcagtaaaacaagccatccaagctgactgcacatccccaaatgagggaacatgtcgattgctgttgcctctggacgacgtcgacgcaatgccctgaaacgggaacatcaaatgaaaacttgtcccaactatagattaaaattaaggaaaaattggtttgaaatttcccgggtttagttttataccatcaaactacacgttaccacccaaattttcctccgttaaacacttgtgttaccttccgttacaaacttttcccctaaagccttcatcaaattgatcagatccaagtccaccaatacagtgttcctgaccaaatgaaaagaggtccaagttggtcgcggtcatctcgtcgacgacaagcgtgacgtccccatcggcatcggccccaacatccctagcatgtccttcaacggcaaggccttctccatctacctaccccctctgcagcacgtgcgattgagcggccaagctccgccgtcatcgacggcatgcatgctctccgccgtcgacaattcagccgccgaccccgtcgacgtgaactacctgaccccgccccaaaagtgcatcttttggttcctctgcaaggcgctcgtcggtgaccggttggggttcttcatctgcgaagcattgcattgcataggcttcaatctatattgtcgctgatgggcattctgcagagcattattgtcgctggtagatgttccaattgagttcagttccagtgttcaatttcagtgaaatgtgatgtcacttttcccttttcaatgttgaaactgaaaactttctagttttcttgacgatggtttcagcaaggagtggtcagtgatagatgttctctgctgtaatttcagttgagttcactttgagtgtttaattacagtgaaatgtaatggcagtactgatgcaagtgaagagcaaggcaacataaactcagaccatcatataatatctcaatatcagagcatcacaagaatttcagactatttcaaaaatttcagattgtcacaaatattcagaccatcataaaatttcagactatcacaaatattcagaccatggtgaaaaaaaattcagacaatcataaaatttaagggcatcaccgatgtatattgcctaagttggtaataaggtgggtccctttaacagtaggttatagttgtttcaattgtcacaatgtatactagtaggaggtggtagtaaggtgggccacattgcaacaaaaaaaatattgtgagaatgggagagatggctggtggaatggagagaagagagattgtaatatttgtttaattatacaaccgggtagtagtgctactaccgaatattagtacccaccttgatacctatctccacaatgttgaaccaggtaatagggcctcctactacccactttttaccacattgtggatgcccaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5226 - DNA, 838 bp, Oryza sativa
gatgttggatgaatataaaactcctagaaaattttgggctgaggctattaacactgcatgttatatttcaaattgagttttcttgcgatctaaacttggaaaaacttcttatgaacatcgatttggtcatcaacccaaagtttcacatttgcgtgtttttggttgcaaatgctttgtcttgaaatctggaaatttggacaagtttgaggcacgttctaccgatggattgtttcttggttaccccacacatactcgtggctatcgtgtacttattttggagactaacaaaattcttgagacttgcgaagtttcttttgatgaggctagtccaggtactagacctgaaatttcaggtacactgtcacaggttcagggggagaatggttgtatttttgaagacgagagcgactacgacgacgacgacgaggtcgactcggccgatcagaccgggcgccaggccggtcagaccgccggcacacctccggttagactggcacaggaggtgtggtcagaccggccagggtcgtcggccgagggttctgttgatgcagatcgagatggtcctccggagattactacttcgaccagtactgatacagaacgtagatcaacttcagaaatcactgctcctttgcacatttaacgacgacatccgccggaacaaatcattggtaatataggtgagcggactacaaggtctaaggtaacgactcatgatgtttgtgtaaattctgattttgttgcttcttttgagcccaaagatgtgtcacatgcattaactgatgaattggggattaacgccatgcatgaagaacttgaaaattttgagagaaacaaa

SEQ ID NO: 5227 - DNA, 13927 bp, Oryza sativa
gattggttctacagctgtgttggatcctgatgaagatggtgaagctgttgatcaaaaggaatatagaagtatgattggatctttgttgtatctactgcttctaggccagacatacaatttgctgtgtgtttgtgtgtgtgctttcaagcttctcctcgtgcttcacatcgtcaagcggtcaagcgaataatgaggtatttgaatcatacacttgagtttggaatttggtattctacttcatcttctatatgcttaagtggatattccaatgctgattttggtggttgtagaattaataggaaaagtactagtggaacatgtcattttcttggtacatcattgattgcatggtcttctaggaaacagtctagtgttgctcaatcaactgctgaatctgaatatgttgctgcagctagttgttgttcacagattctttggcttttatctactttgaaagattatggtcttacttttgagaaagtacctctcttttgcgacaatacaagtgttattaacattgctaagaatcttgttcaacactcacgcacaaagcacattgatatttgttttcactttctgagggatcatgttgaaaagggagatgttgaattgcagtttttggacacaaagattcaaattgctgatattttcactaaacctttggattctaatcgctttgcttttcttcatggtgaattgggcataattcatccttttggcatggtttgagggggagtttgtacctcatggttttatcaagcaaaaatataacaatgagaaaaattgataaaagaaagctttgtttatgcatatggtatttcttgtgcatgctagcaatactttgaaggtttatttgtctctagcatagcttgtatgtattctagtcttttcatgagatttagactttgcttttaagggagatgatgcatgacacttaaattctatacttgaattaagtaaatatgcaatgttgatactagcatatggtttgatttataaatgctctatatatatgctttattgacttgttattcctcaaatagctttacttgctcattatgaaaagagaataaaaagaatgaaaaaaatgaatatcaaatccttggaaacagtctgacgacaaggacatattcgatgtgagcaaaataatgggtgccgaatctctggaaacagtcttgacgacagggacgtacccggaataaaaaagagaaaaatatgagcaaaaaggctcaagaaaagaaaaggttaaaaaattctcttggttattttatgctaaaggttatttgagaaagagtgataaatgcaatagatatatgtgtctagtgtttattcttcaacctatgtgcttgttaagatattgcattataaatcgtatgaaatcatgaattttaattgttgattcaagcttaattgtaaaatatttggttcatggttatactttaatgcatgcttgttgtgttatagatgggttcatcttctttttattgtaacacatgacttgatatgctatatgtatgctaagctcttatatattaatgaacataattcctatgcttgatgaaatcattgtcaaaagggggagaagtaatctaaaatttttttagatttttggagaagcaaggtgaaattttggagagttgttgagaagagtatatttttggttcaattggcaatttctttcttttaaaaagggggagaagttttcttttggatttttgagcacgatgtgtacttttgtacaaagtgtgctttttaccacttttgtttttatttttccaaacaccaaaacatttttaaagggtttgccaatgtgttcatcaagggggagattgtaaaatcaaaggtgtttttgattattattctatgatgaacaattgggcattggagattattgcttttgttatttggaatttatttacaaagtggttttggagattattggatttacaggtgaatctacaggatactgttgtgattttatgtggaccggtcagaccgggctggtgctgccgatcagaccggcgtgtattgcgcggtcagactggcgcagcccgcggtctgactggccgatgctgtgtcggtttcggtttcgggttgtttatttggatatccgtgattatttcatgattatggcttctagatggatactatacgtatgtaatactattgtttgctactaatgagtcaagttggagataacttggtctcggaatatggtttttttgtttgttccatgtgtaggtgactcgatgtctcgggagagtatttgcggtgatggaccgggagtcggcttggggataagacgacgtccgtggtggtcagaagtcatgcgggatactaaggctagagttgatgcatgtggttgatggagattccatatggcatacgatggagttattgtgtgtgtatgggatgcggagtcgaatttggaaggagtccgaatttggtacgattggttatgtaaagtttatttcttgtgctagagggtttcctaaggtgtttaggacccctattatgagtttggttcgtggctttaggttgcctacctcaggtataaatagagggggagcgtgaggcttcccggtatcgcttttgagaacaattgagttgagttttgagttagggtttcgagtttagtcaaaatttttgtaaggagtgctgttggtgcactttgtaaacacagagagaagtaataaagttgtcatccactttaagagttcttcgatttgtgtttcaccgagtttcggcggtctaaccgccgatatactgatggtcaaaccggcgggaagcggcggtcagaccggcggtggctaggcaacaggcgcggcaagggatctcggcggtcagaccggagattcaacaccggtcagactggcggcatccactcggtcagaccggcagatcaatcttggtcagaccgatctccatcgatttcgagggtaacttttatttccgctaaaagattttggttttggggtataccaaccattcaacccctctggttggcttagtttttgctattcgatcctacaattcgttcaaccgttgctaggaacaaagaataatccaagcataaaccaacccaagaatacatttttttaatcttgtctggtgcgagattatctcggacgacaagatcaactgtcttttgtcgctccggtaccaatatctatcagtcttttctcgcaaatgtataccaacttaattgctcttcagcaccaaacacaaccaattatctgcatttggaaaagcctgcatagatctacgcagttaatatgaataggtagcgaacttcattgatcaggagagtagcagggctagataaagaaaaaaaatgcagatgtgaaataaatctgaagagtccaaaaactcttcattgcagcggacaaaaactcttactgtgagttctctatgaacttcattgcatatcaaaaactcttcaatatagtaaggttttttttttggaaaatcacagtaaggtatcaattgataaataaatgagggctgctacagaacgggattctgttgcaacgggatagacatattaactattctcttgcatgagtatcacagatatcaggtcctaggtattacaggtatcaggtaacaagtatcattggtatcgggtaccatgcagctgataccacaagaggtatcaggtatcaagtacaatctcatatcaaacgggataccgttgtttaggctttctgtacataaatctgcccttttttttctgcgaacttcacattaaggttccaaaataaacaaataaatctgaattgcagcagccatgttgaattggtcatctgaattggaaatatatcaaacaataactcatactacattagttctttattttcttatgatatttttggtgcttgtttacaagaagaggctgctttgtgcatctaatttacacaatcttctcctctcatcctcgatctaatgaagagtcctctcatcctttacctatatttggagcaatgttgacatcatacatattagtgtattatgcagaattcagagaaccaatgcgacaacctagataacatgaaaatattgtagtgtagtacttaattattggctcaccctgaacatacaagcatcaaggtcaacaatatattaattatcaaatttcagacacataaatgaacagtcggacaattatatatgtttctgtaagatcaatgtgttttgattcttattctgtgatgaacaattggcatttgtgattattggttttgatatttggagattactgttgaagtggttttagagataattgattttcatgtgatgaatagggtttgctgttttgtcggtaccggtcagaccgggaggtggttgccggtcagaccggcttgtgttgagcggtcagacgagctggcccgcagtctgaccggccgacgctgtgtcggtttcggtttcaggttgtttctttggatatccgtgattgtttcatggttatggcttctagatggatactatacgtatgtaatactgttgtttgctaacaatgagtcaagttggtgatagcttggtctcggaatatggtttctttgtttgtttcatgtgtaggtgactcgatgcctcgggagagtatttgcggtgatggaccgggagtcggcttggtggtaagatgatgtctgtggtggtcagatatcatgcgggatacttaggctagagttgatgcacgtggttggtgaagattccatatggcgtacgatggaggtattgtgtgcgtatgggatgccgagtcgaatttggaaggagtccaaatttggtatgattggttatgtaaagtttgtttcttgtacaagagggtttcctatggggattaggactcctagtatgagtttggttcgtggctttaggctgcctacctcatgtataaatagagggggagcgtgaggcttcccagtatcgcttttgagagcaattgagttgctagtttagctagggtttcgagtttagtcgagatttttgtaaggagtgctattggtgcactttgtaaacacagagagaagaaataaagttgtcatctactttgagagttcttcgatttgtgtttcaccgggtttcggcggtctaaccagcatctctccggcggtcagaccagcggcaagcggcggtcagaccggcggcgcaagggcggtcagaccggcagcgacttcacacgcggcaggtgatctttaggcggttggaccgagtgatcaacaccggtcagaccggcggcacgagcgcggtcagaccggtggatcaacctcggtcagaccgatctacatcgaatttgagggtaacttttatttccgctaaaagttttggtttttgggtatatcaaccattcacccccccccctctggttggcttagttcttgtgattcgatcctacaagtggtatcagagcctcgttttcttctttggactttaatcgatctagagtttttgccatggctgctcctgttaggttttcaaccaagcctcatgttttcgatggaacggatttttctcattggtgtagtaggatgcaatcttacattatggatgaagattatgatatttggagaaaagtttctcatccttatgtgattcctgaagtaattaatactgctgctgcaaaaactgagtttgaacaaaattgcaaagctcgcaacattcttttgagtgggatctctcgttcgaattattatcgtgttactcattttcaaactgctcatgagatttggattgctttgagtaattttcatcaaggaacaaataacattaaagaacttcgtcgtgatcttttcaaaaaggagtacattaaatttgagatgaaacctggagaaactttggatgactatctttctcggtttaataaaattttgagtgatcttagatttgttgattcttcttatgatgctaattatccacaatctgagatttcttcttatgatgcgcaagggcggtcagaccggcggcaacttcacacgcggcaggtgatcttcaggcggttggaccgagtgatcaacaccggtcagaccggcggcacgagcgcggtcagactggcggatcaacctcggtcagaccgatttacatcgaatttgagggtaacttttatttccgctaaaagttttggttttggggtatatcaaccattcatcccccctctggttggcttagttcttgtgattcgatcctacagtttcaagcttaacaggcacactcaacctgcacttgacagtgccaaaaatacaaacaaaatcatgaataatgttttgcaatataactgcattgtgggcggtggcttcttgggccgtcggtcaggcctctcggcattggtatctcaaattactgaattgctgtaggaaaattaaacagtaattataggtgtgacaagcaactattgtaacctattgaatgtcttgcttgaggagccaaacagcagaactgatatgctcaaatgatgaggtgaaacagtgaaagaaacgtgaaaaacataacatgattcataatacacccaaaaatttaatgcattattacaataggctcaatcagagcatgtcatcagataggtacattcggcaaattcatttccctgaaagacaatttttttcataacatacagtagtactccctccgttgtgcttaaagtacttttgataataaagtaggtcacaaataaaataaatgatagtttcataatattttaaataagacgaatggtcaaactttacgagtaaaaaagtcaaaacccttgcattacgaaacggaggtagtaccttgtcgaggggtgatcctctctagcgggaggtcgtgagaccccctttgtgagttcggccgggggagcaggtgagatccgaggtccctcgagacaaaagagacacaagggatttatacatgttcgggctgctatgaagcgtaataccctactcctgtgtgtatgatgattcttctatgcttgcaaagcctctgaatctcccaagtacaagctagggttagagaagctttagtttggggatccagagtccgatccccactctcgctaggcatggtcctccttttatactctaaggggatcccacatatgctgcgggtactacctagggaggaggaaaaatattctctatattaattacatgtcttgtgccttagcccaaaagctatctgcgcgtcggctgctgcgtggggcctatcagatcatgcggggcgcccttgtcattcgccgtttaatggttgaggacttccgggttcctattcacaccaggaaaaaggtacccgggtcagttcaaagtggttggaccagctctgaccgggataagaggctgtgaagcccctcatcattatgatgggacaggatggagcacgccgcctgacacactgacaaggcgagggtacagggtcgccgtcccatcggtcattcgaccggtcacaaatcggtcagatgcgcagcacgccgcattaaatgcggcatggcgcggctgcatagaccgctttaaatgtggttaggtggacgttaggcgtgctcacctaaccctgtacacgtgggctgatacgtagagggggtcgggaaagctcgtccccaagctgggagggggcagccgccgcttcaccccaggctcgacccccccacgtgggtttgtgggcggcctcctccctctagctaggaaggggcagctgccgctccaccccgggctcgacccccctcggggggagccacgtgggtttgagggcggcctcctccctctagctgggagggggcagccaccgcttcaccctaggctcgaccccaagctaggagggggcagccgccgcttcacctcgggctcgacccccccttggggggagccacgtgggtttaaggtggcctcctctctctagctgggagggggcagccgccgctgctgccccgcttcaccctgggctcgaccaccctcggggggagccacgtgggtttgtgggcgggcctcctccctctaactgggagggggcagctgccgctccaccctgggctcgacccccctcagcgagagctacgtgggtttgagggcggcctcctccctctagacgtgacacccccgggcccatatcaccgacataccttttacatttgtagggtgattctctctcttgtcccaaagagatatgccgacaggcagtaaatctcgaatcggctgtatgcgaaggataaatcattcaatagtcaatcttcattagaaataattttaataggtcggacctaaccgatgcagcacaagattacaaccaataaagataaactatttcagatctaatgaagtaaagctcttagccgatgcaagtgaagaaaagataacataaaaatataaactatcggctgaaaccccgatagaaccatacgcatccttagccgatgcatctaaaccaattagctttgatcttagcccgaaggatcggacctaaccgagacagcttgcgccaatatcatcactagccgaggcaaaccgattagaatattggacctaaccaaggaagacctaaccgaggcaaaccgatacagatgcatcaaaatcgatctagaatctaacgatgtatatgatacgcgacatgcgtatcagtagctgagtatatcggacctaaccgaggaagtaccagctagccgacgcgcatgaagtttgacgagacatacctcctgccgtagttcgaacctaatcgatgcagcacgacccaaaagcacgatctcatcgaaaaacctagcgagcaagagtggcgatgcgccgaaattgttgtattgattgtgtgtttacaatacccaggtgtacaacatttatatattttgatttgcacaagaacagcattgtacacaaagtcaaagtcaaatttaatagggggttgcattattaccgatagtatttgtgtactggcctccctttttttttatctcttcccataaaggatacttgcgatcaggttttttagtagcctattactgtagcagtaacaaggcactcatatggggcaccatggtgcccgggcaccatgatatgaaatacacaaatttgcccaaatttttaaaaattttcaaattgtgagtatatacctagttataagtattcgattcatacctatacctagcaacaaaacaacataaatctaactttatttcacaatccaatattgcatacctaactaattatatgtttggatgctatatacctagaatcaaaatataataaaaacatgtttaaattcaattcaaacttgttttgaactagttagtaaagtagttaatgttaatacctaaacatttaaaaaaatctcatactcatttgaattgagtatgtactcaatttgaatcatggagcccgggcaccatggagcaccactctcgcccccatttcatttttttcctctttttttcgaatctgaatcgatccacctgaaaggaccttgatgttgcttagagggggtgaataggcactcatgaaatttacttctcatcgtagcggttaaaattagggcccaaaacttactggcaaaaggcccagaacttcctggcagttttttctaccgagcagagaaagctacccaaaacttctgggattcttcctaggaacttccaggtagttgtgagttgctctttcaagcacctcacaacaaggaaattaattcacaagagtaatacacatgaaactacacaagatagcacaatgatcatacaaggggagacacgatagcacaacttagacaaataaggggataagcatcacaattataaagattaggagagtgagaggagacaaacgatctgtttcccaaagttcggatgctccaccgagaatcctacgtctccgttgaggagctccagagagccgggtcctgattaaccccttgcctcactaagcaaaggcataggaagaggtctccaatcttcaaaccaacacccctagatacttctctttcatttcaaatgaccactaagatccccaactagaacaccaagagaacaccacaagtgaggcttgctctaccaagacgacctcctaaacctcagctcggaatccactcaccgggtattccgtttcctttcagaggtggaataacgccctcacaaacttcccgcaactcaccacaagcttgggagctcaccaggcaacgcctagccgtctaggaggcttaacctccaagagtaataaacacaaacgataatttacttgctatgaactaagtgctcaaaggatggagtgtatctctcaagctctcaaccttggaacctctcaatctctcaaatctcttcccaaatctcactcataaagatctaccactaaggtaggaggtttgggaggggctatttcgctttggataggtctattcttgcctaaactcagcagccaacacatgagagggtggaggggcttaaaaacccaagccctccaaaaactagccgttactcacataacagggcccggaactttctgtccagaccaggaacttcctggcaccctcctcgaccaaacagatagatcgagtcgaaacttcctggctcagaacccagaacttccgagcttccctaacatcacttcacaaaaacggtcataactccttgctccggagtccgttttcgataaacttgggctctatggaaagcttattgagagggctaccaaacccaaccaaaaacaagctataaaaccactcataggttaggttaaagctttggtttctctcaaggtagcacttgcataggtcactttgaacaccgaaacataaacaaacacatcaatgttgcatccctcttaatagtacgacattcctatactcaaatgcataaagaaaagttataccactatgaatgccttcttgacatcttcttgcttcaccttgagggttgccaacgtaaacgtcattttaccattgcgactattctcatctacaactcattaagcacattagtcccaaatcaattatacttttgccttgatcaatgcccactttggcttttgacttgatgttcatcgaagaaccgcatcctcttgattttcgacattccatcttccactcatcttataattgatacagattactcatagcttcaaatggcctcgtacggttcatcatgacaaagccttcactcactcttcaccaccggatttggtccatcggtgccaagcctcttgttttcccttcaccatcgcatggccaattgtaaccgagccttatttgcccttcaccgttatgccatagatacacacttcataccccgcatcatcaatgtcttcacttgctcctcatcaaggtataatgtccatcttctagcttcggtcttttaacttgatgccggaactcaacaatgggttgtcattaatcaccaaaacaatcaccgcactcttagggtcataaatcttccaattccccttacaagacaaccctagggcatagatctttcaccaccatcccagctcacagatcggtgacgcaccatggaggaggacgacggcaccgttgtggttgatggcggtggccggtggctattgaggcgaagtcattgcttcgggcctcgctcccgaacgccgggcaacaccttaactagcaaggaggtgttcacctgggccaagagcaacaactggcgattgctccacgtcggcgacattgacataacaaggaagaaaggaaatgacactccaatttgcatctgcatactctccttcaccttcacacatgaagccccaatttctttttgcaaatcaaattaatgtgcaatctccattattacctgatctgaattgatgggctacacaggtcctacatttgcacatcgtgctccatgtggctggctgcagaggatagggtggagtccgccggtgatggaggttgttcgctatttttctttttctcgtcgtctctatgacatgaacgagaatgtttttgcatttttttcgtgcttgctagagatggatggctgctactgcgcagtgtcaagctcatctctataccacaccgctacatccttccatgactctatcgtcgactaccgctcgccacccgattgccctctccactactagtcacaaggcacagaccagtctcttcatccttatagcaaaattcggcaaagccaccatgatcccagcttcacaatagatttttggctgaatcatgttttttgcttttctagtttgattcacttgtgggtaattttatcactcgtgtgtgattgagccggtaattttttcattcgtactaccattttatgatacaaattaacaatactcttagcatcagtttttactcttatactgtgtattaaatacatcagtaaatatattactatacggtgactatgagatcatgggcaatatcaagaggaatgtggtaattgttttactcgcagaccacgaagtctaaacaatatttatagcactggtaaaagaattactggcgttgtaagctagtagtaattcttttacggccgtctaggaatggtgacgtgcgctgtggtcgcattcatgcaagtaaatttgtttcttttgaaacgggcattcatgcgagtaaaattgttgcttttgaatgagcaaatgtgggaggctgggactaaatgaaaaactccacagagtaaatttgttacttttgaaacgtgtaaagacactagaaaaatagaaaactcggaaagaaaaactagacggtaaatattttattaagacgcgaaaacagaaaaactaaagagaagcaacgaaaaatggaaaaatatagatggttaatattttacagggccctttgatgaagcacagatgagataaaaaagagaaaaaagaaacacggaaagtagggtggtaaaaaacaaaagaaaacagacaggacaggtgtggtggtaaaaaagtgaaatccgaaacgagggagtgttgtgtggcgctcgaactaatattccacgcgctgtgtgcgtattagcgccatcgaacattttcaatacaaaacaagtatattatcaaaatatattcaatgctaatttttatggaactaatttggtgttataaatattgctattttttttctaaaaatttggtcaaagctagagaactttaaaaaaaacgacaataatatggaacggacctatatatgctgtgcaattagtaatatcgtttaatcacctgatatattacaagtagtgcaacttttcatagttaatctatacccatgccatgcattatcatgcatttccaaacgacgcaatcaacgtaacaaaatcaatactggtttgacatcatatatccatctgtatctggtagtaagtaatatctatgataaaaccatttttcgttatatagctaaatatatactgtgacaaagttggtacattagcccatctaagtgcaaggggacacatgttggtacgcaaagcatatgaccgcccgttgacaacgcctgtgcccatgtggctagttgggccattagcctgttcacaatttgtttcctaaaaataagttcagtttgggtccctctatttgccgtcgagtctaaaattcatcccttaaccacaaaccagatacaacgcatcccccaacttacaaaactatgcaaacaatgtccctcggtggtatcgtccctagttttggctgacgtggcacctacgtgactcctttaactgggtcttcgtcctatataacattgacatggcgcttgcgtgacaattcgactcggaaaaataataaaacatatggagcccacatgtcagtttcacataaaaataataaaaacggtgggatccatgtgaccccacatgtcatctcactactcccctcttctctctattctccatgtcatgtagcccccacatgccgctgccggagactgtcgccatgcaggcccgcacgagcggtgtcatgaacttcaccttcctctcgaggccttcgcgatgcccgccgggtgacgagagcaagtcggcaacctggtcggcggtgggcacgttgaccgt

SEQ ID NO: 5228 - DNA, 10933 bp, Oryza sativa
ggcccataggttttattatttttccaaatcgaattgttatatacgcgccacgtcaatgccacgggacaaagacttagtcaaaggagccacgtagacgtcacgtcagccaaaaccaagggcaatattgccgaaggacctcgtttgtattggttttgtaagttgggggatgtgttgtatctggttttgcggtctagggacgaatttcgaactcggtgacaaattgagagacctaaagtgaacttattttgttttcctatgtttactctttaattagctgggcacactttggtcacagcacaagccgtagaaaaaaaggttcacagttaaggtttctcatcttatattcaagtttcaaaatcatccctaaatcaaaataccaaatataacgcgcttctaattttacaaaatcagataacctccgttcttggtgacgtgagggttgagtcagatgggtcgcacgacctccggttcctcgcgcgcgtggtgggacaacctcaagggctcgtacgtggagacgaactactcgttctatgtgcaggacatcaaggtgagcactgagcaccccgtacgtagctagattctgcatgagccaggcaggaacctcgcaattgtaggcgacggagggagggaggatcgccagagaactaactggttggcctctcggcgttccaggcgcgtgctcggatctagtcttgccgcggcgccggcgtgcctgccaattctcacagggtagtgctgctgtgtgttacggatcggagtatatgattgcatcggagcttcagattagttgctactactatacttaggctctcttttgtttaggcttaaaattattgtcttagaattttaagtcagcttattggcttatatgatttacaagccggtggatttaatgtcctaagtttaatgatggagtaatgcatctatctcatataagccaaaaaaaacttatccaacctaacttttgacttaatagtgttagagtggcttatggcttcaaaaaagccaaacaaaacagccacttgtttgtttaggcttagatttttcggccataagttaacttataagcctaaacaaagagggtcttactagtccatgtttgagtgttgcaggataaataatacggggaatgaaaacggtcggaaatggtacattattttattatttttttcgaaaacgaacggaaacggtccggaaattttcatatttatgaattcatctatttagtgtcaactttaatgccacgctgacagaaattaaaaaaactaaattttgaaaacggtaacatcggtaaaattattattattatattagttttacggaaatggtatcggtacggtcggaaaattttcataccgttttcaccccttaatacctcaatctgccgctgctagaagaagtagtagctgtccaccagtggcggagctggacagaaaatcaaaggggggccagccggcttttgacagttcaaaaaattagcaatttctcttttctttcatgcattggcaacacgtaaaagcgaatagtttgcaaaagtcgacaacaaagatcagctacagatgtcagattttaaaatttaggatttgtggatacatcaagttcatagtgacgtaattgacatctcaaattggctctctcttctaaaaaatcagcaggatagaactttaaagctagagagcacactttatcaatgttgaactgaatgaatcacttggatccaaagatgtacacaaagtgagaaactctgttgcttattcactgaatctgctatgatatatgggggtaataaaaaattttgtttttattggaaggggccatggcccctgccagcccccctcagttccgccactgctgtccacgtagcgtaaaaccccagcaccacgaacagaaaccacgcgtctacctaccatcttttttttttagaccgcacggagtcatatatatctacagtaaaatctgccatggaaaatccgtccatcacgctagcctaagcggtttaattagtcgaaattgaaagcaacaggaagcatgtgtgtaatcagtaacattgcaacaatataggtaaaccgagcaaatcatgcgtgcgtcatttaatttgtatgttcaagtaaattccagttaaaaaataaagtaaatctcacaaaactatatatatactttgatgaaactatcacaaaactacatacatatttaaggaatcgatttagcagtatatttatcataaactatatatttaagatagcctatcacaaaactacaaagtaacaaatttatcccaaaactatagatttaataccaatatatatctaataaaaaatacataaggcttctaatagtgtaatagtgatagtgatcccatgttttaatttattgcttgggcacaaaaccaaggaaggattttaatttactttttcaattatagtgcaatagtgatcccaatgttttagtttatttctcatctcctaatagctgttataccagtgaaagaacgtctttacctgttgcaacgcacaagcatttttttctagtttaatcataaaactgcatctataactttacctgttgcaatgcacaagtattttttctagtataatcataaaactgcatcatttatagctctaacataactgtagtgctagagatttgaactctaaaatttataattttgtgataatttcaatattaaatctgtagttctatgctaattttaatattaaatatgtagttttgtaatgcttagccttaactttgtagttttacggtaaaatttggtattgaatctgtaattttacgatacaacactttaaatatatagttttgtgatagtttaatcaaaatatctataattttgtgaaaattactttaaaaattacttcctaagatgtgtagcatattttgattttagaaaatcaatctttagtataccaataattagttaacataacatgtatagaacttacaacattagattcataattcgaaacattatcatataaaaactttctattgcacataataaatgctctctggtccaaagtgaacaatcagagtacctattattcttcttccactaatatttcaactataacttcataactccttcaaaataatttgccacaacattaacaataataaaattttgaagtacattagtcggggaggactatggatcggacgtcaaacgttttgcaaaacatcggatggtgttgcacaacattgttacaaagtgtcgcatatatttcatcgtttgatggaaaatgtttcaacaaaatatagagaataatgtttcattgcatggcacaaaaatgtctcagcccttgaacaaacatggttcaacatatagaaaaaatgtttcaacaatttaaacagtgaaacacaatcgaatcattcttgaagcattttgctataacacatgaaacatcgattttgagctactgaaatatccaaatactttgaaaaaaaatgaaacacaaagaaaaacaccgcaaatttttggtcttcctcctttctagtggcaggccaccgtattggcaccggattacttatactccatccatgaagacactctattgcattctctagatgatccacaccgcgtacactgtccttcctactaccgttgttgacgaagatgaggctgagctagtcccctcattgctggttcccctcccttgatctagcgccctgagcttagcatggtcagaacgccggcctactacatcctggcaatgtggtgcagagcaagatgagtcgcctcatgctcgccatcgagcattagcgatggtctcagcaactcggctccatagctgctccagttgctatggggagagaaggggaaaaataaatgaccgggagtgggggagtgggaataagattgactattggaaagaaaaggagatgtagataatgattagataaaagtgagacagatgcatttaatatttcctcgtacgccagatggagatgaagcgttttcgacattagtctccagcaaaagagcgggaaatatacctattttgtcctacttctacgagcatagaaaaattctccatcctccctctccagtctcccaacctttctctctatatccacgtaggcatccatgtcatccattacggtgacggggccagtgttccacgtggcattcgtggcccgtgtgaacgcgtccctgcaccccgcaccggtgggggcccagattcctcaccctcactgacccacgggccccacccgtcaaacgagcggcccacccgcttcccgaaagacgcgtcacgcctcggccccacggacgttttgttaccccacccggcacctactcgccgtccccaccactccacagtgccagtgacgcgtgggtcacacccgctcccttggtcggccccaaaccctcccaccgcccacctgagcgagtggggcacgagtccctatatatataggcgcctctctcctccgcccccgccgaccgccgcgtgctctctcctccgccgccgccgtcgtccgccgccgccgccgcgtcacacacacagaggaagcaatcggctgcccccgcctcctccccccatcggctgcctctcttcgcgacggagagaagaggataggaccccgactgcacgcaaacgcgaaaccctaggctcgtcgccggcggcggcggcggcggcgaccggtggggagatggcggggcggcggccgctcttcgacctcaacgtcgcccacgaggattgggattgggagaaggggaagaggcggaggcggaggaggaggagcccgaggaggttgttgaggaggggaagaaggaggtggtagtgctcgaggaggaggaggaggaggaggagccccatgaggtgatcatggaggaggaggtggtggaggaagtggtggaggaggaggcggcggtggcggaggaggtggacggggaggtgaggaggaagaggaaggactgcgaggttttggtgggagggcttccccgggacgcggcggaggaggacgtggcgcgggcgctcgcggacgccggcgatgtggaggaggtgcggctcgtgcgggatccggcggacccgcgctccacacaagggcttcgccttcgtgcgattcgccgccgcctggcaggcgcggtgggctgccgacgacgtccgcacggccatggtattgtgtccacccccccccccccccctgcactagattcgtatctccgactcgttcgatttggatagagttgtatctaatgcgaatttgatatgttgagaataagtagtttgggaaaaagtgttagctttagtcatgcttgaagtagagctgataaagttagtggtctgggatgcttcttgttcactaatttgaggtaatctatgcccttgcaatctcgttttgttgttggcttgtgaaatttgaattagtggatgtggaattagataatgagattaagtagtttgggaaaagatgttgctttagtcatgcttgaagtagagctgataaaattagtggtctggaatgttttttgtttactaaatttaggtattatttatccttgtgatttcattttgttgttggcttgcaagatttaaattagtggatgtggtatcagggcttttgattagtgttgaggaagtagatgtatggtatgtgcccttgtttttcaaggcctaagtgaccgatcagaccacaaaattggggaaaaacagattagccaggttgaaaatggtaccttttagttgatttcatagcatgtgcctggttcacctattgaactaaagtcgtagagatatttaaaagtcttagttttgaaaaatactgttctaaattgtgatgtgacctgctgtggtgctaggtgtcaccttcccactaaggtcctatgcaccaccctgctttcccgccaagtgccttatccaaacataattttaatggtcatattacgttaagcttgtaatggcatatttgtcagtacttgatgcttcggatagttttaatgacgactcctgctggaatgccttcttaaatgcgttttgtgtttcatatatctggtaataatgaccaagacgtggcaatctaaaagaagctgaaactaaattagcaaatattttggcgctcatttttctaaatgcaatgagcaaatatttttggttgttaagccaatatggtaatagccaatgatttcattcatggtgtcattggaaaaagaggcactcagttagatttacccaatgaaaatgggaaattcctgataatttgttgtgctatttataaatattttaaatgctgttaattactccctccgtcccaaaaaaactcaacctcgtactacgatgtgacacatcctagtactagattgcctttgtttgggatggagggagtaatttgtaccacactgcctcacgctcaggacaaacactaggacaatcgttattaaagatgctacttacatgaatacttttcgatgttcccggataagttcaaactgattgaatctcagttatcttgttgtagcatcagtttgaattgaatgtaaaatgtataaacttgcatacttgataaaaatctgcaattgatccatatgtgcacacacaaacatccatttactaaaatgtgttttgccaatgtgtgcacaagtccaagttagcatacttgcatttatgttatggttttatgtttaagcactggtcactatactagttattctattgaaatggtgatgcgaataagtatctaaactagaggacaactgcacttatgaactaattattctgttgaagttgttactttagttaagagtcacaattagagccacaatgcaaatgtgccaagcttattatactccgcgatatttgccaattcattgtgaagtttgctcccacaatgaactgttagatcattagatccaagtctgttgaactccacattagttttagtttcccttctattagacgataatgatatctttattgatcagtaataatgtttttccaggtcaagggagaagcttgtatgatatgcaagaatgatgcaaacgagacccttcatctgcggaatatatgctttgattggacaaaagatgatgtatgctttcatccttatttaattaattgattgtaatttttgtcacaagcatattgttattttctacaagggttctcttctgtgcagttagcggaggaactgaaaacttacaagttggaaaaccttgaggatattaatttagtcgaggatccggaaagaaaaggaaaaaacagaggctatgcgtttcttgatttccgcacaaatgttgatggtgtggatgctttttttaaactacagaacagagatatttatcttggtacggatgttcgagcccaagtgtccttttcaaaaactctttcactggatgataagattatggaaaaggtagtcacacaaacaaggcatctatattttgtactatatgaatctgttacacgtattggaatatcttggctttgacttagctgctataactttgattatgcattgcaggtaaaatctgttttcttggatggcttaccacctcactgggatgaagacaaagtgagagaagtgtttggaaagtttggtgaaatcgatagtatacaccttgctaggaacatgtttaaagcaaaacgaaaagattttggtttcattggctttacttcaagacaatcagctttagattgcattagtacagttagtaaaggtggtattgttgaaggtagcggaaaggtaatcacttgaggtgtttttagatgtgcttttcttctggtttatttgctccagctactgttacttagtaggtcaatattttcaggttcgaatcaaggcttctttacaaaggcccagacctactttgaaaaaacattcatggcaagggattactcccatgttgggcatcagaaggggatttattggaaaaagttatggtgatagagaacactatggtgatagggaacgctatgatgatagagaacgttaccataatagagaacgttatggtgataggggatttgggttttcaggtcatgcaagacgtgattactcaagcaatcatgttcatgacaaataccatcgccacatgcatcgtatggcaattgatgttgaagaaaggcccgtttcatcacgagaacacagatctcattatagaagagattctgcagtatctggttggtttcctttaatcttctctaaataaacttctttcttttttctttctctccaaggctaatgaatgtttatttccaatacttggttgtaggccacatccacaggtatgagagggcaaggcccagggaagcatatcttgatagtcgatatactaatgaatacccaagacataggcactcaaggcatgaagaatccatccagcgagatgcatacaggagtaaatatggacactcctacctggagaggtcacacagagattcttgcccagattgtaatccaagtgatcatagttccagtgccttctataagacagtaagcacactatataaacactatctggttttattatccattgcttgatgttcattggagctggtttactttcttaggaccatgagccaacaccttcatcttcccaagtagcatcccactgtgaggaatcgttcagtcaggttgtgtttttacacttcctcctataaattcagttgcttcagagtgatgctaactatttgatcttatgtttcccagggccgtaagttgatggcatcaagttcccctgggatgtgtaattgtggcgaatgctatgttgtaagcacaaaactacagcactagtgtttggaatgaagtttctttgtaatacttgattctgattgtagaatcttcttttttgtcaggaacaagatgcagcccccgcaagctcccaagtggtgcctcttcgtcaccagttggccaaaccttttcatgagcgaaggtatatatattctgacgcttcatgtgttcctatcctttcacctactcttcgaactggttaaaaaaaccgtactctgatcttttgctgtagttctgagcctgatgaccactctgcttctgcctatgaagctgcggagtacaaagaacgcaagagcaggtatcatccatcttccagagatggccccagtaatactcaccacaggaattaccgtagacaaggaagataggtccaagtaagcaaagctaagctttcgacaagatagagaagctgctcatggcagtgcagctgctgctagagctatacttatttagtagcgtcgagttaccattggtgcattggtggtgctcccccgatgcagaatcctcccaaaaggatttctggcttttgtgggcgttgcaattttttccggccctgtggttgcgcacattttaccttgggatgccatgtcatgtgatgtgacattgtagttcgtttaccccggatacataccgatagaaatccaaagaaagagatgttaacttgcatggtggtgcgttgcgttgcagcctggtgcggttcgtatgagtttcagttttactgctggtgtcttcagagttctgatgtcgctttggccgttggttgattgagatgttgcaattgcgagtcaaaaatttcgttgacaagcactatagagcattgcgtgcgtaatctgaaagaatatagtttcttttagtgccgtactaccaaacacaaaaggtgctgaatatatatatttttgatttgtgcgacacgtgccatgtagcaccacataacttggttcgatgaacgcgcagcaaagaagggcgagttttgtgctccaaaccgtacacgatagtgcacattactttacatgatgcttttctttatctccctatgtacatcaaatttttagctgttttttactccctccgtctaaaaaaaaactagtattagatgagatgttttctagtataatgaatgtggataggagtatgtccagattcgttgtattagaaaatatcacatccagtactaggttgagtttttttggacggagggaatatgtggtactacacatcactgtgttgcacgtcttaaaacggtcactttttataatcaaagttttctttggactaccttttctcaatctttacgctttcaaacaagtaattgtgttttcttttttatggtttaccaccctaactatatagtgtggctggggtaagatagttgacgtgggtgtgccgatgtgtgcttgagaatatagggttgggtggttcaaaatgtaaaaagcaaaattacttaattcaaagtaacaagattaataaaaatctggtaataaaaaatgactcaaattacgattcgctttaaaattattttcgtcattgatgtgtgcacatctgagtgcactttggtgattaggtacgcaactctcttgtcaactgagaccgcaggagcctggagggcaatctgtacacattttatacggtagtttgtggaccatacgcacttggcagtggagtttatacaacttaggactcttttgattaaaagaaaattcatagaatttttttcctatatagctctttgaatcaatggaatggatcctataaaatcctatgaaattcctatggattgtcttttcccatgcaagttttggaaaaaatttaacatgaggtagaacctcatggaaagaatcctttgaggccccttttgattcaaaggaaattcataggaattttagaggatttcattcctataggattttttcctatatagccctttgaaaatcctatagccctttgaatcaaaggaatggatatcctatgaaattcctatggattggctaataccatgcaagttttggaggaattctaacataaggtaaaacctcttggaaactttcctttagtctttatctctcctctaattcatgcgtttttcctgcggtccaatcaaactaccatttctctgtttttcctgtgttttgcaatcctctgttttacacttagggcccctttgaatcgtaggaatgaaaaaacagaggaa

SEQ ID NO: 5229 - DNA, 49186 bp, Oryza sativa
  unsure (1)..(49186): unsure at all n locations
cacagaaaaaacacaggaatggctgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggattttttttccataggattgaaatcctccaaaattcctacatttttcctacaaatcaaaggggccctatgtttttcctacattcctatcaaaatcctgtgtttttcctgttcctatgttttctcattcctgcgattcaaaggggccctcagtctttatctctcctcaaattcctgtgtttttcctgcggctcaatcaaacagtcattcctatattttttctgtgttttgcaatcctgttttacacttgtattcctgtcagaatcctatgtttttcctattcctttgttttttcattcctatgattcaaagaggtatacaataccttatggttttacgcactcaaaggggtatacaatatcttatggttttacacacttatgtgatgggatgcgaataatttcttgcttggtgtgtactagataagaggatggaatggatgtacggtgattgattgagacgacaaaattggatgaaatcaccatattttacaacttgaatcaatattggttcccagattaaatagagagaacattagggcccttttgattcaaaggaaattcataggaattttagaggattttattcctataggaattttttcctatatagccctttgaatcaaaggaatggatcctatggaatcctatgaaattcctatggaatgcctcttcccatgtaagttttggaagaaatttaacatgaggtagaacctcatggaaagaatcatttgagtctttatctctcctcaaattcctgtgttttttctgcggctcaatcaaacagtcgttcctatatttttcctgtattttgcaattatctgttttacacttgtattcctatcagaatcctgtgttttttctatttctccgttttttcattcctatgattcaaaagggccagtagagcaatgattaatgacattgttttaattgagagtatcctatgtggagaagtaaagttttgctagcaatcacataagtatccaatgctcacatttaattaatcgaaatgtggctgcaccaaatcacagctaatggggatagttatataggatttgtagatacataacatagctctactgctaaaacacctaagcaagttttacatggctgctaatttaccttggccaagattgatacggagttctcattatggttctatggtacctcatttattgtttaacaagggttcgttccggtggagggatctaaataacacccctaaccgtacgaattttctcgtttttttggaatttttttcggctcctcggggaggataagcgtggttggctatttttgcaaaaaactcctcgtgtttgtagaaaatatcgcacagttccttaaaccgactgacaacccgacatgttttatccgaaaaaccccttgtatttcagcgaaatacaatgtgaagaagagaaaattccgcttctaggggtttttatgaaaaacatccatcccctacccccaatccccaaaccctcctcgttccctcacctcagcgccgccgccgccgcaagccccgccgccgccgtccgtcctcccctcgacgtcgcctttcgctctccccccgtggtcgccgtgcgccatcccccgccgccgccgtgcgtcatctggcgccggtcccccttcccccttcttcgccctcccctcgcggcggtggcgtaaccggcgccggtttccccctcccctcgtggcggcgtctgagtcggctccggtgctcccctccctcttccatcccctttcgacggcgtcggggatgacggcaacgcggtggtggtggcggtgtcaggtgcgggtagaaaggagctggtgacgggcggggacaaggcgtcccgatctgcactgactcgatctgcgcgagccaaccccgcgccggattgaatagggtatgaggggagaggacggcggcatgggaggatgaagaggacaacgccgatggagaaaggggtgaggttgcccggcgggggatgctggccttcaccgacgcgtggctccccccgccgcggccgtcgtcgaccgtcctccacccgtcgtcgccaccccccccccttctcccctatctcgggcctcttcccgacctcatgcctgcacgagcgccggccgcgtcccgtgctcctctcctggcggcggcgtcggagccggcgcccggtgccgtcctcccttctggatcgatggatttggaggtagtaccggcggtggcggtgttgggaggaatctatatgagtatttcactttcattcctcctcctctcactctcactaccgatcgggagcgcggagtggtgatggtggcgatgtcggagcgggggtgctggtcgcgtccatggctcacctcatcagggcacgcgccatccgcgccggcaccatcatccgcgtcctcgactatctcttcatcgactccgacatcaacacaaggtgaccatacaaatccttcctgctttcgatcgatctcatctcgctgctataatcatgtatcagaccagatgcctgcctggctgatcgatcttttcaaggagccgctctttgatcattttaatgtatgtgtgtgcacgttttgactgctatcggggaaattttggttaatttccttttttcattctaactgctaggtaaaattttattctgaaatgctctgccgaaattcgttttttcggagttctaaacggcgctagggaaggactgatgaataacagggcctgctctttactgatccagggcagaaattaaatctaaaaaattaaccaaagtctggtctatttttgtatagtagcagctcttgtccagtttatttacatcaggcaacattctaaagtgatgaaatgcggatgaaatcaaatggatgatctacttgttcatattgataaatttaatattacacattatcaacctaacaaatgatgtagtttaagaaagtttttagcaaatcattataagcatggagtaattaatccatgtcaatcatccgattaacaacctgtttagaatggaacattgttagctatttctttttgttacttgaaactttgaaagtttcaagtattacaacatgtgtcaacacttactgaaaattgaatccataactaacttttcctatcatatcttggtttctcagttcagggtcattatcgtccagcaacttgaattgctgcaaactgagtgtgcactgatcggtactagcaatactcatgcgagcccagtaaactttatctcacatggaaccatgcatttcctttccattgtgagctgtccccggcatgttgctactgggtacctgttctgaccgacgtggtggagtggtgatgttgcagaacgcgtacaacatgctccacagcgacatggtggcggccgtgcgtattgcgcacgcatgctgtatgttcctcgacgagctcagcaccacatacctctttcctgcccaccacaacgtcaacgtgagcacattcagatctcccaactttataaaagaaattgcatcttaattcaaagatagtttcttgcacctcttcgatgcttcatatctggagatttgggtagcggaaattgactacaacgacctatctctgattttggagtcgatactaaataatcaagagaatgggcttgttttgtttttttttttttttctagagtgggatatggaaacacctagcccaccgtctaagatgagatgttgtctaggataatagttgtaattggtagatgggatattgcagggctacgagagggtaaatgatccctctgtgtaataggggaggggagtttatttctagggtgaactaaaccatccaaacaagcaagtgcaattctgaacagaaagtaaggtaattgactgcaacatctatcaccgaatagatggtgaaatgaagatcttaggcttttttgccacttgaattgtagtttctaaatacatgtccactgatatatctgaaccatagctacttttcacggacaaactagcttcatatgtatgaaacatggcaatgaaaatgttgtttgattcctggattctgacctactggatttggatgcatcatctttcctttgaagtgttagccatcatctgcaaaagtattgcattcccaagctctttggatggcccggtgccaaaattgaagaacatcatgtactgtgttggagagtgcaaaccattcaaggcaccacaaaacatatctcctctgttctttgtagatgttgtattaggatacatgcaatcaaagattcaaacatcagattctttaccagctaaaatatcaaaaaatattaagacttggcagtgtagttatctttttactaattcttatagatatatgattagaaaaatagaatggtaaaaacatgggtattcgacactctcgcagtgtactagacaagtaaaaaaggacactagggagtataaatcagtcagcacatatttcattttggcacttgatatttggtgccacctcacctgtcatatcatggttttgttgttttccaccttactttcaggacagtgcaaatgtaccaaacaacacagatgtttgcattgatgtgtaccatacccttcagttcaaaatttcgcttacatgatacaagcagatagcagcagactccggtccttctcgtttttgtatttgagagtattctgccatagttccttttagggttgctaacttacttgccattttaccccacgttatatatgatgtattgtttggcaggagaacgtcaatcgaggtcattccagttcagaaagaaaaatacaatttctttgctatccattcatgaagaattgtacattacagagttttaaagtaaattgaaaaacgattgcaccacaaaccactttttatttaaatttgttgtacctactacatctcatattgttaaatgtcaggtcaacatactggggatatatacatgacaaaagaacagagcaaactccttttttatccaaatcattgttcactgaagtggagttgtttctcagagacctcactaatagggtgagcttacaagactgatcattgttagtcttcagctggaaaccaagcaaaagatgtcatactgttgtaaccatgtttgaagacaatttcgttgcctcttgtttgaagatggcaattgtcataatgcgtggtttgtcaaaaatatgtccactgtgacatgcgtatatgtattaataatttgtcagttatttgtacctatctgttttgcctagatgattattgtaaatgctcttatcgcaatgtaccatcctgtattattcatgttattactgatataatcttgcgcgcggcgtggcgccgcgccatggcccatctagtgctttgcaactactgatcctgatgtcttgggctttggcagtgattggtgggcactgggcatagtttaagggtgactaggcaacggtaagactgccggtgagcagaacaatggtgatagcgttggttgcatttggtgttaattgcaggcatgtgcctggccgtaggtttctgttttgctcatagttcatggtaagagtggacgaggaaccatgccaacaaaagcatataaatgtatttttgaaaaacttaatgtaccatcggatattagtctaccactttatcctgtccagccattatttttctatcagagaattaacagataaaggagaaatatggacccatcagtgctctcatatacttagtggcagttgagtttcatcaatgctctctcgtaaggtgatgagattattaggaaaatttcaaatagtcccacctgagcacatctctacattgtagagtttcacaagtaagaaatgcatctccattctgatttttatacaatattttttttaccctgcctatgaaaaactaattttttatttatagtaattaataagtcttgaattaaataagtggtaaatcttaaattgaatttgtaaaaataggatggacgttgtttcaaagggcatccagatttggacgttgttctaagaagtgtccagaggtggacgttgtaccgaagcacgtccaggctcggtttggggcgcccatgccgccatgcggagaggcgccatcgtcgactctcctctcctcgggcccaatgttggtgcagggctcaggcaaggtgctgccatccccgccgttcacctcgactctgggagactgcaacggctgccttccggcttccgcctccacaacgtcaggaatctgccgttgcagttcacctcaactcacctcgaaggctctcgaatctggagaggacgccgccgctttctgccttcacgccgggagatcgcagccgctatccacgttctggttgagtcatgctggaacaataacccactcatgccggcttgtattgcgtcgtctgtccgcccctcttggttcctaacagcaagaccaggtatcgcctcactccaggtggctggccgagcaagtatgctcagttcatagatcttggtattcaggtgtatatgttctgcaatagaaagtttacaaagaatgcaaaattatgaagggtaggacgcaaacatcctccttctatcagatcatctgtcgcccgatgacttccaatctctggcctgttgcaaaaggaaaaaaaaaagcatcgatagaagacctcgcatgcagtacatctggcggccgcttctcaagattcagtcagcaaagagctcgatgcgtagtaaacaatggaccagcacaaaaaccaaactaatcaaatatctcaaaataaaagtggtggctgttcacatatgaccccgagtagagtgtccgtcatgcggaacagcggaagcattgaaggagggccgggggatggcgaccctgtctggcagatcaggtagagagcggtgcctgctcagcaagcaagcaatcaacgagagacaatagtctgcataggagtaacgaggcagagttcgaccattgtgtgattggatccaaagtccaatcttagtccggtgaattggacggctctttggggttttcaatggacgcccttgtaagcagcgtccccatctggacgttttctacaacagcgtccacacctggacgccctatgcaatagcgtccttcctattttcgtaaaaattgactttgctttattatatatttaatttctgcattattaattattatgaataaaaaattcggtatgaaaaaaaaaggttggttgtaaaaatagttttttttaagtagtagtggccacggctcccgtcgtcgcgcaccatgcagatggcattgcctagctaaccacgatatcggcatctcgctgctctgcaggtgctcggtcaaatgaccggtaagattcaatggctggtaagcgacacttatacgccactggtttgaagaacatcactgctatttgttttgccttggaatttccttcttaatttaagtaatttatccatgttttgcaaccccaccccaccccccaaaaaaaaaaatccgtgttacatgcaattgtatctgaccgaaaaaaaaaatccgtgatacaattgcatatgctagtgtggctaaaaccagatacatacctcctatgtttgcaatgaagtaactttagttaaattttacagaaataaaatagtgtcatgtgaaactgccatagaccgacggaatgtgacctcgcatcacaatgaaaatggaacggaaatttagctaagccagtgcttgacttgacagaaatcaggacctgacctgaaacaccgcagaatgtcacggcagcagcatgtggcatacacagcctgcacccatgctcaaatgcacatgcacaagaaaaagaaattctaccatagcatagattcagatctctcattcttgatttcacaacagctagccacatgagcatgaattttcagtatatgaaaaccctcttaaaaacaaattcagtattgcaacaatccacaaacattgcaacagatagatcatgcttgattctccaagtaagattttcgaagatgatctagtcagaatccgaagtaagatccatttcagggtgaaacgggcggagtaactttgctaggtgctcccccatgtcatccacctcctccctcccgaagccccagtcacggaggaccaaagacccgatggcacctcttgcgacaccgtgcttctggaggctccccgatcgcctctctatgaaaggcaggacagtgctgcttgatcgtaatcgtgccgccatcggtatcgattcaatatcgagtgagccctttggctgggattcttctgcatggtcgctaaggatctccccgtgccggccaatgttgcctctgaagattgacgggaacggaagggggacagggagggggcaaagagatgctgagagatgggaaaattttggctttgtctctctggcttcgtagactgaacataccgagtctttcacttgtgatatggaagtcctttgcccacctgtgcaaacaaatttcaattgttaattctttgtacttctacatgtataaccaaaatttagccaccatgcctataatgttgtgaaatgttcaatattgtacaatataacagtagaaaaataagttctgttggcatgacaaaacttccccatctagttttccgcgcgcatgcttttcaaactgctaaacggttcgttttttgcaaaaagtttctatacgaaagttgcttaaaaaatcatattgattcatttttgaaaaaaaaaagctaatacttaattaatcatgcgctaatggaccactccgttttccatgcggaggagataggttcccatcctccagtaccgaacacagccttaatcagaccctacggcaaaagataagacgtgcagacctctatcaagagctccatgaaccaccagcgattcaactgaataaggatcttcgtcctcgtcgctgatttcaggggtcaaagagtgcagcttcatctctatgttccccaatagcatctctatctgcaaattagatgtgtgcaattagcaagcaagattaaatttccatccaatgttggtataacagtagggcatatgttatgttgtgtacctgtcaaagaaggggcaggcatcgctacatccagagcagtaaccatattctgccgaccttgatcagataaaatgtgcagaagttcaccaatgtcaagattaccagatgaatgtgctaagtctgaactcgggcccgttcgttgcaatctaaatggaacagtaattgaatgtattgctgcagcacaaacagcactagcatggaatggtttctcgtcttgtatataaagatacggtgacatgtaacctgatgaaacagagtgaaaggaaatttgtgagaaaatctcattcggaataagctttctgtacattcacgaaaatattttttaagggaattcatgaaagtaattttgtatggaaatcaaatgtgaatatacagcatgaacaaaaggagttgattctctcttaatggaaacgcaatcaagtgcagtatcttaaggcacaagatcagtatacatgaaagcaatcaaaggcaaaactaggccaccggaaagaagtcctataaaatcacagaataacaatagcatcgcaatttagtatcctcctgtgtatttagccaacttacgagaactcctcagacctaaaagtgttcgaatggaaagttttcaaaaaagaataaaaaaataaactaaaatcgtggagttcaggcaaagggcatacttctacttaatgaaggcggtcctatggggaccatcaggttgcaaaaggacgaaagttttgaaaatgaaacagcatcatgaagagctctcataatggactccctttgattcatcctggatgatccaagggtcattggatccctcacacagtaaagcaatacaggtgtatttgtgtaatcatcagcaatgttctccaaaaactgtgcagctacactggaaaaacttcctgaatcacccacaataaactggatgccctgtggtaaattatgaatcaataatgctaaaaataatggtctcaaaatatgcatgatatcgaaaatgatgtgcataagtgaacattagcttgttgcaaaactatagtagagtttgctgataatttactggggaaaagttggacctgaatatggtcgcattcttcaacaaagaaccttagcctctcattcatttcctctatttgcgaccagtctgaaacaacctcttgtgcgctgccatagttatcaaacttgtcaaagtctgtccatgacccatgtaactcatataaactctgaggatgatactgaacttttgaataatccgtccaaaagttgacgccattctctagacagtcgatcaggtccttatcttcaacacttttctgggagttgctggcaccattgctagtgcttggattctgcccttcttcaactaagctttgcagaaacaagttccgcccatgaggttttgagactgatcttgttacatttccagacctatataaaccaggaaaaaatcatcatggtaatatatgagcccaacacattattcaacatataggtgcccctaacaggaatacaagagttagtcctattctcgtcgatgaaattagcatatagttactgatagcatgaatgacagcagcacataacaagcaacagcaggccaaaagatgaatgcaactctacgaaaataataggcaaatgcaatgcatcacttccacagaagctggatgggtatatgcatcattactaccagtccatcgctcccttattatcagcctaagagcagctcattgctttctcaggctgcagaaatttcctagaactgtatcaatcaaacattgctagagcaaagctgctatatttgctatctgctttctttgacaatgcagacatgcttcctccatttgtcagaattatcccccagctgtagatacctaaaagcttatttaactctgtaacccatttgcacaagcaatccgatactaaactgaaacaacagtattctgctgcgtagcttgtacatggcaaattacaacgatcatttatgcatggtgggcacaataagcaaaaccaaacatggaagcatattctggagaagttagagcaccacttgccatgtagcaacattgagctgatctgcagaagcactggtctgacagagattaccggatgaactcaaagaaccaagggacccctgcaaatgataccaccgtgaacacgcagcctacactatcagtaacaaaataacagttgttacacactacaataattggatcaaattcacagtcagattacctcgagaaccaaccgataccagacgagggcagtatgtgggtacaccctggtgaaatcaagcattgtatgctagtagctatcaattacaattacaacagattttgcgaatctggatcaccaaaggcacttattacacttatttcagactaatgtcgaggaagaatcgcatggagtgacagtattttctattttcaaaccaacctgcaatgaattgctggtcccaaaacacagagaacctcgctgctcaggtaaagcttcagtccataaggctatacatctctgtcgggagttccaaagataatctgttactccctccattccaaaatataaggcataaccatccctaatccaaagaccaagaaaataattattatcatcttgtagtttggatcattataataaatacaatgcatgcatccaatagaattatagaacatgataatggaggatttaaaaaagtaataatttaatggagaaatggtcatagttaatggcctacatgcatggatgccttatattatggaacatctaaaaaagtggttgtgccttatattatggaatggagggagtatattgcaagcacagtgcaagaagttaatacatataacccaaaatggacacggtgatcaaaataacagtagaggaaagaaacggatgaaacataccacagcatgcaacagtttattgtgtagatggacacatgcagattttcctgatatgcaaggagattcctcaagtgtgctcttgttccttagatcctctgacaccggataatgcctgcagcacctccatagcacaaccatttctcgctacctttattcatgttccatctcaaccgatgcaatgctacagctttaggaggaaagacctcaaaattttcaggggattcgctacccctgctggtgcttgtgccaaaattctcttgcattgaaggagcagctaaaactatggcaccagtttcttgtccttcatcaggttcatcttgttgaccatctctgatgctcggatttatagcacaattgtattctgtatggtggttaagcaggcatgtcaggtacaagcaaaatgatacaagttgcaggcgacagagattacctgagttggcaagaagttccccttcttctataacatgcaattgagctacatctttgcaagttttagtagcccgtttggtccccagaggaacatttgacaaaggagagtttggtaatgcaataccaattttaatggttgttccctcctctgataatgaaccacaaagaaaatatggtacacggttcctcccaggttccttttcccagaatctcggagtaagctacagtaagttgaatatttctttagcaatgttatagagaatcacaatagcatgcataaatcaatagtatatgtgctgtttagtttacctcaaagcaaacagcagttccatcagccacacaataagccgcatagcctggatatcagcaaaacaaaattacaaattcatgaattatcatgaatatttgacatttttactctgctcacatgtgtggaactaaatattgatataaggctataaccgatattccgatacttgacatagatatactatggttggacatgaggtgaaatgcacctgcaatttctgaggcatggacactccagatcaaatattcagacaattgataggtagaaacaccctgagttttcattccaacaaatggccttccagtaacaggaacatcatttgcgattctcgacaagctaacgaactttaacgtgccatcttccaatgatatgacaatacctctgaacacaaagataaaaaatataacagttaacattaccattcttgtaaacaaaagggtatgtctggcatatatacacacaatatcaccatgaatgaaacaatgtggtctatttaatcacgtctactttgatccagtaacacatcaagaccatgtccagtgaaggaagcttgcatatttagaaggtacgtgggcaaatacaaacatttatattaataattacgtaaacaagtgcaaatagagcgtttgcaaaaaaaaaagtgcaaatagaattacttaaaaaaatacgctgatgctttaatggaactaattatataaacaaagacaatatccaccttagcacacactaacagagaagtacaggccctatgaacataaattacatgactaaaacaattgtcaacattctagcaaatatggtttctagtatgtgttccaacattaatgaaaacatacatctccatttataattagtgcagtgtttcaaagacaaggaaaacaacgtaaacaccgtgttagtgatgaaaaatcttctgtagtgaaaaaaaaaacaagtacatttagtgctttacaaatattaccttgcatccttcaaccattgaagacttattacggcccttcgagcagtagttaactcccaaagatggcgatatggatctctgcagcaaagatatcttatgagatgcactaaaattcccaaatattacaaaacaaaaacggtagaaaacaacagcaaatccaagggggctgtgacaggtagtgatttaaccataacaatcaatatatccatagccaaacacactgcagcttctagaacaagtttcttagtgcccattgaaaagctaaagaaaaaaaaccgtatatcgcactggattcataaagaaactcctgctgacatcattggtccatgtgataataacatattctgcatatcgtgcctatcttttgtttgttaactcggaatttttaccattaggaaacaaacagaaacaaatatgaatggttcagaaattgggaggtgccacaaattgagagaggaagggggagagactaccctcaatgttcagacctctgaggacccatacataatattagaaattcatgcaggaaaagagagtagttcgaaagatgttttaaacattgcttcagttcacaacaaggccaacacctaccttaaatcccagaatttcagaccattctctccagcagtgacaaaggcattcatgttttccttactgatagaatgacaagagtcaaaactcaaaaattatcttttggaatagaccataagtaacggtacaactggctacctcacagatggtgtccacgacacggttctgatgggagcagattcagcagttacacacataaaaggttttgaacctgtttatcaacagaacgcatgatttagttttgtttgcaaacagaacagaataagaaatgtgaagatttgggaactccagtaacttgcttttaaaccagtaaagcagttctacagtcagacatgttgtcaggcaaagtgtaaatgataactgataagagtgacgtcgttggcaaaactatctaaataccttgaaatgacaagtttgctgagaacttccataaagcaacctggaatataagaaagtcaatcacagaactttcagaacagcaacttgaaagactcaaaggtcacaggatttaagttaagaaaataattttgctgggtaaggaaaaggtaccgttccatcgtgacatcccgccaatatcatatcatgagagggtgaccaatcaactgtcaagggaatgctatttaccattataaagaggcaatggcttcaaaattaaagttcatgctgaggaattaagaaatatatccaaatcttccacctagtttgagctactactagcaaaaaaaaaaagaagtctacaggtccaatacctttgtctgttcccacactttactttggcagagctaaacacaggcttcagctttaaaaatcgagggtcagtaccctcctttgaagaagaggaatatattttctgaatcatgcttggtgatggaacttcccatctgtgcacaaaaatgaattacaagatgataagagggggtgatagatatttaaatgagataaataaggatctacaagagcatacactcacacttcaagcgagccattccccaagagtactgcaagaaaacccaaacatgatttatgttctgactgatttgctgaaggaggtttccattttatgtcccaagcaacttttccattatgagctaaacataagacaacccttggtagagaaatgtcttttgggacacgagaaagggtcttttctgcagaacaaatcatatgataatctttagttgattctttaaatcgagccacttctgtatcttttagttcatcaataacctgagcactgttttcagaaggaacagatacagcctgatttctctctgcgttttcaaagttacaagcaggagtacaacatgaagtatatgcagttgatgcagaagatccgtccatgttctgtacttcaacactaagcactactgaacttctttcatttgaaacagatttctttttatcttgaacactgccctttccgggacatgattctttcttgcaattttcaactaaggccgcattgtcgcttgacttgggaattgtctgtgttttttgttcttcacccctgcatgctttagaacaaccgcgttccgttgaaattggctgctttctaggtctgcctctacccttcttggcacttgattcttccttgcattttgcaagacatatgccctgtgctggtgttgcaacacgagatgttccaacactcaaatggacactgttctctatagcacagcttgatcgaccaatgtcatttgctaaaatgtcacaattactcttggccaagaccatgagattatttgaattggtcaaagtagaacctttctttggggtctcagtaccaggagcaaatacacaactggttgtactcggaaatggtttcttcctaggtcgtcccctccgcctcggaccagttgagttactcttgttgcttgattcaggtaaaatatacgtaggcaacatggatcctacgtcagactgtccagattgcatggaattatcaatatgaattacttccttttctggctgttctctacccctctgacctgacaatggaactggggaggctgcatcaactgcagcatgagttatattagcaccagacccagtattttcagtgggacccaaaccacaatcaattgaaccaggcaacagacagacagaatcatttcctaattcagtatcagtgcctggaagatgcttgctgttgcttggagcaggatactttcggggcctccccctttttttcttgggctccatgcaggttaaagctattggagatagagctgtagacaagtcttctgttagtttaatgccagacaaaccttttatttcaacaggttttttcctaggtcgccctctaccttttcttggagttgattccacaggattaacagttggcatgggacaagctattgcaacgtcacatgaaacaactgctgaactgacaagaggatcaataagagcaaactcttgacttgtgtcgttttgggatgaatcttccaatttggcaattggcagcggatattttcttggtctgccccttggtcttttgacacttggttccaagtgatcagaatttgtgatggtctttcttggtctaccccttcgttttggttgattggatggattatatttattgcatgcaaccaatgactgatgaggatgaccctcttcagatggtgctaggagacaccaaacttgaattatacctctcccgattaatggcatgccaattttatggtaagaagaaccaggagggtgagcagcaacagcaagatactgcaatgtataggagacgtgcaaataaggttatcagctctcaataacttttactcctagtcctatactttttttcaagaccagcaaatacttgaagatataaaccataaaaagaacataatactactttcatagacactgaacattcaatgcaatcatgcaattaatctgcatgcaaagatgtccttgggaagaactcccttcggtcattttcttatacatgctttatctcagcgcaaggttttattaagtaaaaaagaagtaaactgccattttatcatcctgcaatgcacagcacatagaactggaaatgttgaaccagattcactgctttaacaagagttggaaaagatgagaaattttactttgattcctgtgagcatctaaaatgggaaatacaaatacagaaaacaaaatatgcctaatataagtaaacgtggggagtaccgcaagagatgtctttaaattcatgtcaccataaagtatgtggctcaatgaaacatgttaattttcccattgacatatgaactaaagaacactcatcatgttcatagtcacagcaagtagtggatattggaacaaaaattatgctgatataaaacaattttgaagccacaacaagagaaaactttcagtattatcatagttataacctcacagtttatgggagaatgaggcctgtcacacaacctagggcaccagtccaatgcccaaacattgcccccggcaaatataacaaaatctgagctgcaaaagctaaaaaattattaaacataatttaatcaagatggcttcaaggagaagtgaaagaatatataacatggcaggtaaaaagtattaacaatgttttatcacactgtgaggcaggtactaaataaagtgggaagcacaaaggcacaaaaatagtattagatcagatctattttcatcaatcacaaaaaaaaaaaaacaccccccccccaacccccaaccccaaaaaggaaaaggaagaagggtttggcaaacgtgccaaacccaatgtaggggcctgttcactttgatgccatttctaaccataccattttttggcaaagttgccaagattgtgcatatgtttggtttcttaccaaactttggtaaaaacaccagaaatttggcaactgtacagtaatgaccaaaatttggtagaatatacgttggcaacaaagtgaacacattcaaaatagctatcttgccaaaatttggcaacattgccaaaatttgctaaggtttatttcttttggcatcaaagtgaacaggccctaggattattcttctggaccaaaagaatgacccactactcccaagttgatgtggctagtagttttgaagtgtgtgcagtcaatttaaaaaaaccttaataactagcatgcacaaaaatatttcaattgccacaggtgtcgattggagactctactgaagactttaaacaagtttggaaggttttcaaaataagattcaagtctcgcatctcgtgtttcatagaagacctactcaaagagatcaaaggaggtatcccctgaaacctgaaaactactaaccaatagcaggaatacaatatatgttgccaattagtcagcctattggtcatgttacagcaaattagcaactagtgaattgccaaaggagctaaaataatacataagcagacatcttgggttattcctaatatcaactgagaaacttaacataacctatctccactaacagtatgacctttattgacaaatatgggggaaaaacagacaacaagataagtagattgacaagattctaaagtagtacagaaagaactccataaacaataactgtctgttttagccttcccatcgtctaggtgtgtgatctgcagtgtgatccgaacttaattatgagaatatggtccaaaaggaacaaaagatgatataagaaatctcattcagctgaacacaacaaaaaatagactcaagaacttagcacaaggcaccaacagcaactaagttacctggggaacagatgcagacgagaactgtggtaagtttatcttgtgtgtgtcaactctggatggagctgatctggcgtcacaagtgaaactaacattttttggctcataagagaggtgcctccattctctgcaaagatatgaaacaactagcagattaggtactaaataatattattttttttaaaaaaaaagaaggcagtcagattagacaaatgaaaaagcagcttgtgaattccatttaattgatgctcagaatgactgctagaactttccacaatctgttactcttgatgctgaaaggagtcgtcctcatgtgcataagcgagctgaacatggcaaaccttaaatctgacccaactatagactatatactatgtcaaggaaagtggcctaacactatccatggagaaattcaatcattgcagatagtctgtctggacaaaatgctaatggttataataaatgcagataatttatctaatgttaactgctaatagttgacacttgacacatttggataaaaaccaatcattgcacttagggagcaagtatatgtgacaatgtagaaattttagtcagtaaaatttaaaaggtgcatgtagaaggagaaccaacaatgcagcacgttgaaaatatgcagttccaattgatgcaaatcagtatacagtgagatggatgatagaaagctaacgttctgagcagcctttgtatggctgtaccagctgatcaatctcagttgagtttaacagccttatattggtgggtgctaaaacacagtgagtggtgcttttttaaaaaaaaaaaaatctttctggtgaacactgggccccttaagtttttcttctactttaattggtgattaaatcaaagagtactaactagttatagcatgctactataggttgctaataactaaagctgttactgaaactgccaatcctgaatacaaagtaacagctaacaagtagtcttcacaaataaaggtggggctcactgacttagtggcttctagataaaggggatcaagtttcgctactcctctgtaccttaaaccataacatcaaatggtaagctagaaagtcacaatgtgcataaatgatcatcgatcagagtcatcaaacaacagatgagtacagattaaggaaatacatctaccagaacaaaagtgacttaaacttaatgaattagtaataaaacaagtaacagtgcaactgcattttgttcatgacatgaaaaaaaaaaccttgtatcgttctaatcaatagaaaaacagaattgtgcattgagctaatattgttacctaaggacactggaagtaagaatatagccaattgcagtggcaaaagccaaatgaattctaatagccacaacaggaataatgaaacggcaccaaagcattcctgtgacaactgcttttttcctgtttgtgtggcagcgatgtcttgggatctaaattaacaaattccaataaaatttgccaccgcgtgtggcacataaggcaatgaataaattaaagagagcttatatgccacataagttttcccattaaaagctccgtgaaattgcatcaatgactaacaaattaatgctttgctgataaacgctactattaaacacaaattcgtccactccacccagctaaataggccaacaacagaaagttaccaattttgccgcggtgattaggtaccggattagacagagcaagggagtttctcacctgaggaaagttattgaagaggcgagccgctctacttcggcgtcagggaagttcggctcgggctccccggctgtgagctccgagatggcgtgcaccgctctggagaagacctccggtgactcgtcaaatacgcagacctcgacgccatccttaacctcctctccttcagtctggggcagcgcccccgtcgcctccggcagcgccgccatcaccggcgaatcgagcgaagagagcggttgagccgtggaaaacgagaatggggggaatcggccctcgcaggtggggttgttcaatcgagccggcggcccgccatccccgaatattctgccggtttccaattgagatctctacgggcctgtagttatgggctgaaagcgtaacaatgcattaggcccatatagcttctgactttctgcaaggcaatgaacaaccaatcggctggtaagcttcctttatcttctttactagttgacggcaatgaaaccaaaaaaaaaaaaaaactaccatacggatgagtcgatgagactaattaacatgtgaatatgcagatttagagacctaggaggaagaggatggggagtacaccaaccttgggaatagttgtcgcggactcggggaggaggcgggacgcgacgggcggcggtcgagggcggtgcgggtctagggtttcggcagtggtacgagtagaggaaggcgcgatgagggaggagtcggcggcgtcgggtgacggggtgagtgcgagcgagaggagggcggcggtgtccaacggtcgacggtgacgatgtgggggccggcgtggctatgtgggggagtccggaggatggattgggggggggcgacgagatgcgacgacgggcgggatgggacgacggcaggggggcggtgggttgggacgacgggagcggcagtcgagggcggcgctggtctagggttttgtcggcggcggcgggtgactctccggattggggggcgtcgaggcgtcaggtttttgttttcgttctggaggaggcggaggagcgtgcgccgtttttccgtcgctctcaacgtgtcgagagtcttttaccctattatctggggggcttttaggctgtgttcagatcctaagtttggatccaaacttcagttcttttctatcacatcaatctgtcatacacacataactttttagtcatatcatctctaatttcaaccaaaatccaaactttggattcaactaaacacagcctagcaaataactatttgccacttttagatttagcaaataactatttgccacccctatctcaaaaactatgtgtcacaaaaacttttttgagttagctgtatgccatgagcccaacttttgttgacccgtgtgccattttggatggatggagacataacagaggtgttaggggctgtgtaaagacagttttgccctagtgtacaataatgggtttaaacataataaagatatgcattgaaacattatgtaaattatgtttgatgataatttaatatgtttgtatttgaaaagctaagtatattggatatcataaaacataataaagatatacattgaaacgattatattggatgataatttagcatgtttgtatttgaaaagctcttaaattataaaaactataaagatatagcatgtttgcatgatgtttaaatgcgatagttgttagtggatgatgaatgtggcatattgttaattagtggatgatgatgtggcatcttgttagtggatgatgatgtggtatctttgcatgttaagcttaagcagttagtgggggataactttatagtaagataggattatgctttcagcccataacttcaggcccgtagagatctcaattggaaactggcagaatatccgaggatggagggccaccggctcaattgaacaaccccacctgcgaggtctgggaatacagatgccggttgcctcctcttctgcaactctggtgacagaatcgctcccccgaagcgaactatttctccgtttctttcctaaactctagctatgcatctcgccgtcgtctcccgctccgcacgcaagcagcgggcggctgctgctccgcgcctccgtcgtgtggggctcgcgagagcctggaccatggcggaggcctccgccgacgttgctcgccaccggatttggcgtggtctacttcttcggttattggttggctacttggcttcacgtctcttccaccccaaacaagagcttaattgggccgatctcaagccctagaaggaacttgcacttctcgaccaaaaaacccaaacaaggcctaattgggtcaattccccctatattctcgtttcgcacggctcaaccgctcatcaagccctagatagtgctctctctctctcttcgctcgattcgccggtgatggcggtgccgccggaggcgacgagggcgccgccccagactgaaggacggcgtcgaggtctgcgtatttgacgaatcaccagaggtcttctccagagcggtgcacgccatctcggagctcacagccggggagcccgagccgaacttccctaacgccgaagtcgagcggctcgcctcttcattaactttcctcgggtgagaaactccctccttgctctgtctaatccggtacctaatcaccgcggcaaaattggtaactttctgttgttggcctatttagctgggtggagtggacgaatttgtgtttaatagtatcgtttatcagcaaagcattaatttgttagtcattgatgcaatttcagggagcttttaatgggaaaacttatgtggcatataagctctctttaatttattcattgccttatgtgccacacgcggtggcaaattttattggaatttgttaatttagatcccaagacatcgctgctacacaaacaggaaaaaagcagttgtcacatgaatgctttggtgccgtttcattattcctgttgtggctattagaattcatttggcttttgccactgcaattgaccatattcttacttccagtatccttaggtaacaatattagctcaatgcacaattttgtttttctattaattagaacgatacatggtttttttttcatgtcgtaaacaaaatgcaactgcatttttagttgttttactactaattcactaagtttaagtcacttttgttctggtagttatatttccttaatctgtactcatctgttgtttgatgactctgatcgatgatcatttttgcacattgtgactttctagcttaccatttgatgttatggtttacggtacagaggagtagcgaaacttgatctcctttatatagaagccactaagtcagtgagccccacctttatttgtgaagactacttgttagctgttactactctgtattcaggattgacagattcagtaacaactttagttattagcaacctatagtagcatgctataactagtattattaaccttgctagcttttatagagcaattacacatactgttgtctctagaaatacagtgttattcttggatgatttatggaatggatgattcagaagtcagaagctaaaaaaataccctcatttatgcaatcatgcattcaacataaataaatcagtaaaggctatgtgcgcaaaacctctagaagattctttcaagtacgcctttataacagctgaagcatacagtgaatttcagttgttacaaatggaaatctagttagttctgcatatgccaatggggaattggggattctaggagctacatttggggagcataaagatacacagctcaaaagttctgtaaggctaattttgttagttctcctcaagaccatttaaattgttatggaaaacaaactaaccaagtgtgtcatgaaaatcaaagttttcatatggctactcttttatgatagattgaacaccaaagatatgcttgacaaaaagaattgtgcttcaaaagatgctaacatctcttatgttctgcgctcaactagtataagggagaccttgatacatcttttttcatgtgcccttttagttgaagggacaagaactggattcagatggaatattaatttaaatttgtttcaaatgattgttctaccaagaatcggcttgaaaagaaaaggtttcctaaagattatgtgcattgcatgttggcacatttggaagcagaggaatgaatttaccataatatcaacccatcggtggatcaatggtttcaaaacttcaaagcatatgtgtaggatgaatgagcctttaagatctatagtctttgattagttacataacttgttaaaattccgttttgtaattgtaactagactctatatctatttcttatactagcaaaagggcacgtgcattgcaacaggaaactataattacaataaaagttagataattcatgttaatctttgtgattcgatccctttaagagaaatattgttattatggatcttaacttgtaaaatagtaacgagaaattgtaacataacctttagatcatttaggaaaaaaactcccgcactattgaaatgaataacatggcataacttctattgtccctatgtttttactcgctccatgttgttattgtgcatttgattcgtctaatgtgaccttgccttgtcatgtgatcaagaagttaagaaagtgagagtggttggctgacggccaagtgtggtgatggcagcaaggatagagggggcgaggcagtggcacgcctaactctaaccaacgagagcaagagaagagcagagccaaaattagacactaacatggttagcaaactggatcatgtgtgtcgtgtgttgtaatttggttttggaaacaaaaaagattgtaattagaccataatatagacattgtgaaggaacacgatcttgatggaacactcgaacccaatcaacttaaatatataataaaaattattgtagcctacctatctcaaatgttgacaagtataaggctgtagccaatcaatgtatgcaccaaagttgaaaggaaagagccattgccaaactatataaattactatgaaatttacactcactatattacagtctccagctaatcagaatcaatcaattgggaatactgtcaggccaacgccaagcagttataatttatataggaatatagagtgcaatccattcttttgtacattgaatgtaatcaaattacattcaaattttaattttactgtgcataaattcacatgttaatgctgtatttctggttaatgctctaaattccttagagcacccgcaatggtaaagtaaggtgctctctataaaacatgtacatctcagcaatagattagattaatagtaaatcacctcaatagtatgtctacatggatatctatagctctctcatccattgcctcgtttttctctatagactatctctaagttagtagatagttttactctctctcttcatttaatctcttccaagtaggaaaatatgatgacatggatctcttgtagagagcatatagataaccattacgggtgctcttagtatgtagagcccccacgacctgttggcagcttgcgaatagactcactaaaaatgccaattttttttttaattctatgcagacactgatgagttagatccaacgtcccagacatctcccggccgcaccccccccccccccaccacgcatcgcctccaccacccccatcacgccgctgtcgccgtcgccatcccgctgctcgtctccgttgccgtccccgcccctccgcccccgatctacgcctgggcacccgcctccgcgcccctagatcaccgtcggcctgagtcgccgggctcgtcgtcgccaagccgatcccctccgcagggaggtgcagaaaccctcctcccctactggtcttttccttttccagtttgattcttgcaagttctagagactgatacaatcatgtaatttggaattcaaagttatgtgcacttagaaataataattttgctcatactcaccaaatccctttgattcactggacactcaagtgcaatattgaatccatcaacataacggaatcaaatactggagaggattggaacagattacccccatcaagttggtgaaataaaggagcaattaggacgaccactaaatccgctaatggaacacataatgaacagaaattccttagagcttggagtaatattagcactacagtcactatctttgaaaacgatcaggggagcattcattaccttggcccatgctaacatcagttactcctccactttgactggaacacctcaacacatgtgtcatcattagtttgaacctgtgaacgatgagtttgctattcacttcagggaagtaagctttagtggaaaccttggagcttatgatatcaatctaaaagaccattgagctaaatatatgcaaatctggagttgatttggcaaccacaaaaccaactgatataaatccttgagtccatgtatgaagaaaccacacttcatttttggtgaagccacaaataaaccctaaaaatgatcaaagacatacaatactgtggtattagtacaatgccaatttacaaaaattgaacgaatcatgcatcacaagcactgtttacagaattttggctctgttcatagagaacagatcttcaaagcaaaattcatcctctatttccaattattatttttttgggctttgattcactcatagtagagaaataagagacgcaatagcactgcctgggcattatttgagaagaatgagaaacctatatgtaaattgtccatcctttttctgtacttatagtagcaaatcaatagctcaactaataatgtcattgaccaatggcaaaaaaaaaagatcctataagactgatgtttgaataacccaattaatcaatttttcacctataattttgtaattccatcatagcacaaatgagagagctatgaggtctaacaagaaagaaacataaaccacatcgtttcctttctttttagagcagcacaaatgagaaagagctatgaggtctaacatgagccttctattcaagtattccttgttggaatatgttggtctgaattaaactccatgcactacatttattctacaggaattagtatgctgatagtttacatcaatctcgctgcatgtgcactacaagagaattatgctattgccacaaaaatattgcaacaaacttttattcgtggccagtgcattattctattgccatgtccggtcgccttgtggcaagtagtaaattatattacaacaatttagtattgttgttatactttagttttttttcatggcaattagtgtattttctctagccacaatatattactgttccagtaattttggactctttacaacataccaaaattgttgccacgacttggttaaattgttggaatagtactttttagtaaaacaaatattttttaagtgatgtaaaattttgacgtaactgatatggtctcaattattgtaccccttggagggactgaaatttttttatggcgcctaagcacaggacggtgggagttgtttcagataaatcaacgatcattaatctaactagaatgcctcgtttggtcaatttatttgtttcctttagtgtgtgcatggatttagaaataaaattcaaatgccagtgacaatagttagtctgagcgggagcaatgacctcgccaggccgcatgcacgcaccaccacttgctggaatccttgcctcggagccgtcgtctcgccgtggtgctaggtacatggctgacgctcgctctcgccgaccctgtgtgtgtgtgtgtgtgtgtgtgtgtggatgagtgtgtgtgtgtggagatcagtgggagaccacgcagatagcccagaatttgctctcaggttggggcaattggtattccatagttttcttcagattgtggatctcttcccctcttctgctcacccgatcccctcgtgccgcatgcgcacgaagcctttgcgtgattggcgacgcctctcctccctccttccatcctggatttttcccgtctgtctcctcaggcctttcaaccttcaaatgtgccaccgcatggattaggccataagcaattttcttagaaatgcacatgtcctgtaagaaaatggaatgcttttagttagaatggtgaccctttgtcaattttaagtcttcatgttccacttcaattagttggaatgaaaattccttgtcattcgaaggcttcaagtcccaatttcaatttatggttgtaaacttggagtattagtttatggtgtatcagcattcaacaaagttatgtgcagtttgaaaagagggcaatcggtccataatttgtcttgcatattatcttctcatttgctagttcaagatagcctactaaccactttgtaggaaggtcatcctttcactaattccattttcccttttacatgtgtcgaatttttattaggcttctctgcagctaatacaggaaaattactttagtttctactcagcattcttgtgtgataatggcgttagcagcaatctacagccttttcatcattaacaaatctggcggccttatatactacaaggtattgtttactgtactcctgtttctctttgttctttcaaagctggagtctgaacaccttgcacctctcatttatccaggactatggctcagcagggaggacggacaccaatgacagtctacgcttggcaagtctttggcattccatgcatgctatctcccagcagctgtcccctacacctggctgtgaaggcattgaccttctacaagcccacaactttgatctccattgcttccagtccctcacaggtcttttatcatcctcctctgttgtaaatttgcgtgaaaatctgacctggatgcttataactgcaaagtttttagtattattgggttggaagtcaattattacagtttgtcgttttttctataagtatgcatcctatctctaatctttcactaagttactctttagttgttctgttttctgaatgttgtggagatagtcgcatgaattataagcacataatcatgggcttctatcttgcggttgcaagcatagtctgagtgtgatttacaggctttgcatttgctgaaataatgtttttgtacttgtggcttggcagttgggtacttggggcctgttccttgaagtgggcagcattctcagttgtatgcgttgtgagcatgatcactctcactcgtagcttgcttgatggacaaaatatattaaactaacaaactaacaatagcacactcctataaatggaagtttggacgagttacattgatatatgtgttcaagccatgccaagacttcagttcacgggaagtataaataatgatgaaacaagtttggccaaactaattaaatttagtgcttgattctattgggtattgtgttttctagtttctagtcatttttcagcagcaagatcctagagttctgtccttccaaaattctcgaaaactttgatacaagggagttaatgtgtgagacaatagtattaatctgatacttcaataataagtgtggcttatggagccggattgcaatgtttattgaacttaagtgtgaatgtctgacagaagtgagatatttcttaatctatactaggtgcagatatatacagcaaaaaagacaatgaaagcattgggatatgctgtcctgctcagtatatctttttctatgcaaaacaatttaattggaatgttagagaacatactttcttgactatattgtgccttttgatctttaagtaggccctggtacatctctagagttagttatccagttatactttatttggtgactgaaaggaatgttgctaaattggttcaattgtaaacatagtgacccacttctgtttcatggggcaggtgtttttccgaattgttgattgttagaccaaaaaaaaattcactgtccttttgtggtttgcacttgcctgccgctgatctgtatgattttgcttctgtttcatcagggacaaagttttttgctgtatgcgaaactggtgctcaaaatatcgagactctactgaaagtcatatacgagctctacacggattttgttctgaaaaatccattctacgagatggagatgccaattcgttgtgagctttttgatctcaacctggctcaggtcattcagaaggaccgcgtcacacttctgggtcgatgaatcatttagaaaacatgacgcaccatgtctttgtatgtggcttatatgacatgtatggtgtcagtagggtacttggaattcaggcaagtcattacactgcatcacaaagtccatatacagtgtgcagtcgattccttctagttctgaaaattactttattcctgaagtatcatttgtgccattttggactttatatgtttccagtcgcaccaaccaattcaggaaggtgcatcacacccgtatttgcatttgcatctggcaatgaattcttattgaagagaacatatgaacaatgggcaatttgttttgcaccaatctctatactcaatataacatcctgaatactaccgaaactaattctttaactttaaaatcgcttgtgtgctgcaatattttttgtatgtgcgattaagggtcgtatggaaaataatgatcaatgacattacaaaagctaagaaaattaaaatgtaatattggagcactgtcttcctctaatattgggtatagaggtttaggcccctttgattcaaagaaaattcataagaattttagaggatttcattcctataggattttttcctatatagtcctttgaatcaaaggaatagatcttatagaatcctataaaattcctatggattggctaatgccatgcatgttttggaggaattctaacatgaggtaaaacctcttggaaactttcctttgagtctttatctctcctctaattcctgtgttttttctgcggtccaatcaaacgaccaatcctgttttttctgtattttgcaatcctctgttttacactttgaatcgtaggaatgagaaaacataggcattcctgcgattcggggccctaacaccattgaattagactccaaagagtgtaaacgacattcaaggggtggaactgttcttgggacatcacgtggaggccatgataccatgaagattgttgacagcatccaggatcgtggtataaatcaggtaaaggaaatgaatgcaattttattacttttcggacactgttttaagaatcaatttacggatagtatgaagattcttctacctaatcgaaacatcttacaatcagcgttgattacaagtttgtgcgttgtccaggtttatgtaattggtggtgatggcactcaaaaggggcgcaggagtgatttttgaagtaagcacgattatatatcatcttgatgtgttcaacctgatcaaattatagtttttactcccaagggttggtagtgtatttcattataaataaaatggactgaaagggtcaattaggtctagagttttttttagggggagggtcgaataggctaattaaaaaacttaagtaaacatggaagcagggattttcggaattttcgtaaatggttttcggaatttctgaaaataacagagcaggcgtgaatcaaagtagattctagatctaacagcctaccacaggaaaatgctagcacaaacaacaactagatttatagtggcacaatcaagcaaagctagaggagagggagaaagtgatatcaccaaagatgttacacacgaagttattcctggagttcgaattcttgagagaattctactctctgttgaggggctcacaaagagccggccttagctaaccctttcttcaagaggttgcacaaaacacttctctttcggaggtgagatctaacctgcacaagcttctcccagccaaccacatgtaaaatggtggctcaagagcgacacctagccgtttaggagtccttaacctctaagagtaaaaaatgatgcaacaaattcccggagatgatgtaagtgctcacaaatcttcacaaagacaacaagaaacacccacacaaactcgaatccacacctcacacacacacacaatctgaatcaaacccgagtggaaaggggaaacaagaaaacaaggctcaaatgaatctcaagtgaagcaaagccaagggcatgaaaatatccaatcagtccagcagccctctcaagaggagagagtgggctatttatagccatagctccagatctgcccgttagagtacaataattgcatttttcggaaaattaattttggaactttcaaaaatttccaaaacagcaaaacaggaagcgaacgatgattttcggaaattccgaaattttttttggacaaatccgaaaatatctagaaccaaaaacaccttcagtagacttttggaacttttgaaaattgctttcggataagtccgaaaatttccagaagcatgtttgacttgcagacattttcgaaaattccgaaaatgagtttcggatgaataggtgatttatttgatcatccatatataaaatcctcttcttcttcttttttttttccagaaatttacatttctcaagtaaatgaattagtgtgctcattgcaatctaggacttatcttctcctgccaacaaacactggttgcatgaagaaaacaaatggatgtacaggcgctgaagcatactgttaatgccaaattttggtaagcaccgaagtcgtcatcgatatagagttagtatcggcctctggaattggccgatggaaattatcggtcaccaacagtaggatttttagtggattcgattaaggaaattaatcaattagaagaagcttactcagaagaggtcgagttcaagaaggatgcgacataacaattcaagacagagtaagtttctttttttacttttaggaaaacttgtttagagtctgatcatgacttatatattttactttatctttaggaaagtatgtgtcatgtccaataaggactagtatctacccatgggtataaatatttatacgcaggttcattgtaatctatctctcgatcaatacaaatttcagcgcatcgccaccctctttcctaaggttttatcaccggcagaacttggcacctcgacgcggttctacattgctttgatctccggcaaaggggcaagccctaacttccgctggctctggcaattgtatctgctatattggcattgttcaaggctgcatcgtttcgatatcttggattgctcttgttcagttggtatatttgtctacctgatatttcaattctatctttaattgtattgtgtttagaaacacatcggtttagttgagattgtctcggttaggtccaatcttttatcttagtcgatatatctctacaatcacaatgctattttaaatggattagttatatccatcacgctgagcatagatctatcggcttacctacacccatgaaatcaatcaaagcctgccattttgcagtgggcatggctagcaaaggcctgaggctagcaaaaaacaaaatttattttttttgtgggttatactcatcggtgacgggctttaccttaaagtccgtttgagttatagtcatccgtgaagggcataagtttaggcccgattgagattagagtcatccgtgacgggcgatagtttaggcccgattgagattagagtcatccgtgacgggttatagtctacggccgattgaggttagagtcattcatgacattctttagtctaggcccgattgaaattagtagtcatcggtgatgggcgctagttggggcccaattgagataggtcatccgtgacgggctctagtttgactagtcgtctgggtcaaagctatcggtgacgggctttacttggggcccgattgagataacttcattcgtaatgctcgtatgcccgattgagataacttctcacatcagtgacttctatgctgtgacggatgccatacctgtcacagatggggttgctgcctgattgagatgtgggtgactgttgtagtgtatctaagtgtcaaaatctatatctaatatatagccgaattttcaaaacctattgacatcggctagcatcgctacattagcttgttggccgattagctctttgatcattagtttatctatcttgtttcatttgcaggatcaaactgactgccacgtctgaacctgataatttaggacctgcactggacctgcactcgtcgtaactggtagagaggaggcccaacaacgagtttttgacagggatgcagaggcggagataggggcaatggtggctgacgatgccggtgaaaatgtgggcaatggtgttggcggacgatggtggtgtggaggcctgaagccggtggcgcgtgtggccaacctctgcgatctcccgccacatttcatcgttcctcatcgtatgcatcagtaaggtcctgatatggagctcctgaaattttaagggtaaaggttagggttgagggttcacactatttccttcagtgaataaaatcaacactataccattgttagaatcttaatggctggctcccttctatgtgcattgtatgcctctccacaagaaaagtaagacgagaacaggaaagactgagctactgctaccgctgtcactatatcttgccgccatcgttgccgtcaagcaatcactcttccccctggtcctacaccctctgttggcaactttttgtgacaagtcgacaagcacgatcgcaacacctaaacgccttacggtgatatagagtcgccaaccacctcgatctagccaaagggccaaatcaagatgggttttgtagaaaaacagctaaaccggctagcagagccgatttagagatcaaaatcagcctctaggccgatttagatcgatatgaggataactacccatctcgtgggcaaaacggaaggttttcaggacaaacctacaaagaggtgtcgcactctcgcagcggcggcggacggtttatggcgcaaaccgacaaagatggactaaaactagggtaaaatagaaaacgtagtaaaataacgattcaaagtaaattgtattggggggttttacaatgaactggccttgtcccttaaataggggttggtcttgccctctacaggcccttctccacgccaaactcgggatagaaaccaaaggaaacacgaaacatgccttcccgagcaaggagacccgagacccgacgaaaacagactcggactcggaccctgccggtctgaccgcccacataccggcggtcagaccggccctactagctggtcagaccgcccacacacctgtggtctgaccggccatgtgaaggaaacccgtcactttccaaacattggcaattttctcctatttcgtccttaggtgccaaatttgggtgtaaacacatgcccccctgcctttttggtgaacatacgtgaacctaaaagcatagaacattttatctcagggcgataatccaattaccggccataggacttcctaagcatcttgccaaatgctcgaagtatttcttcaagtatttaccattaattgctctccgaaaacactgtcttgaagtgtcttcatctccttcaaagtcttcaaacgtttgtcgatgacgtcttcaaaattacttcccatcaaggtcttgtaatcttcaaccgacaagtcgtcttgtttgaaataccgaagagagccaagatttacctcaactggcaaaacggcaatttcaacaatgttttattactcgacttggcttatccattagcctgagcgtagtaaagagaggaactcaacaacttaatatcataagattcggcaaaacttatgcacttctttggacataaaagaagctcctttaacgtttgaggaataccgaatctatgaacaatatgctttaaaataaagtcaattatctccgtacaagtaatattctcgagcggcacggcttcggcccacttagtgaagtaatccactgcaactagcatgaaccaatgcccttttgatgacgaagaataaatttgaccaatgaaatccaaagcccaacctcggaacggccatagtttaatgataggattcaacacagcggtaggcgctaattgaacattgccgatccgttaacaagcttcactccctctgtaacatttgaaacaatcatcaattattttcggccaatgaaaccccactctcctaagcaaccaatttatcttacgggctgattgatgaatttcacaaatcccttcatgtactactctcctagcaactttagattgatcattatctaagtaatactccatctatttttcggcgatataatatttgagcgcttgccgccgaatctttcgatcaaccttaagtgtaggatctttcaaatatctaatcaaaggaattctccaagctatttctaactcatgggcacaaatgtccgaattcacaattaattcagccttttaatcaattgtaacgtgccccctggctctctccccgagatcgatcagaccggcgacgcaatgcctacccggtcagaccgctggtaccaccggtcagaccggtcgtgcaatgccggttagaccgcccctggtctatgacttcgccaatttcgtccaaacttttgaaatcaagcatcggccttaagtatatatgttttcttcacataatagccagatgcttggtgtatcaaattatcggaccaaaattcctcctctctagacatattaaaaattataatatccaacaaatatgtctagatgaatactaattcaagtggcttttgaaacaataatcatcatgtcatcaaaacacttagccaattgaagtatgaacaataatgaatcaccaaaatcatatgtgtcacatgcatagattccaataaactacaaatataagtaatcggcttgagcatgtatgtaaaatattaacaatgccaatgttcctaaagaaaaccactctagagcaaatcatcacattgaccattgacattagccgaattactagtaagcaaaactttcatgttgcaataaatatgaaatctatatcttatatggtgatccataaaaacacatatgatttggctttaaataaatatcaaagagtcatgagccaaatcatacttcaaacaaattatatgccaacctaccaattcctctacttagaactggcatttgcaacatgtatgtataatatcaatttgataagcaaaaacacacatgtgctagatagcaagcaatgttctaacatggcataggcatataacggtaaacacaataaactcataccttgccttagcatccaacaaacgacagctcaaagatgtgatgtcgtatccatcgccgttcatctctcttgatttcctcataagcatattgatgtcttgccccccaagcaaaatcggctttcttggttgcgcgatttcgaaggcaagatgaataccgcactaacacccatagcatcatgtgaaggagacttatctctaatgaccgatgattcttctctcatcaaattgaatccatcactactccgtgaaatcaccgatcttttaacttctacttcttaaggtctccacactcgcttaggtgtcgttcgaggctctaaattctcacatgttttgttctccatatcttcggtctctttttctttttgacctatggcccgaagacgctgtagcctcctcttttgagagcgagataagccagaaggtatccacttcggctgtggttgttttccaagagctaagcaatgactcttgatatttttggtcgaagtagaagctcccgtattgctctcaattttcccattcttctccaatgcccctcggtcagaccggccacaagccgtcggtcagaccagccaatagggtcggtcagaccggccacaggttggcgatcagaccggctagatgcctcgatcaaacctccacttttgacaatcacggtgtcggcttcgatctcctttgcttgtatggtttccaccgcatctccagtaggtacttgagcatcttgagactcctctttgacatcaacgacctctggagctttggcttctttcctcacccacaccttcttcacctttttcactttttccacctttgatccaccggaccgattcttttgtgggaaacggtcttgtcttggattagatgaatgacttggtactgacttaggtgattccttccatccttgataatacggcataggtggttgaggcatccatggcatataatacataaaaggataaccatatagtgacattgaatatggataccatggcatcacaactggaggtttgtatggagttggtatagttgatggctccgattggtttgatgtttgaccaaatctcttcctacgagataatcttggtctttttgaatcactagtttgattatcaaatcgttgaccggctaatcctttcttgtacttagccataaacatctcaaaagtgagcttcggctttttggtcatttggaaactagatgactcatcctttgcaactttatgatcttcggccttcgcatttttgatcctattcttgggccgaggatccccaataataacacttttccctttctttttgtcaacatcaataggactaatagggagaggattactaaaaatttcggtctatggcatagatgtaaccgaaattgtttcacaagtgaccgatgaagtatcaaccggtctttgctccatcaagcttgcatctttgaaataaccatgaaactcatgttccatttgtgaccatgtagaaattgaattaggagcaagcgaactaaaccatgtagatgaaaagtttgacaaagaaagaggaagcaattttaacttaagcaaatcatcattaccggccttaccacattgatcgatgaattggccgatatgctcctttgttgttctagtatcctcacttgtgaattttgtgaaattgggcacttcaaatccttgcgggtatgggaccgaatctacgtgttcaggatacggcctttgatatgtatgcattgctactttggattctatttcactactatcccgcaagacattatcatcatcttttccaacatccacatgaccgatttgtgattcggttttaggtgacaacactatttcactttcgcttgtgatacaatccgaaccgtcacttagttcagctatattttcaatgatgctattctctaagctagcaacacaatccgaatcatcacttgtttcggctattccatatttgtctaaactagtaacacaatccgaaccatcgcttggtttggctataatggttgttgcattattatccaagctagcaagacaatttgaaccaacatttggttcggctataattgttatggcatcattgcacaaattattaacacaatccgaaccattgcttggttcggctatacatgatattgcactttcatctatactagcacgtaagctattgtcatccactcggctttcctgagccagagcttcatgcaacacatgatcaacatcaagaaatatctggccattcaatttctctttaatagaatcaagcaatccatcatatgcaatgtcggccaaatctttgtcagttattttcaaactaaaacatcggtttttaacatccctaaatctcttgatataatcagcaacagattcattgtatttatgcctaaccgatgttaaatcagacaacctaagctcagtttcattagtgtgaaaataatcatgaattttttgttctaattgagcccaagtagaaatagaatttaccggtaaagaagtaaaccatgtaaaagcagtaccggacaaagataaagaaaacaagcgcaatttacatgtatcccaattagcctcaccacattgcgctaaaaattgatctacatgctcccatgtggtcctactatcctcaccactaaacttggtaaattcaggaattttataaccacgaggatatgggataatgtcataataatcaggatacgccttttggtactccctagcaagattccttagctttgcgaaattctccctgatagtatttctaaaccaatcctccacagttttaggccttggtggatctggtggtggacttggtggcctagaaggtggttgttgcggcacaatattgttatattggccatacctagtatcgggaggatatcccctattaatatcattgtaggcattagggatatgtggaatagcatgactagcagtattaacaggtgatgaataataattaaaatcagtactgctagtcgtggtatgaaaacctagagaaattcccagggaaccggtctgaccggctatagatagcccggtctgaccggtagtcagtggtgcggtcagaccggccacaggaggcgcgatctggccaggatagagcacggtctgaccggctatggtaggcacggtctgaccggcgtagcacacggtctgaccggccatggtgggcacggtctgaccggcataggatgcggttagaccggtgccatgaccagtcataccgttagctagattttgcatatagccgattcctgtgtaattggccatataaacacccattgacccccatagcattataagcatattgtatagaagcaaaactagaagtagcatatgcatctacacaacgatcattaaccttttgaatagcaaagtatgggttgggcgaatcggaggttaccttttggtgaaactacaacttgaggtagcggggcgtttcctctcacgacgccgtggtcggtcctaatgtattgtgtaatagtattgttgaacccgttcccgcttatcatagttgatgaagaaaatccttgattaatttcggccatatagctcatagccaaaatatttgaccgaataaattaatatacggtcttaaaattttccttgtatgctactgtactcggcaaaagtatttgatttatttggtgtactcggcaaaagtatttgatttatttggtaatcaaccgagtagacttagcaaaatttggaaactaatctaaagcttcacagtgtaaccgatacaaattgaatcggtttttgtctttctttttttaatgtgaatagtaatagatcggcttgaatagcctgatcttttctaacccgtgtacagtaagctttggtcaatcaaatctttctgttgccgtgtggaacaaaaaggaaacaatgttgctaatccggctgctgctccctgtgtgaacacagtttaacgtctagccgtgatcgaacagaacaattaagcttaagcttgaagacaaaaccaatgtcggcgacaataataattacagtgtaggttaattccggctgtttagccgaaactaattcgatgattcgacgaaacagtaattattagattaaacgaaatttggccgtagtatggccgattagatcgttccccagcgaagtcaccaaaaatcgtgttggcaactttttgtgacaagtcgacaagcatgatcacaacacctaaacgtcttgcggtgatatagagtcgccaaccacctcgatctagccaaagggccaaatcaagatgggttttgtagaaaaatagctaaaccggctagcagagccaatttagagatcaaaatcagcctctagttcgatttagatcgatatgaggataactacccgtctcgtgggcaaaacggaaggttttcaggacaaacctataaagaggtgtcgcactctcgcagcggcggcggacggtttacggcgcaaaccgacaaatatggactaaaactagggtaaaatagaaaatgtagtaaaagaacgattcaagtaaattgtattcgggggttttacaatgaaccggccttgtcccttaaataggggttggtcttgccctctacaggcccttctccacgcccaacttgggatagaaaccaaaggaaacacgaaacatgccttctcgagcaaggaaacccgagacctgacgaaacaaactcggactcggaccctgccggtctgactgcccacatacctgcggtcagaccggccctactaaccggtcagaccgcccacacagctgtggtctgaccggccctataaaaaaaacccgtcactttccaaactttggcaattttcccctatttcgtccataggtgccaaatttgggtgtaaacaccctcctcttaacaaatccgacggcccctgagccagatccggtatcgaggtggagagggagaggaaaagagcggagaatgagagagggccgctggtggggtggagagggagagaagacgataatggcggagatacccgtgcgtcgccctctagggaccggatccaccaacgaggacacccatggtcgaaggtggttctgggtgaccggatgcaccggtgaggagaccgactccgaccgcccccgagctagatctagcataatggagtggagatggcgagaagggagaagggggcggcaacggcttgcaaccgtcccatttccctaggtggccggattcgttggcaaggagggcgacacacggtggtgtgacaaaacagggacgcggcggcggcgaggagggggggagggtagtcaacgacggcggtggctaggggaggacggtcgatgatggcaataggggagggcagatggcggtggcagcagccttaggacggcggcggcgcggggcacagtcaggtggggtagatgtggttttgttttggaaaagcccctttatttttttatatttacaatgctacccctagaattcttcgtgttgtatttctctgaaatacgaggtatattcatgatattgtgatattccgtgtaaacacgataggttttttgcaaaacagccaaccacgtgttaatctctccgaggaggaaaaaaaaaagggaaaacagagaaccggtatgggtgggactattatgaactaagtatgccttcctattccagtactccttcggtagcagtccagcaaaggcttaagggcaaagggagtaatgaaagcgggaatgttgtttcgcatataggacaaaccagatttcgagttacttgtccacaccaactgatcaggcattggaaaattgtccaatatttgtttgagcgaatcatcaagattgacagttccctcacaacacctattcctcgtcttgaagatactcgtaaggcccagtctgaaaaagattgatccaagaaaatgccatacaagttttttttttcaggaaacatattttttaaagtttgtagcaaataatgtgacaataataatccgatgaagtagctaaaaagaaaataaaaagagccaaaattctggtttctatgctacgtgccctcggttatctttctcaaactcaaagtaggcagaccaaggtgacagaaaaacaagacagggcttgggtatcagagtatgccacagtggacaccataaggcatgctgcaagggagacaccagtatgagtcatcagatggccataggttgtttgaatttgatgtcgcttagcttgacttcgaaaccagggtagtaaaataaatgttcccagcatatcagatggctgatgcaaaagaaaaagggtgttcagacttcagagtgcaactattcagataacaagtactggcagttaaaacatagctataacaaaattgcgcagaccttcttcctcatatgaccacatatgctgctaaaattacatattaagattacaacaggtactcttccaccatggtttcctggcacaggagtataacttttaagttgcatgtgttaagaaccgtctcccgtgatgatgcttgtcgtcatttcttcaatgggaactcaggaatattctgacgaggtgatcttgattcacgacgagatctacaaggaaacaggaactgaatcatggactgggctaaagaaggacgtcagcccacgataggagtgccatctcagttttgctggtgacctggaaaagagattagaagaacgagagagcaagagtgacctagctcctcgcgcgctacaagatgcaacattaattttcactggcatgcagccaatacagcaggaggatgagtgaatggtgcagttatggtctgattaaaaaattgaattcgtgaatatagacaagctaaagcccaactattgtataaaccatcttaaagccaaatattttcctgacatggtcatttttggagctaatagcttactacactattagacttgctctaagctgagcatttttcctggagcatatttatatcacacgacagatatgcagtgatggcaaatactgatggtaggcaacaccaccagactaagcgagtcataaaataagctcatggcagcaataacttgactaggtaagccggggactacctaattgtgatttctaatgaatacctttccatgtttctaacaaaatatgtcaatgggaagaaaaggtatttacagtaattaaacataattctgctcgctggactgctacccaatctacagagagaaataattacttccagaggttcacagaaattagacattcactattgtctctagagcagttactatcgaatttcagtaccacagtcaaaacttcattaaggaaatgaaaattaagatagctcaaacccaccttaataactctaggcagggccaataaggttttttatttctgcaaggcagtcatcgagagctttatactcaggggtatgtaagaagtctgaagcctagacaagaaaagttccaacaatgagcaatctggaggaattgaacattaaaaacaaacagacttaaatggtttagaaatggtatattttttctttttataatgttgtttccgagccatttgttgcaggtaatcttagcatcccacaataaccccttgttctagtcaatgatcctaaagtcatgtccaacctactaatttcataccagggaagaggaacagtgcaaaaaaaaaaagatacctgttttaaggagcttttaaggtgcatctcagctgaaaataactctctttggcttccagtcgaagaagaaatttccatatagatcttgcaaagctgcagggaagcttgagcatacttagtgaacttcgtctggtcatgccatagtccagaaccctgcgagtacaataataaattaataatatgacaggacaaggtaccacaagattaaatatacatcaaatataaaacagccagcattaaatgatttcctgagatgaaaatgaagcagaaatctgcattctacatccgcagacttgctgctaggggtcaacatggtaaaattggatagtgatcctctgcattagagtataaaattgtgtgttacacatttttttttctacaaggaatgttcacctcaattcaatttatatgtggccatccatttagatttgtttgttttttaatattaagaagttcaagggataatttgcaatggaagtaggtggggtggcagattcagggccaccaccgctaccttataaaggagtatagaaaatggagaaatgctacagtaaattgcattaagagaaatctgcaccatccactcacaatcctatgccaatggtcaacatccacagctcgaatgtgatagtactagctgactgataaatactgatgctacagtacctaactgatctgagccgtttgtttttaatgctcaagtgctaatgcaaaacactgtagcaccttgcattagcagttcaaaatgcagaggatccggatccggtaaaattaccatcctgacttttgcaaaaagaaagtagcaaaagaaagccagtgtccattcaagcatgtcatgcatgaactcaacagaccgcaagatcactgcgacaatacaacactagcatgctatgctcaagcagattttctagtagagcaacagttaagccacctgccataactatcatccaagcaaggtatgtcagggactcggggccatgaggaggtgaaacacagaaataggagaaatcagtgaaacttttaatggtaggcagacaaacaatatgctatgctcaagcagtagcatgtgatggtcgtggctgttggctccttgctcaagtaccttttgataagccagcaagagatagccaatgccaaagtgcatgaagattttaaaaagatgataacacgtgggcatacaattttcttaatttgtttgttcattcatcatatcttttgctcaatgcttgcatataaaaaaatgtacgatagatagtgatcccggtcaatcagaaggagcatggtttggtcaaggggtccattagagtattgggtgtacgatggatagttccgatcagacaactacaaaaatttaaggggtccaaatggacctttctttttttctttttctggcaaatggtttctacccaaaactccaagcatcataaaacttatgctctctactagatacactggaatccaattttcccagtggacaggtccaaattctacttccaatcgagatctggaatgttgtctcaataactcaggacagatttgtgaaaatttgatacgcgatctccattacacacaaaaaaaaaaactctgtccaacaaagaatgcaatcctagcatttgaaggacaaattagtaggaaagtgaaatggcctaaatgtccctaattaaataaagggtgcttaggagtgggactgtgggagggagattaggggtaagatggggagaaatttgaatgagagatgattgatgggacatgtagtactctagaattgtactttttgtgggacaaaatttgaaagatatgattgcattttttgttggacggaggtagtagcagatagggcaccccgtcttacaatgagccaacacactgttttgttggtacttggtactagaaggctccccaatataggcaagaggaaaaggcattatcactgtcagcataagcatagcatacgcacctggagagaccgaacttgcttcaacatagcttcagagcatgcgataaggttacccttcgtcttatgccacctcgcatataaaccccatatctccgaattgctacccccacttcgtacaatctacaaacaataccaatcagacttataatatcaaagagatgttggaattaagatgaaatgcaactcatagagcttacaaacctgctgaaggatatcaccaattatatctaacaactggttgtacttcctggtctcttgatttgcatcatctgaggtgcttctggaagattcagcttcttgagtatcagagagatgtgtaggttgttcttcaagcatggccatcaccttttccaacaaatcaatgttgaaacgtttgttcgaggataggtttagtaccattttgacagcctctagtgtctgcacagggtacctcatattatctcaataatcatgataaacaaattaaaaaaatcatactagctcgcatataggtctgagatattcaaatgagataaaaatcctcatcgagctaaatgctcaggaaaaacacatgtaactaaacttgtttgaagggtttatagtacgatccaaattacacgtggctgcatctcacaacatcttaggcatcatattacttgccaacatggcatcacaatgttttggcctcttttctctatccttatggctttcccgtgcctcggatctggacaagacaaggcgagaaagtggtgttctgcagtagagacctaaattaggttggttgactgttgtggattccttgtccttttggtttatgatttatgttggccatttcggcatccaaagtaaattgctctccactgggtggtgaccaccttggaggaccaagggcaggtgtcagatcgcttgtaggatagaaccatatgtagtttggacttagaaagtgcaattgtagagctttggcgcctacatgatttcttgcaacaaattgaacaaccaatgggttttttttcttcatggtatggtaaagtatggaaaactatctttaaaaagatgattatcaacatttcgtaatgaatgagaccaaaaaaaagacaaatgaagaaatagaccattgttaacaaggagattgcgtgaaagcaataaaagtgggtataaaattaggagatgagctctcgaatatataagaaacttatgcatgtgatgagtctcaaataaacatcacctaaaaatttaaatgcaagcttcaagaaagaaatataaactgagtctttgacatcaatacacagctcacctgttgaatacttcctgtgtccaaaagaaccttactgtaattatcccaaacctcccaactattcctcctaaaaacaattgacttatttttaatcagaaactttacagaattaaagtaataaattttgtacaatatgatgttatacgcacttgaactttacagcttctttgaatgcttggactgctgcttggctccttcctctaatcatgtgcctggatagtaaactacattagagatatattccaagagtgaacctataacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5230 - DNA, 93658 bp, Oryza sativa
  unsure (1)..(93658): unsure at all n locations
agttttgttgtttagactataatagtatgaattaagtctagatatggaaattaactaggaatttacaaagttttttagagtgtatgtattactaatgtactgatgtaggatatgtaaagacattttctttttgctgatcgattttgcttaccgccccaacaataacctccaactccaacaacatatttcccttctctttttagagcagcaaagatcggtttagaatcttcagctgccttcacctgaaatttcaattgaatatactgatcaatatcaattgactcctcgataatcgtcgttgaataagctatgtaattggtgaaaacaattaccggagagtgagccatgatccattttgtaatgtttatacttgggtctccattgtaaggtcgcctttggaagaaatctggcaccacgacgtaatatcccgcttcaccaactttgtcagctattttcctgtaattgtcagcattattaaccacaaatttgattttaaattgtctttgcaatctagaatgggagtaaaaatgtaaggtgtattgaaaggaatccagttgggacgttttacaatactttcaagctaaaggaagcacttaaaattggaatgaaaaacagaaaccttagtacaatccacatgaagaaatctttgctgttataccattggaatccacgatatttttacagaaaaactgaatttctgaaattggatcgttgcttggttatccattcataaatcagctttacaaggacagcaatgagatattactattgactattgagttacgacagcgtttgcccctaaagaaatgatgttttagaaagcatgtaatgaacatagttatgcacagtaatacagtatacaatgatagtactactccttttgtttcaaattaattattgttataactttgtcccaagtcaaatatttctattttagcctattaataactagcaatttgtataatttaaatacatgtggattgcatatttggaagtatttcttattgtgaatcaaaaaacatattaaaacttatgtcatcaaaatatacattttttttaaaaaaatgattgttaaagttagaaattgttgacttaggataaaactagaactacaaataatttgtaatggaaggagtagtagatttatcttcaacttcgtagggatacagaagatgaaagttttagcatatatgttgtctaagtagagtagttaaaataatgaaattgcacattgaaagtaaatgatgtatttcaaccgcttaacatatttatatcattagaaggtcagaatatggaaaatagcaaaaatgagtatacgcttctgattctccgtatgaattgatggttactcaaaaaaaaaaagatactaactactccctccgtttattcgacgccgttaaattttttaaatatgtttaatcatttgtcttattcaaaaaatttaagtaattattaattattgtcttatcatttgattcattgttaaatatacttacatatatacatatagttttacatatttcataaaagttttttgaataagacaaacggtaaaaaatttaagtaattattaattattgtcttatcatttgattcattgttaaatatacttacatgtatacatatagttttacatatttcataaaatttttttgaataagacaaatggtcaagcatgtgctaaaaaatcaacggtgtcaaatatttaaaaacggagggagtatttgaaacggaagaaacatgtacatagcaatgttgaatattctttgttcaagctcatggatggtgagggcgaatggacgattatttgcttttacacttttgcgtgtctaaagtctaaacctgttatccttctcacaagtcactgcagaaagataggagatagttcactaaaactgacctgaacccattgtgacaagaaaaacaggtatggtacacaattaagccatatctgtctttttctttttttttaaatcagtctctttccagagttgttcaagtgtcaagtatttgtcatgccctgttctctttagattttcccccggataattgctacagattatttggtccatgctttaaaaaatattatttattctactgcattattagatatttgcaaagttcatttttcaaaatattaatttgttatgttaataaaataaacaatctgcgcctataatccagagagtgaagaaatgaagaaaattactgtcgaagatgacaacgaacaagaagctaaaggaaatgaaaagaagattttgtacctcagcaatggtgcttcaaatcctgaagaaaccaaattaacagcaacaattaacggctaatcaatcgataatcaccaaaggatggcagtgagccagtgactgatcagtaagcaaatcaggcagacatgcacacacacactactaaccaaagacgtcggaggcgaggacgatggcccggccggagtgggcggcgccgccggtgacgtaggccgcgaatcctcccaggttttggacgaccacgccggcctcgccgtcgccggcggccgtcagctccggcgggttctccaggcactgcaaccgcggagaaccagcagcgccgccgccggccgccgcggcgagcacggcgaggcagaggaggctccggtggagcatcgacgtcggtgccatggtgatgggtttagtttgcatggtaatggtcattagatgcagagggttttgtactacattttggctttagcacggtaggtagcaaaaagaagacgcacttgacatgttagtgtcgcattgatgttgcaatcctaccttttcaaattgtgccattctgtcatgctaaatctttgttacacgtggccaagttcgttcgaaagattttatctcggtttctgttagcgcgttttttaatatgttaaacggtacatctcatacgaaaacaactttcaatatagtagtggctttgaaatattagataaaactatttttttatttattttgtaagtttgaaataattaaaactcaaatgatcatacgttttctcgttttctatacccatacttaatattcatctaaatcacttccgttaacactgatttgagattggatggtagcatctcatctaaagaagatgaaactgcgccttcagtttcatttgcagaggtccctctttcaactttgattttttttcttccccggcgtttaatttggagatcttacctttctacttagagagttgagcttttgagttgaattccttccattatttgttcctcaccaccaatacaaagaatcatttctagtgttcgacactaacggcatgtcatttcctgccatcacattgtcaaattcaccacctaccaaattttaccccgaaaggaaatgggccatgcaataattctctaactcaatactgggaaggcatgttgttaaaaacttgcttcaatttccccgcaaatatcacattcgttggcactcctgtaatcctattcgtttccatgaaaattgttgagtcagagaagccatcggctggcatttagcccaacggttaagtgatgatgctgtctcgttttctcaattaccagaactcctgaatcattactttgtcaagagctacatttctaaccattgtaattaagaagtacaagatcgctgattgcacatcaacgcattatgttattatcagacacatgagatgtgctatcacaagtttatgccgcctaaccttcaatccttcagttctttccttcaagctggaaggcaggcctgccatcaccatccgccacaacaggctgctacacaatgagggcccctttgaatcaaaggatttatataggaatttcattggattcaaatcctataggaaaatttcctatttggccctttgattcaaaggattgaaacttttcaaatcctatgaaattcctatagaatgacacattgtaagtggattttggaggaaacttagcaagaggtccaacctcttggaaaaattcctttgagtctatatttctcatccgattcctgtgtttttcctgcggtccaatcaaacgatcattcctgtgttttttctgtattttgcaattctctgttttacacttcaattcctatcaggatgaatgaactgtactttttttatggaaaggcataggaagtcccgtagtagttgcatcaattaagtcagaaaaccttggccagaaagaatttaaagaaaaaaaaatctgaatattgttctcctaattacctgtgttttggagaactaaactaacaagaaaacgtaacatggatgggggacataaattacagatcgtcgggtggtggcagagtgtaagaatactttattccccacacttcttagacaaacgaggaacaaatttcgccaggcaaatgaggaacaaattgaaaggaacaaaactggaagagacttggaaaatacagtacctgcatgtcttgttggtcgtgagtcttgtcaatccatacagatctttataccaatcagtccatacacataatgtttaggtgttataacggcatcaatggatcttcttaatctttagcgagtgatgcttgccattttctgtaggattcctcttaatatatacagtgtttatagtcgtcttgacatgttcacagccatcacactccactattccaggctttctgtaagcatatcatacttgcattccatgtgagcttgcaagcaatcaagaacagccaggacattgtttacttggtggctctttgatctgttctctgccgtgaaggaataaaccttatcaccgacttctatccagctacacccaatgttcgtctttaggcctctcgccttcattgccatcctcactctggccacatcactccagcaaccaattgtggcatacagatttgctagttgtatatgagttgcagcacaacctggctcaagtttaagacggtgctctgcagcctggatgccgatcgaaatgttcccatgcaccctacaggaacccagcagagagccccatatgacggcatttggagggatagacattgtttggatcaaatcccacgcttcttcaagcaatcctgcgcgcccaagaaggtcgaccatacatgagtagtgatcgagccctggttttattccatgttcaatcattgtcttgaagcagtgtcggccttcctccacaaggcgtgcatgccggcatgaagaaaggacaccaaggaaggagagagcatcaggtactatgtgttgcctctccatttctttcagcaagtcaaggcaatgcttagcaagaccatactgcgaacatccaaagataatggcattccacgaaacaaggtccttacaggcaatgcagccaaatatgaactgggcttcatcaatacacccacactttgcatacattgacagcagggcattggaaacatgcacatacgaatggaaacccattctcatttgtaaagcatggacacttctaccaagtgctagaagtgcatgtttagtgcacacactaaaaagagtggcaaatgtgatgtcatttggcttgcaacttgaaagcatcattgatgcaaacaaatggagacatggctcaacccgattatgaagcgcaaaaccagaaatcattgctgtccatgacactgtgtttttggttggcatggtctggaaaaccaagtacgaactttccaactggctacacctcgaatataaggtgatgagtgaactgccaataaagacagttgaatcacagccaactttaaccaatagaccatgaagctgtgtgccttgggtgaacatttgcctatcagcacaggaactcatggcagctgccaaaatagattgatcagtactggtttctcctttcctgtgcagctccattatcagcataaacatgtcctcctttatgaatctagtcctggaacacaaagccgagccattatttgaaacaaagctatcaaatttagcctgtgcaggattgctgcatgagttaaaagtgacaccatttcccttgtgtatagtatgatttgattgaacccccaagatgtcattcatgcagtcatggattagtcggtgatggcatggacctcccactttgtcatagtcagcctttcttggtacaagattcaaaacttttagcgcactgttgatgttgctgccatgctggtcctttgatgtgctttgtgctgcagaagtcccatagcttgcaacaggtacacgaatagccgatgctactgctgctgacaaactgctgaaacagccacctacaagacggttgtgcataactgaagccgtccatgtgtgagccaatgagcacgattgaggagcagaaaatagcaagcaatccagagcacttaacatgtgccatggagtcccagtagagccccaaacatgtttggaagataatctgcacccgcaccttgggattaatcttgctcgctgaagaagaagcacataaatcatcaaaccaaggatagatggataagattggtaaggatagcaccatggagaaaataaaaatctaaaaggctataactaaatgaacggagagtaagattttcgatttgattcctcacagacacagcattacagcaatctaggggttccttaaaacaggagaaatcaaccaaaattcaaatggacctccccaggatttcagagttataaataaagttattgttcaaagattgataacagcaaaaaaatcaactacaaattacaacctgtgtagcaaatacaactatgcttctaaatgcaagaaaaatgtgtgatctaatcgctcgagaacagtggcggccccaggattttaaacttgtgtattcgaaatagaaaggggtaaaaaaaatttgttcatagacctaaaaacctaataattggctaattggcttgtatagtatcacaaactaataattatataatatatagcgtataattgagcataaattcacacattgatagaattgatcatcatttgaaattgtttaacatatagaatactaattagtaaacatatcaaagtgccaacatatgaaatacataaagggtagaaaatgataaattgggaagaaatcttacagtttggagatcaacttttcgttgtttgatattttggaaataagtgatgatgtccttgtctttaatttgcaagaaaaattctctttcaatgaatgtaactaaacaatcattcaactattgttgccctatcttgcttctcaagttcatacattatgatacaaagcacaaattagcatatatgatgcacagaaatatgtttgctaagtcgctagtaatctcaattaaaaaaaggttgttagcccattactagttcatccaacatcaggatcaggaacacatggatgctaaacatagaaaatcatgcgaaactgaaatctagatgcaaaacctaagtaccgaggggattcacatgagacaggagctagggattaaaccaaaccaggaggaaggatcgccggggggtgcggtcgttacctcggggctcgggacttgatttcttcgcgctgggcctcgaggcgggtagagcttgtcgtccatggccgcactgccgctgtcgcagcaggccgcgcgtcgcgccgcaatgccgctgtcgccgcaggccgcgccgcgccgctgcctcacgagtcagccgctgccccgcgccctggcgccaagccgagtggtcctcttcctgcgtcgacgcctccacggccgtgcgcccgctccgccgccaccctaggagatgctgcgccagtgcgtccagccggcagccgcccctgcctggctggctgccccgcggtcgccggctcgccgccgccgtacaccgcgcccgccgccgcaccgcacgccgcacgcagcgccccccgccgcccgtctccttgcaaagctagggttaggttagggaatttgggaattggggattttgggttagctgcctggcaggtgagtttggcttcgaaatggtcttagttgcggcccaagtagactacgggccgagtgaaagggggaggaaggtggaaaatttagacccaatagagaaagaaatggcataacgaggcccaaatgagtagtttaagtctttttctttaactttttgaatacatatatgaactatagagtatatatacctattttttgtctaaaaatcttgggtatacatctgaatacccttgaattatagctgggcccgcccctgctcgagaagttcagcgcttcagctagttggcacaaatctgcaaagcttgtaaacaagtttatacttgaggagcttaggttcttgtttgcttcaaaattttttgattttccagaccttttaaccactatggacaacagctataaagaattaaagattgtgagttgaaatggaagatgcatcagttctatttcttcaggatggaagtgatctagcattctagcctaacccaacctattcttgccaggataaaaatggcccgttcactgattcaccatctcgaattgaacaaaaaaaaaattgagtggggaaaaaatcaggattcacctgcttgctacctgaactgggaacggtgcccgccagcccaggacgccgcccgcagccgtccgccgtaggctgcagcgagcgccggcgacctagcctcgctgcatggcgtgcgtggccctttgaggcttgggccgtggacaacgccggacagagagagagagagagagagagagagaggtaggtttagcctggacaagcacgctgctccgccgctggtcggcgccccgccggctggcctcgtctggcagccgctgcgccgctcgatctgctgccgcctgcggagacgatttgatggtttggttatgggactttggccgaaacacatgcagggatgagtcggggaaaagatggcccaatgggcttaggtaattgaattttgaactccattttattcggaaactgaaactgtcagccttgctacttaactactaggcatcactgtatgtataccaccaggtgttccctttgttccattttctaagacattttatatcctcttttatttagacttataagctaggggctgatcgggagatattactgtggctatgcaactgcagcggtagcatcaccaaacccaaaaccaggggtggatccagcaatgaaaaattggggggggggggggggggggggaggctcaacctataaaagacattactcccaaaattttcaggttttcctggctcaaagcaaacataacagtacaagcaaaacgctgcattctttgattcactgtactctaaccaatcatagatctccaaccaacgttgttggaaagatctctattcaccactttgccatttgtgaggaaatgtataaccaactggttgggttgggacccttaaaacatatgccctcttcacttgatctctaatctcaaatggatactcatcaatttgcacattcctggatcactaacaatatctgagcaagtgaactagacccttgccaatttttgttgtcttatgttctcatcgtcctctgatgcagtagtactgctactgccacttgaataatagttgaacaatgttcttttcgagatgctgagattctagtctagacaaaaaaagaaaatgaaactgtgctaaattgctaatggattgaatcattccaaatttccaatcaattaatcattaatcacaattgcattgcatatttgcataaaattctaaacattacataccttgtttagttattctgcctgcctgttgctcgcctggtcctgcctcttgctcgcgtgctcccgtgacgtcgccggcgccgcccgccgccgacgccgcgcgcttccgcctgctgcctcgccggtaggggtgaaaacggttcggaatttttccggattccggacctgttttcggaaacggaatcagccggtcggaattttttcggaatttcacggaaacggaatcgaaaacggaaatattttttcggaaacggaatcgaatatgataatatcagtttccgtcggaactcggaatcggtcggaaaaattccggaaagtttgtcggaatttccgaagttaaaaaggcccatccaaatagtccataattcctccccaaattcccagcccaacccaagtccctaactggctaaccctagagaggagagagagagagagatcgagagaggcggcgcatcagagatcgagagaggcggcggcggagcggcgcatccaggggtcgagtgcgccaccgctggccgcctggccgccgtcctcggctagtcggctctctcgctccgtcctcgcccccaccattttcgccggcgccaccaccacagacgacgccgccgacgcggacgacgccggccactggccacaccgtcgatgccggctacccactaaatcacggaaaaaaataaaattccaaaaagaattcaaaaaaagaaaccctagccgtcgcccaagctcgccgccacctgcccccgcctcctcgtcgtcgtcggcggcggaggtgaggaggagatggctttggcgccaccgccctaggtctccgctggggcttcacccaaggccgccgtcggattcgggcgggacgaggtccgccgccgccggatccgggcgggacgagaaccgtcgccgccggatctggcccgtcggctcctcgtcgtcgtcggcagcgacggtgaggaggagatggcggtggtgccgccgcccgaggttgccgcccactcttcgaccgaggtcgccgcccccgccaccgccagctccaggccggagcccaaggcggccgagccatgccgccgccgccgccgccagctcccgccaccgccaccgccgccctaggaggagtggagaggagagaaagagagttaaggaaagaaagagagtgaggggagaggatagaaagagagagagtggaggtaaaaatatcaggatagggagagagaagaggagatgaaaaaatttgaagcgaggaggagtgaaaaacaattaattttaaaatattaaaactttgaatcgaattttatgatattaaatgaacttgtgtgaaaaagttatcaaaaataaagttgtagaactcgttaagatctaccaattttcttttggccatttctccattcaagtttgattggactatataaagtttgaattttaaaatataagaaattcaaataatttttcgggtagtaaatgatttcaaatgggaaagttgtcaacaacaaagttgtataactcatcaagatctacaactttagtattggtcatttttctatatgactttgtttgaacagtttgaatttgaatttcaaattatgataacttcgaataatatttttaagtattaaatgatttcaactgaaaaagtcatcaataacaaagtggtataactcatcaagatctataacttttatttgggttatttcttcatccgataaagtgatttataagatcgttcacaaaatgtacatatctcttatatagtttatagactataggagatatatgtaaattttgtgaataatattactatcactttatcggatgaagaaatgaccaaaataaaagttatagatattgatgagttatacaactttattgttgatgactttttcagttgaaatcatttagtacttgaaaatattgtctgaagttgttataatttaaaattcaaattcaaattatagaaacaaagtcatatagcaaaatgatcaaaacaaaagttgtagatattgatgagttatacaactttgttgttgatgactttttcatttgaaatcatttagtatttaaaaatgttgtttgaagttgtcataatttgaaattcaaattcaaattattgaaacaaagtcatatagcaaaatgaccaaaacaaaagttgttgatcttgataagttatacaactttgttattgacatttttttcatttgaaatcatttactaccctaaaaaatatttgaattgagaggaaggaggcattatagacttctcggcgagggaggagcaaaagggctgggccggcggcccgaagagggaggaggggaaggggaagccggcccgtggagggagagagaggctgcgggctgcgggctaatagtgtatactttataccttataccatggtattttgctgtaatttttttagaatatttgttatacaaattatatgaagttatagaagaatatattttgctgttgagacttaccaattagacttcatataattgtgttttataatgaattgttgactgttaaaacttgagaattgaacttcacaaaagtttgaagctcagtttgaggggtttctgtattccgataaattttcgttaccgtatccgcaccggttcgttttcgctctgttttcggtttcgataatattcgtttccgttttcgtttccagggtttccgattccgattccgattccgaaaaaaatatggaaacgaaaatgataaaggttgtttccgtaccgtttctgccggcgcgtgctccgctgcgccgctcgtcttcacctcgccgcctgcccccgcgccgctcgcctcttgagccgccgaacggggagctcactgccttggctgctagggattcggggccgggtactggggaattaggtagtggaaaaagtgcaccgaaggtcccttaacttgtcattgaattacaatatcgtcctccaaccgcaaaaccagatatccggcaggttcttcggtggttttttgacaaattgacccttttcaaaaacttatttcgaaactaacccctgccaaaaacttcaaccaaaactaggccgtcggctcagcgccaagcgcattggcgctgaggttggccgtgtcagcgccaacgggactggtgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcgatcgccaccgcgttctcctcgcccaatctcccccaaaaacctctctaatcgaaggtgatttgtgcggcattgagtttgggatcggaagagaaggtaaacccctctataaaccctaagctccccaaagttttattggatattttgcattgttttggttgtagacgtggtttgataatagttggctaaggatggattattagatggataatatgggtggggatgaagtgtggaggtggcatatctttatctatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattatacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagagcttaatgaaagtccactcatagaatcacccattagctgtcacgaactgtcggagaggtgtagtaggaaggaagaattgattgaggaagacgtggaggggggcgagggagtaaatgatatggcggatgtggaggtcagggaagagaatgacccggtaagggaggaagtacatgctgaggagaatgtgccgttaagggaagaagtacatgtagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaagatgtcagagcatgaaaggactgtgtttgcgaaactggtgggtagaaacccggaaataacacaattcgaggatcttaccagatctggtgttggtgaaagatagcggcagacggcagcactttgttggcagaagatcttcagtgggtgattgatggaaagagaggggaggcgcagggtatagctatttcggagggagcagctcaggtggttgtgcgtggcgacgacgggggagatcctgagcggcgtagggggcggcgatgtgggaggagagcgatggctgcgtgatttggggaggtcgtggcgcggttggcgtcgccaatcttgcaaaatactgaaggaacacaaagagaatcaaatccagtatgagtaaaaacttttgaaagtgcagtgtgacagtggaattcttctgtttgaccattttagtgaatagttttaacaattgtcaggaaacatattcatctagattagagtgtttatactcaacaaaccaatgcatatggaagatcaatatgtacaaaggtatattactacaaggtttcgatggcaatccatgcagaaactaaagggaaaaagataaatcaacagaatattaagaaattagctctaaaaacaatgaggcattcatcagctgcaatgaatatcatgaaaaattgcacaaacatcaataggtttcgtacggaataacatgacgatgaaatcagaactcattcaactgcatgattgtctagggtgaactgaattttcgcctcaacttttttgcccccccccccaaaaaaaaaaaacaccctaaaggcatatcatcgagcactacgggagcaatgccacaatggtaccttctcaggagccacagtattttcgggctggaggagcgcgccacgtgcaggggggggagcacggcgggggggttggacggcgattcaaactccggttctgccgcccctgaattttctgatacggggcggcgcgatagcagctgggcggcggcgaactgcggtcggggtgaggggtcgccggcggcgtgatttgcggccttgcgggtgtgcgagagagagaggagagaggggaggggcggcggcgcgatttgcgggtgtgcgggcgatctgagagaggaggggataggggcgagaggtgagagaggagggggaacgtggcgatacgaggggcgttggcagggtttatacattccagcacggttttcgacaagttttgtactagtaccgaattttaattttgaccaaatttactgtatgatatttgaatttgtctgaaagcattcgaaatcccaatcaaaccgagccttgtcaaaacgtcgaaaaaccgcgaaaatcgatcggctttcattggctttgtaaaccatgggcgttggattagatgattatatggatcatcggatttgatataatataataaataatgaataataatataatatataataataaataaatcataggttaatagactatagtgcaacagtaaccgtgtaggcgtgtactagtcatgatgaaggaattgaacatggtgaaggaattgaacgtgttgacttgtgtaactggtggtaaatctagctatcaatttagtctactatgttgtagcgtatcgggtgaaattaagagaagaaagtgatagtactcattattgagtgaatttttttaataagtggttatagctttttaagtaaaggccaaaattttttgttccattattgaaaaaatagcaaagcccagcaggcattgagagggtagaaattagcaaccaaattcagattgcagacactcattgtattcagcctgcatacatggctgttcatgcaaatttgtacacggacaccggtaatttattctgaataaacagtcgcatgttctttcatgtatttattaagtttcatcacttcaagtgtttctgaaaccagtccagcattaaggcgagagcttgtttcccggtttcgagagcaaacgggtcgctggtgttatatcgaccggcaaatccatgggaaactcctggaaaaatcttggcgtagaaatcaatctgcaacaacaaaaatatcatggtgttactctgtattatatgctagaagaataaattgggtcaaagccacagttttttttaattgatttacaagtgccttgaacattgatggacttgttaacctgccaaatatttcagtttcagttattcagagctttcaatcctttattagaacacacataagtttttttttctttctctatttaataaaatttgccgcatgtgccgatttattaaaaaaatcccttatttattcacgatgagtcatcaacacgtggatttaacctatatgtgattgagaggatgagggacaaattagaaatcgtgtcaacttttagtggaaaatgaagattttatccgagaaaaaaaggtaacgagacaaaaacatgctggacgaaatcaaacaagaactcacatcgtttctttgacgcaaggcatgcacatactggtagactaatcttggtggtgtaactgtgtcattctggcctccaaggatctcgatgggccatttaacctctgtttatcaacgggaataattaatatgagtaaataatacagattagatcaaatgataaatattgcatagcgccaaaaagatcaacttcacctttcatatcatcagcagtcactgcgtaaggatgagagatgacaaccgcttctacctcattggttttcgctacctccacagcaaactttcctgccagataaacatgtttttagagactttaatttctatcaaacatagtataatgtggatagcaattgaggaagtttcaagaatatatgtagatataaacacataaatacattttcttttgtttgatcaatatgactcaccaccccaacaatatcctccaactccaacaagtgatttcccttcgtttcttagaaaagcaaagattgatttagctttttcagcttctttcacctgccatgcatggtcaattgaatatgctcatccctcgcaaaaaaaaattgaatatgctcatcaatatctacttgttgactcaatttcaaccttttgactcattgatatgcatcttaattttctaaaaaacagagggggaaaccctcagcttcctacagaaaccatcccttaccctccataagcatctcagacaggtcaaggactgaaggttttgttatgcaactaagatcaaatcactccttagtaggtaaatcatttgtatttattcaactaagatcaaatcactccttagcaactaagatcaaatcactccttcgtcacaacaaacttgaataaatcatttttcacataccccaaaatctaaactttaaaaggttttattttttaatgatcaaaattagctcgtattgacagcacgtgttccaaaacgaggccctatttgtttcagcttaagattattgtgatctagattattaaatcagattactataagccagattataataagctgacaaagaataagctgtgagttgtttgtttctctagattattggaggcatctaagggtagtgagtctttagctactcaataatctagaaaaagctcctccaaaggagattattaggttataataatctggtttatagattataataatctacttatttgtttcagcttactcctaataattcagattataataatcctaagctgaatcaagcggggcctactccctccgtcccataaaaaaccaacctaggatcggatttgacacatctcaatactacgaatctaaacatagtactaggatatgtcatatccggttctagattgattttttatgggatgaaggaagtatttctcggagcataagtactgtaagaacaaatcacttcagcctcgtttcagtggaccagttgccccatccatgtgtatggggtatgactttgaaattttggcctatccaaacgacggcttaagatggtgatcgagacgaattgtaccggagagtgagactcgagccattcggtaaagttcacagttgtggttgctggatctccatgaaacaaatcaggtaccacgacgtaatatccggcatcaccaactttatcagctatttgcctgtaattgtcagcatcattattatcacgcaaatgtgttctgttttccgaagttatagagaaaacatataagagcaaaaacacacacacacatacatgtgttagggacttaaggtgtgttcagaacaacattttcccaattgctaatccctcgttttccatgcgcatactgtccaaactgtcaaatgatttgtttttttcaaaagaaaattacatgaaaagttactttaaaatcatattaataaattttttaagtttttttacctaatacttaattaattatatgctaatttgccactccattttatatgctggaggtgaagggttcctaaccttcaacaccgaattcagccttacagcatctccaagagactctccattcaactctctaagctaaattttagccaacatagcaaaaaaaaaaaaatagtgctccaacagactttccgtctatatggccaagccatctagctggccaaatatggccactcaatgctatcgtctattttcctcctcccacgttctctctctacctccatcaaccatagcaacattgtcgtcctgggagccgactgtggccgtggccgagtaccctaccaaccactgactgcatgcgtgccgaagaggtcgtagccgcgcactaggtctgccgcctcaccggacttcttccaagcaccgtccctaccggttcccactgccaccctgccccgccccacgccgattcctactgctgcgggtgatgaccaccaccaccaccatctgccgctgccccttgagaccaccaccgaccccgaccccatcaccgcctagactagcgccctcctccatcgctccttcatccctctgccagctggacccgtgccattgtggccatggtagcggactagcagttgcttcgcggcatccgcacccgtggcctccactgcttcctcccccgcaccgtctccgcctccgttcatccttgtcaccgttgctttatgccctcatcgccatcaacatcccaccctccctccgtcacgtgtcaccccacggagcggcgacgtggaggaagggacgagtagctgatgcaccagggaatgtcgcggcggctacacggagggtggccatctagaggcacccttcccctccccttcgtcctctccgccatcgccagcagctgctcccaggctcccagctcctcccggctctgcagctactgctccgggccgaggaagtggcggcagcgtggagaaagggggagagacagcggtgtggagggagtggagagagaagaagaagagaagaatagagaggatgggtgaaaaagggtgggaaggtcaacatgtgggacctactgtcacagacgtagaggatgttgaagtaagtaatgaatctgatttgacaaatcagatgaagagttagctatatgagtgtttgaagagtctaatttatataatttggatagtatgttggagaaactcataggactcaccaacataggtgtgtgtttgtatgtgcgtgagtgtgtttgcttctgacttgtacatgaaaaaaaagtaggatttgtcaaaaagaatttaattggaatgagaaacttgggcaagcgttggtgcatcttccatttaattgaaataaaaacagtttaccatataaaatgaacatttttccacgccattattttctatgtagaaattaaatcagtctctttccatagcagttcatgtgtcaattttctttccatgcgattgtgacatggctacaaatcggacacccgattttatggtgaaaaagtaggtgctctcccctactacactgttgcatttttggctagtgcaaagaggagtctacccatacgcatgcaaagctacacactttatatctcattcccatatattttattttagcctccttctcgtatcttcaaactattttttcctaaattatttaccatataaacgatttgatcataccattatatttgttataattaaatttttacagtaatatcttacacgattatattttaatcaaaaaagtaatatgatttgtgctagaaaagaaaactagaaaagaggaggatgacaaagaaaatttacctcagtaacggcgcttggaaacctgaggagttaaaccaaattaacaatcacgcatgcagcagcaagcaatgaaattagcagttcatcatcagtccataatcaccaaggaatgaacaaatggcagtagtgatcactgatcagttagctagctagctcaggcaatcatatgcgtactaaccgtagacgtcggaggcgaggacgatggcccggccggagtgggcggcgccggtgacgtaggcctcgtagcccgccaggtcgtggacgaccacgccggcctcgccgccgccggccttcatgtccggcgggtgctcaaagcactgcaagcgcggcggaacagccgcggcggcggcgccggccgccgcggcgaggcagaggaggaggctcaacgaagcagttgccatatggttaatttgcatactgatgggtgagagacgatgcttgggcttttgtaacatggatttaaccggtagagtcagatgaacgctgcaatcctgcccccctttttttcttggaaaaaataaacagagtgaaactaccacactttgtaggacgtactcactccgtctcatattataatttgtttggtttttttttcttagttaaatttctttaaatttgttcgattttatagaaaaatatagtaacgaacatattaaaatatgttcaatgtcaaatttaataaaataaatttagtattgtagatgttgctattttttctataaacttgctcaaaccctgaagaattttgactaaaaaatataattaaatgactgtaatatggaacggagggagtactccctaactatttgtcattgtcgtttagaattatatgttattgtcctttcgaattatttgtcgttgtcgtttcaaggtggtccaatttaatgtttggaatatagtgagttgaaccacattcgcatcaattctacgtgtcccaagctcaagaaatatttcgaggaggatgagaaagacaacaaggataacaacgacttatcttaatttgaagataaaattaaaggaagaactacaagtgcaaacttgtgtgtcaaatgctacaagctttcaaaggaagttgagtttagcgatgaagaataatcggaaagcgaggatgataaaaaagcagatgcaaaaaggtagccatttgtaagtttatgtcttactgtaaaatgctcgtgcgttgcaacatgaaaacctacccacttaaaactgtgacaccttattacacatgtagtattccagtgaaacgtgacattgcctcatgtgaattgttatctcgtcacgctcgcttcatacaaaatgggaggtatcgaatcatatgtgttgaaatcacatcaatattggggaaaacaacaaagaaaataatatcataaacaatgactaaccaaatgtaatattattttcttatcgcccaaaaattttagaccatttaataattgagaaaattcgatcgatagcataggaaaaaaaacagtaccaaaaaatagcacaaaaatttttcgctttcgactagaagcacaggccaccggtttttcttcgctctatagcacttccgtcaggtttagagttaacagcattagattgaagtatagaaaaattttgttggacccatttgcccttcgtcttcctgtgtcatctcgtcctctcggaccggtgcccacgatgacggcgccatcgccaaactgcgacgcggcgacgatccccgtccccatccccgccgccgccatccccgtccccagccacgtgccattccgtgtctctgtcggctcccgtcgcgacgacaacagtagttgtaggaagctgtacgagccccggctggtggccatcaggctctaccaccgtggtcgggacgagcaccatgccatggagcagcacaagtggcgcttcctccagcgagctgcacccaccgtcccgctctccgacttcgtggacgtggttcgggccgtcgagcagcgtgctcgctgctgctacagcgagagcacggccatcttgaacgacgacggcgacggcttcgcggagatgctgctcctcgacggctgcttcattctcgagttctcggcgaagctgagccgcacgaattagtgcacttgcaaaaagctaattaggatttaattaattagttgattaatttgttggcgctggcgccgccatggttgcagatgctcccgatggccgccatctcatcaccgctgccctgtggagacgacacgagcgagctgagcgcggagtcgaagtgcgccatggactccgctgccgccggcaccatcatcaccatctgttcagccgccaccgcccatggcggcatcattgtcatcgtcgcgttcgccgccacagcgggcagcaatgcgcccgcacctgtgccggcgctggacgaggaggtgaaggaggagaagtagtcgcgcagcggggaagaagtgctcgtcggccatcatcgtcgtcggcggcggcgtacagcggcccacatccatccacgctcgggcagtcggggagacgaggcggtcgcccggcacgccgatggttgccgcgccgccgtccacgagggagtggaagaggagacctggtggggaatgtggggagcgaagggcaaatgtgtccgacgaaaattttctctactccgatctaatgccgttacttcaaaatgcgacggaagtgctacgtggcgaagaaaaatcggtggcctatgctatggatcgaaagtggaaactttttgtgctatttttttaccactttgtttcctgtgctatggatcgaattttctcttaataattttggtgatggtgctcaattgaaaaatgaattgaattcatgcgttacagagacaaattctcagtgagaaaatggttaataccagtgttgaattagcaaaggataccatagtttaccttgaaccatgacaatctctaaaagttaatgttttgatatcaaaagaaactgataaacatcaagcatgttttttaatcaccgggaaaaaaaaggcttgttctattttttttaaagtaaatttcagaaaactgtaactataatgataaaattatcagtttactacaatattagtgatctatttcagtttgctgcaataatagcgtgagaaattatcacaaaactattaacttttacgtgatatgctgctacagttgttacctacatgtcatgtagcagtatatcacataaaagttacagttttgtgataattttctacgctattgttgtaacaaactgaaatagaagccccctccaatttttctaagctccactgctgtgggacttccaactttctaagctccaattgcagaagtcctctctttcagtttgcatttgttccaacgttcaaatttgaagattagttttaactttgaacttgagaatacatgcatgtgcgttgggttgaattcccaccgctgagagatttccaggggaaggaatcggaaagtttcataaatcaattcagcagttaatacatcgacaagctcaattcagagaaaatcatagccaattaatcacattgacatggctggttatacttatacatggacaccggcaatttatttagatgaaaatgaataagtgcaattttctgtattttcacaaatgactatctatattgtcatttttttaatagaataatctatattgtcatttcaagtatttctcaaaccagtcaagcattaaggcaagagcctgttgagcagttttgacagcaaactggttgctggcgttatatctgcaagcaaagccatgagacacgtctggaaagatcctgacaaagtaatcaacctgcaacaaagatgcagtccattagaggcactttgtaatttgcatcttttcttaaacatcattgagtggttgtgttgaagaaaaaattagggtcttcttgcaaatatagaacaagtcaagaagatataggatattttccgaatttatggccatgtacatgtatggaactttaattgcaataatgtactagtgttcagactttagttattgtaaatttcccaaatgttcttctcaaaaacaactttccaaatgttgactaccaattagagccagcatgatcttttaatatctcatcatttctggtagatttatatcttgtctgtttaccgtttcagtttttttttttgggggggggggggttgaataaactctgtttcagttattcttgtgctttctaatatgtatttttttttacaaaatttaagatcatttggcatcaggtgccaatgaaacacaacagcaactcacctcagttgtttgacgcaacacattcacaaactggtccaccaaacttggtggtgttatatggtcattctgacctccaaggatttcaatggggcatttgacacctgtgttcaatgtgaactaagtaacaaaacaaaggctacttggatacaacttacataaaatgactagataattcgtgtatatgtagtgcaaccaattaagcatcaaatcaaaacaagttaaattcacctttcatatcatcagcaatcacctctgaaggatgagagatgacaatcgcttcaacttcattggttttggccacctccacagcaaacttcgctgtcagttgaacttgtgctgagactataatatgatctaaatctagctgtggaatctaactaggaatttgcaaaaaaaatttagagtgtaatcctaatgtactggtgtatgatatgtaaagacatttttctttcgctggttagtttcgcttaccaccccaacaataacctccaattccaataacagatttgccttccctttttagagcagcaaagattgatttagcatcttcagctgcttttacctgaaattcaaattgaatatactgatcaatatccattaattgactccacaataagcaccatatggaaaaggttttttttatgcaactatgatcattattacttggcgttttgaaacgaaccatgtaagatttcatattgatatagcattaaaaaattacaagaccatagccctaaatagttatgaatagggggaaaaaagaaacaacagtcacaccacgtgtctacaagatgtaaacttcctcctgtttggatccccttgagctattttggggctaaaaggggtgggctaaaaaatatccctaggatctaaacaccccctatgtaaacggtgaaacaaattaccggagagtgaagtgtgatccattttgtaacgtttatacttgggtctccattgtaaggttgtccatggaagaaatcaggtaccacaacgtaatacccagcttcaccaactttgtcggcattgtccctgtaattgtcagcatcagtaaccacacatcagcttgtaaattgtttttggaatctagaatgggaataaaagtagaatttgtatgagataaatttagctgggatgtcgtactatttgaagctcaaggaagcacttaaaactggaacgtaaaacatagatttcagtaaaatccacatgaagaaatcacgggtttgtcgttgtattgttggaattcaagatatttctacagaaactggaacactgaaattggatcattgtcaacccttcattgagttccgaatacgtttgtcctaaggataaaatcggataaaatctgatggctttttacttataaaactgtcagaatttttatttatttcattataatgcatagactttacatattttttgccccaaaaaaaaagttccgacttcgtttgtcctaaggacaaaatctgacggttttttacttgtaaaactgtcagaatttttatttatttcagtataatgcatagactttacacattttttgcccaaaaaaaagagttccgactacgtttgtcctaagtacaaaatctaatggctttttacttgtaaaactgtcagaatttttatttatttcagtataatgcatagactttacacataggtataatattattggcatgtacagtattttcaataatttccactgtatttgtcacttatatatatgcacgatgtgtggacttaaagtttgtgtgaacatgaaattttccattaaaattatatatatacatatatatatataaacccgcttgacatatttatatcattagcgggaggatagaatatggaaaaattgcaaaatgagtatatcacctctttaaattataaattattttaggtttgttatagatcaaacctctttaagttcgaccaaatttatagaaaaattaatatattgaacgatggttgttgaatgaaattaatttgatgttgtagatgtttctacattttttataaacttatcaaacttaatgatatttgacttaggtcaaacccaaagtggcctataatatgaagggagggacgaatagtttaaaaccatgattagtcccaaaatgatcaggaaattaaactatttgaaatgaaagatgagcattgtctaatattatttattgaaaccctgatgatggccttatgggtgatgagaactattattcacgcatgtcactgcagaaagatagggataattcagtaaaaatgacaatatcaccttttaagtcatacaattatttgtcatgtttgctctgtttattttccctcaaattcagtctctttctagagttgttcaggtgttaatttctttcactaaatttgtggagcaaatgaagaaaattgcggagcaagatgacagacaacgacgacgaagagaggaggaggaggttaaagaaattgacgaatactgtacctcagcaatggtgcttcgaatcctgaagaaaccaaattaacagcgacaattaacagctgatcactcgataatcagttgataatcactactaaccatagatgtcggaggccacgatgatggcccggccggagtggacgtcgccggtgacatacgccgggaagcctgccaggtcgtcgatgaccacgccggcctcactgtcgccgtcggccgtcagctccggcgggttgtcgaggcacggcaagcgcagcggatcggcagaggtggcagcgccgccgccgccgccgccggccacggcgaggcagaggatgctccagcagagcagcaacgaagacggcgccatggtaattaattagctctactgatcatagttgctgaagcagcttttgtacatggatttagacggtagtaggtagcaaaaggagacgcacctatgacatgtttagtgtcgcatcgacgttgcaatcctacgtccttaaccaggaatgaaataaataggtgacttggaagttttcaacttaaatttgagagttaaaagttagaatctaaagttttaaaatctatacataattatttttttaaaattttcgagttgaaagatttgaaagtttaaattagatacaaactttgtatacgtgtatatggtttttatacatcaaaagtatatacatataaaaaatttgtattatatgtacgtatgtatataatttacatacatacgtataacctttttatatgtgtatataaagttgagagaatatattttataccattgaatttatcccagtttaacgatttgccaatgacattatctctttctactatgtactgatgactctatcaattgtgataggcctctttttaaaaaatacccaaaataccttagagatatacatggttaacaattaatttatctcattagaaagtttcagaaaatatgaaattttttatatgccctccttacacaacagagaagtatgtacataagtttcaatttttttatatatttttttaaaaatatttttgtgtggtatatcatagagaaatagcttacacaaaatataagagaaaaaatcttatgttgcatatgaaagataatttatattaaaaacaacaacacaaaaaatattttatatagtatataacaaataagttatatttttaaaaaatagaaatgaaaaaaacttatatacaaacttttatacttacaggaggccacataaaagttttcatattttttttaaacttctaatgatataaatcaactgttaaccttatatgtccataagggtattttaggtaggcaccaaaatcagtcgaaaccgtcattcacacaactatgatactcgatttccactgattttgatagttgacggatactatatactccatctgttccataatataaggcacaaccattttttttggatgttctataatataaggcatgcatgcatatatacaattaattagaacctcttctccattaaattattacttttctaaatcctccaccctcaagatctctaattctattggatacatgcattatatttattagagtggtccaaattagaagatgataatagatagttgtgacttatatttttgaacggagggtttgtggtttaaggacgcgaatgaaactaaaaaacgaaacaagataaatcagcccagtagcaaactgggcctgggaaagcttcggctcgagccccacgtgcgtcgtcagaaggatggactcatcgtccttaggtcatggcccagcatcctgcatatgcctgagtcgatgatgggtaatcctcctcctccccttctcggcttctcgctcgctcccgacctctctccaccctccccaagaccggtggcgagcagccagctggggatgcgccctctctgctgccggagaatctggatccggccggcatcggcgacggcgacggcgacggcgagggccggacggccagatcgacggcgccctcgacgtggggtggagagcaggtatgccacgcacctctactcctcctaggtcgctctgcgcgctgttctttggctccgactgaatccatccggttatgagtttttgtaccatatcgcccattctgagacaacaccacctgtttattagctcgatttgattctattccatcgccaccccagggacacccaccccgactgcaatgggcagcggtagggcgtgtatccgccctaccgtttcagctgcaaaaaaaaaaggcagtgaaaagatcccctactttggggcacggcaggcgaccccctgccggccagctgcaaaaaaaaaagaaaaaaaaaaggagcagtgaaaagatccaactagactcaaatataaatgatatgtcattggcacttagccgatcggctatcatttataggtttaaatgcggtttctttgtttctgtttcttgttgattgcaggatcaaatcaactggtacgctagcatacccgaaggcgagttttgggcctgcactggagttaagcaaatctcctaggcctcgtgttttacgtcaacaataattaattgaaatatcaatttcctggaatatttaggtatttttaagtaggtatgtgtataattaaattaatttataagtaaagtaagtgtgagaaataaaatgatatgtgtcggtgatatgggcccgggggtaccaagactagatggagtaggctgcccccatcgccacgtggccctctcctgagggcggtcgggcccggggctaggcggcggctgccccctcccatgaacccgaccccctccgtgggttgccacgtgtggtgggttaagtggccgcctccgtgcgtccacttacccgtatttatggtggcttgagcgggcgtgccatgcctcatttaatgcggtgtactgcgtatccatctggtctgtgatcggttgattgactgacgagacaaggggtgtcagacgcactaccgcgcatgccaggcggcgtgtgtcttgccctgtcccatcggtcatgatgatgagaggtcttagcctcccatcacaaccggagttggctcgtctgccctgattagggcaggggttccgtttcccggtaaaaatgagaatctcaggctggtgggtccttcactgttacacgtttgtaaccaccaagcacaacgatgacgagcagtatgaatgggaacccggaagtcttcaccccataaatggcgattgataggggcgtcccccgtgtcaagcggcaagatttgatgggccccatgaccagcgcaatattcgtattgctttccaagtcaaggaacaagacatgcgtttaatacaaagaatgtaatccttctcccctaagttaggtttttgggcccatgtggtaaccccttgaggtataaaaggaggtccaggcctactgagggagaggatgagcctttttgtgtagagcgtacaccccgcctccaaaatccgcattagtctgctctacacgttgagcggacccacgttctcatggtatcccgcttacacttttgtcctcacttcgtgtaaaagggttaacccggggataccatggttggagcaccaaggcttataagcaggccctcacccacctaaacttccaaggtggtactaaactaccactacacatccacttctgggccacatgggccaaactcacactactaacaggcttcaaacgggctggggtgttacattcagcctgccttaagggctgacgccccagcagctcaccgtttacacggcagaggcccagaaccccctccggtgcagaccatggcccaaagcacatgcatcatacaacggaggtttatgctctgataccaactgtaacaccccgcctccaaaatccgcattagtccgctctacacgttgagcggacccacgttcgcatggtatcccgcttatactttcgtcctcgcttcgtgtaaaagggttaacccggggataccatggttggagcaccaatgcttataagcaggccctcacccacctaaacttccaaggtggtactaaaccaccactacacattcacttctgggccacatgggccaaactcacactactaataggcttcaaacgggctggggtgttacaccctcatcatcaacaccttctagtccaacaaggagatattgtaacttcttacaggatcagctaagcacaggagtagggtattacgcttcttagcagcccgaaactgtataaacctccgttacctcatcttcctcgagaggcccgaccccctccttttcacacttccaccacagagttcctcgaatctcaaccgctatccccggccgaactaaaaaaggaggatctcacaattccctaatagaggagttcaccctctgacaatatggttggatttaatttttactaaattaagcatgatttaataacactctttgaaattttgttgggacatcatttcagtatttatttaaataaaaatcctcatttctctccgggccattttcagcccattttatttgtcagaccgcaactgaagtctaattagcttccccaaactcctcctctcagcgcgttgtgttggacccaccggcctgccagtggcccatcaagcgtgcgcggcacaacaatgatgcagcatggcgatggaggcggcccgacacggaggcgatcagagccgtccgatctgatggatggctcggatcgcctccgcgctgctaaagattcggatcggggaaaaccctaaccctaaccatcactttctccccttctctcttccgatcccctcccccggcgacgattgtgagaatggacggcggtgactggacggtggtccggagaggtggagcacgcgtgcgacgacaagcgctgagtgcatccttttgtgccggctgggggtgtgcccgaggacggtgccaagtcgtgccacggtgtcggtagaccggcaaggtggtcacgcaagtggcggttagcgccgtgtggctcggacctcatcggcaaccacgggtggggtggggagggatggggacagcgaagccaaaaggcggcacaaggccaacgcttccaatccccggcaagggacggtggggaaaattccatggcggcgcacgcacaacggtgaaccggcacgaccccgacaaggccggtaagtttctgaaacccgaagcttacattttatgattttatttggatttgatttggatttaattagttaagatatttcaatgtcctgtataatgaggttattatggggagtggacgatatattatctgttaactcaaccgatcgctttttgtgataatggtctcgcagcaataatattattgtaggttgtccataatagtatgaatagttggactcagtggcggactcaactttgaaatatatatgggatggaaaacggagatgttcactcgataagagcaatcgaacacaacacatatcttatatcttatttatagttcaatcacaaaactgcctcgatcattgtttatggcgtacgcgtgtgtaataccccgtatattaaaagatatttaggtttttttagtttgggttgacttgttaaaataaagatgttaacagaaataaataaaagaaaaatatctttagaagtgggccaacctgagaagacccataaacccagcccattagttctcccctaaaacctagagagaggggaaccgaatcccacctcccctcatagtgccgccacccctctccctagccgtagcctccttcctcccctcctcctgtgttcgcatctctccgctctacaacaaattgctctccctaaatctccaccttcatagcttggatcaagaagcgaagtagaaaaatggaacgaggaggaggagaggagtagagggaggggttagaccgaagtctcccctattgtctcctcacaagttctctaaagaaaccctaggtgagacttatccccttgttgtatcagttgttctagcatggctttagtgctttaattcgtggttagggaaagatagagaatgagtttgggtagttgtggttcggtttgttgcggttcggtttgctgcagttctgcatatggccagatttgtagtgcttcagtatttcgatgttttgggctctaaatgtataactaggaagttgtagataatgtttggatctatcttctgaccaaagggcgcaattttatctcaagtggtttaggagatataattttttagtatgactgttgtttttgtgtcaaaatctggataatagtagattgaactgtttttagaggggttaaacagtggaatcatgtcacgcccggaatttctatccaaaactccaaacgcttacatgtgtgtaaaacctttgtccaggaatcagccgaggcacacaataacaaattgataatagagtacaattattaatctaattacgaagcgaatataaggtcattacagaggtagatagtttctctcaaacaataaagatgtaagtagcggaaaataagataaacggcgcaggagactctatcccacaagcagcatgaccagggctacgcctaatcctccacaccttcagcatcattatagaactcctcttctgatgaatgattgcaaggtgagtatatgacatactcaacaagccatgcaacaaatatgcaaatgcatgggataacaaaggatggcataatatagtctgatttgcataaatggcatttaataaatacttcagaactagtaaaacagtaaagtatttaattaaacaatattaatccatcgctatacaacatacccgttgcatagacccaaccattctgaacaaccattcctgactgcacagttctatctccaaaccaggaatataccattccaaaccaggagctaaacaaattattaggacgatgtatgtggacatccctatatccacatacattaacttaggaggggttacatcccttttagattgattctttttggatggagggagtacatgatatgctttgtggttaggatatgtcccatataatttgacgtatgcaccaaataaacaaggaagaacaaaactgattgatctcggtctcaattttagtacgtaaacataacaggaaatttactagaataacgactaactcatcataaaattacaaatagattaatgcatttgacatcttattatagacgttctgttctgtcgctttctatcattccaagatggccattatcaattcgtgtaatcaacatgttgaataaataaattttccatcttttcttataaaaagtatagtacatgcacgagctattctaaattacaacatatctgcgctcacaagtcaaagataaggtgacttgcgtttttgtcctgtcgatatccatgggcagtcacccgacaagatgatgtcggaagagcttaattatagagaaaaatgaatgattgttttttttagctagcgatgttagagtttacaattcaaagttgacatgaaccaaaattgtagttgttttataataattaatgacatgtcatatctcaacaaactgttcagtgtttgtgccttcgtggactgagggcatgagggtgggctttcctatagtcagcattactaagttttaagagcaacattgggcgtccgatgaaggagtgaaaaaatcgggcgctgacgtcagcataacgcatgcgtgcaaaccattttaaactatatttttctcttaaattatttatacaaatcatgattcgattgcaccattaaattcattgcaattaaatctttaaaacaagaccacacatgtatatattccgacgaaattatttttagcttattattgaattatttttaaatgttgcacgctgttccaccaagtatatcgaaaatgtttcactaaataaatctaaaatgtttcaatcgtttaaatcggacgttgtttcaccttatataaaaacaatgtttcagcaaatagcgaaagaatgtttcagttcactgcaatatttgatccatatatagtgaaatatataagtacactaggtgaaacatttttttatggaataaaaaaatgaaacgagttcatttaataaagggattctaaaatatgtgggtgatttattgcaaaagaatgtttcagttcactggagcatttgatccatacatagtgaaacattttgttcactgcaatattaaatctatacatagtgaaacattgtgagtacactaagtgaaatatttttggtggaacaaaaaaatgaatcgaattcccttaataaagggtttccaaaatatgtggataatttgttgcacggaggtatgtggtgganacacgtggcagttgggggcagtacacatggtggggcacgggggggagcgaccgattttgctcccctcccccctcccgccggtcgcccaacgctaagcaatttcgctaatttttacaaagttgtacaatgtttcgatcgactctatatgctacttatcataaggcagaagtcatggtccacttggcctacgggttcgtcgttcatttcctcgcacggaaaacagagtagctcattaggccataatttattaagtattagataaaaaataaattattataatatttgaaagtaactttcctatagagaatttgtgaaaaaactacaccatttattagttcgggagtgtgcgtgcaaaaaaatatacgaagtcttttaaacctggacacgaaaattgaggacgattttcacagacatgaccagttatggtgcgtctgcaatccaaaatctaaagagatctctttataagaaaatcgtttttgtaggagtgctctggacacttagtagcattagagctagccggtgcctgtccttggtggtgcctggcttctggcccttcacttcaagaacattcttgttaatttaaatctgaatttaaattaaaagaaattatgtaaatactttgattttcttaatacttcctcgttcaaaaaaaccaacttagtaccggctgtgacacattaattctagtactatgaatttgtatatgcatatgcctagatttatcgtactataatagtataataatagaatatgttacatctggtgctaaatttattttttatgggacgcagtaagtacatgttagcatttttggtaaaataatatatttatttgtcaggtagttttgcccttgacgatcaatcgtgcgcgaccctgctctctcacgttgtatggtgccccacagcgaaatcaacggttcctccatgctgcaataataataataataataataataataataataataatagtaataataataatagtaataataataatagtaataataataatagtaataataataatagtaataataataatagtaataataataataataataataataataataataataataataataataataataataaatcagcggttcctgttgctttctgtcattctaacatgccctattatcaattcgggtaatcgaaataacgttgaacaaacaaatttgccatatttttcttataaaaaggagtacatgcaggagctataaagtacgtatcacgagtctaataagttcacttttgtttgtcatgtcgatatccaaggagagtcacccgacgagataatgttggaagagcttaattatagagaaaaatcaacgattaatatattgttgttggttgaggtagcgatgttagagtttatattacataattcaacgtcgacatgacatgttgtgtactattatgggcctattcggctgcttgttttcgcagctgcatgcatggcagctagctgcaacagcaagcagcacagctgcagccgtagcactgcccccaagaatgggagccgaacagatccgatgtctcaataagttgtcctcgaatgggctaaaggcttgggtgggcttccctattgtttaaaaatattactaccatcatcattgatgataatatcactaactcggatatataacaataaataccttatgtatttaataattaaagatgtatactttctatgtacgatttatatattatatatttaaataaacgatactgcaccataagtattttgtatggtttcgttttgggcatttgcttgggtaaaactagcttggctcgactcgagttcggcttgagtctgtaccgagtccgagcctaaacaagaaaactagctcagcttgtgttgacagtactagtcccagccaggctgccgacccctctattgttcttcttcccccttcacctctttgtccagtcaaacaaccacgcgcacagtcatgtcattccaccttagttgtctcaagctgacacagtgcagtgccaaccatcgccatcagatgtgacaccagtgacaccgcctctcatccaccatcaccgaacctgcaataacctaaagcattatgatcaagtactgggatggcagtgacaaagacaagtaatgacacattaagtagttttagtattaatcataagtgtgaagtctgacttttgtgaattcatttgtatttaggcgctgcgttcattcctgcaacttgcttccatttcactggcatataaaacaagatgaggggttatagtataattaatgaagtattaattatatcaacatggaaaattgacttatttgattttttaatgatattttaatatataagttatagtaaaaaaacaaaccttttagtaggttaggaaatgaggaagttcccatttggagttgaacaaaagaacatacctttttttacctcagttatttgctgctggctagggaaaagataataattacccgctaccctatggatggcaccaaacaacaactagggtggcgtcaaagcaaaaacaaacaacccccgtagagctaaagcagatcaatccgtaggatctcctatggctttccaaaaaatgggtggaaatgcgccaattacaagatttctgtatattagaattttgtatctacatatgtatatgtataacaatataatgtagtggatatgtgaaatttttaactcacgtaactgatcaaaaagtctacatgaacaaaaagaaggagtgccaagcggtggaaaaacaagttatggctcaacatttgttagatactacctcctccccataaaatgccgcttttagccacaaatcttgacaaagaatgaaaacaatatcatgacgtagatttgtactagttgtttagtatagtaatgagattatgtctaaacgttatcatgacacagcaaattgtctagtgtttggtgccttggtggaataatagggtgaggacctggactttctcgtagtcagcgttaccatgttctacaaaataaaataaaaataacaagtagaagtataacaggagaccaagtaaaaggggagggatgttgttgtgacaaagactgtaaattacacattaattgtttttggaaaccataaatgtagagttgtcatacaatatgtattatatatacggactctacgctaatacggggatctcaccatgtgtatatattaatcatgaaattagaagtcgtcaccctctcctggctttggacagggtggaatcacaacaagggcaggaacgacttccgtcgcctgctagaacaataatgtatactttttgacaggttgtcaattcgattgaataagatttgtcaatatttgttagatactacctccgttcccataaaacgctgcttttagccacgaatcttgccagaaaatgaaaacaatatcatgacgcaaatttatactagctatttaatatagcagtgaaattatgtcttaatgttgtcatcagacagcaaactgtctactgtttggtgccttcgtggaattattgggtgaggacatggactttcccgaagtcaatgttaccaagttttacaaaataatataaaaataccaagaagaagtataacaagagaccaagtaaaaggggagggatgtagttctgacaaagaccctaaattgcacactaactgtttttggaaatcataaatgtagagttttcatacaatttatattatattgatttactctacgctaatgagggcatctcaccatgtgtatatattaatcatgaaatcagaagtcatcgctctctcttggctttggactgggtggtgtcacaactagggcatgaacgactttcgtcgcctgctagaacaataacgtataattcttcacaggtcgtcaattcgattgatggagatttggccacatttgtcagatagttcctccgtccccataaaacgctgcttttagccacgaatcttgacaaaggatgaaaacaatatcatgatgtagatttgtactagttgtttaatatagtaatgaaattaagtctaaacgttatcatcacacaacaaattgtctagtgtttggtgccttggtggaataattaggtgaggacctggactttctcgtagtcaacgttaccatgttttacaaaataaaataaaaataataagtagaattataacaagagaccaagtaaaaggggaggaatgtagttgtgacaaagaccctaaattgcacactaattgtttttggaaatcataaatgtagagttttcatacaatttgtattatatcgatttactctacgctaatgtggggatctcaccatgtgtatatattaatcatgaaattagaagtcgtcaccctctactggctttggatagggtggaatcacaacaagggcaggaacgacttccgtcgcctgctagaacaattatgtatattttttcacaggtcgtcaatttgattgatggagatttgtccacatttgttagatactacctcctttcccataaaacgctgcttttagccacgaatcttgccaaagaatgaaaacaatatcatgacgtagatttgtactaggtttttaatgggacaatttcgtttttgcccccactttaatttgtaatatttattttgctcctagtttttagtgttttcgtttttactcccacttttttgaactgaaagaggcgtttacctctggtttggatggaagttagtgggaccgggtttatggcaggaaataaagaatttttgaattagtgatttaccattttacccctgtggaagtgttaaccatatggactctctctctcctctcgctacacagcaacccgaaacctagcccgtgtcaaaaaaaaaaaagaaccgtagacctagcctaggcggcggcggaggaggagagcggccggggagaggcggcgcggcagcgagcggccggtgcctaagcggcagcggcgagtgggtgagggcgagcggcgcggtaggcggcggcgagcgggcggctgcggcggcgaaggaggggagcgagcgtcggcctggtgccgctcctcccggcgcgtgcaagagagcggccggggagagggcggcgcagcggcgagtggccatcgcccaagcggcagcagcaagtggatggtggccaagcagcgcggtaggcagcggcggaggaggaggaggaggaggaggagagcgggcgtcggccaggcgccgctcctcccggcgcgtgtaggagagtggctggggagaaggtggcgcggcggcgagcggccaacggccaagcagcagcggcgagttgttgaaattttgttgaaatttggacaaaatttttgttcaatttctatcaaaatgctgccaaaattttgtcaaaattccatcaaattcaaaatttgtccaaattgtaatgtcaagatccgtccaaatctgtcatttgattttaaacatattcacaaaaataattttccaaagccattgcaggtggccgtgcaccaccgccccagcttggcgtctcaccagccgaaaatgatcatgcgatggtcaccagcggcaaggccgggattcgtcgcccggtcgatcggctcaacctccacgccatgccactctcgctagttcctcacacatatcgtgtagctctagctgatccccactggcgcaccgctatggaagaggagtacaacgctcttctggccaaccagacatgggacctggccaaccagacatgggaccttgttccgcgtccacccggcatcaacgtcgtcactaggaagtggatcttccgccataagtttcaggctgacgggacccttgacagatacaaggctcactaggccttgcgtggcttcactcatcgcccaggtgttgattatgatgagaccttcagtccggttgtcaaaccggccacagtacacacagttcttagtattgctgtctccaaggattggcgtgttcatcagcttgatgtcaagaaagcctttcttcatggcactcttcaggaaacagtctactattcttagcccgctggtttcactgatcctaccaagcctgatatggtctgctgcctcaacaagtccttgtatggtctgaatcaagcaccccgcgcatggtacagtcggtttgccaacttcctgctcaccctaggattcaccgaggcttgctttgacacatcattgttcatatacactcgtggctctgatgtggtctatattttgttgtatgttgatgatattgtgctcaccgcctcttctgacagtctccttcgatggactatcgctgctcttcaagccgaattctccatgaaggatcttgggactctggatcactttctggggatcagtgtttgccgcacttctgctagtatgtatctcagtcagcgtcagtacattctggatattctcgatcgtgctggtatgtcagattgcaagccatgctccacgccggtagacaccaatgccaagctttctgctgttgacggtgattcagttgctgacccaacggactttcggagccttgctggtgctttgcagtatctcacattcactgacctgacatctcatatgctgtccagcaggtctgtctccacatgcatgacccacgggagccgcaccttgccgctctcaagcgcattcttcggtatgttcatggcactcttgatcatggactacacattcagcgatctcgagcagttgatttggttgcctactctgacgccgattgggcgggttgtcctaacatgaggaggtccacctcaggctatgtcgtatttcttggggataatcttgtgtcttggtcttccaagcatcagaataccttatcccgctccagcgctaaggcaaagtacagagccgtggctgaaacctgttggctccgccaactcctgaatgagttacattcacctccctccaaagctacagtggtctattgtgacaatgtcaacgcagtttatctcttcaccaatccagaacaacaccaacggactaagcatgttgaaatcgacctacactttgttcgtgaccgtgttgatgctggagttgttcgtgtgcttcatgtgcctaccacttcacagtacgccgacatcttcaccaaggggctacctagttctgttttttcctagtttcggtccagtctcaatgttcgtttcaccgacgttgcgactgcgggggaggggggttagaatatatctcgtgtatagttgtttccttctgctgatcctatccatatcgtctctctcggttttgtttctataaaccggttgagtagataaggtagggcttgtgcctatatgtactccacatcgatgtcaatctaataattgcgttgagtctattccgctttcacctgccaacccctccccagtcgtcttgttcctgtccttcatgtccatgcctagttcaaggtcacctcaccaaatcaaattatcttagtgaaggcgcttactccaactacccaaaacaactcaagcaagcacacgcaaacatgtcctttcgctcaacttggctcaagttgccagctgtacggggccagccttcgctactagatgtgacacaccacagtcacaccacctctcatccactatctattaacctgcatgacctagcacattaaatacgaagtctgacttttgtgatttaatttgcatatattcattgctaggtatggataagagaataatcacccactacctagaaggaacggaacaagaacacagcataaaagtgaaaacaaacagcccccatacaactaagtcaaactataggttgctatgggcctttcatcaatctgtaggatctcccatggctttccgagaagtgggtggcatacgctgctgaagtaccaatatgatgttacagttaacagatgaaccttatcatgaaaaataattgtactagttgtttaatatattaatgacattatgtgtaaacgttatcatcagtcatcacagcgcaaactgtctactctttagtggcttactggaattggatgaagacctgggcgttcccgtagtcaactttatattaccaattttttcaaaggaaaataataattactttctccgtttcataatgtaagtcattctagcattttccgcattcatattgatgttaatgaatctatgaatgcgaaaaatgctaaaatgacttacatcgtaaaacggagggagtagaagtatagcaaaagagaccaagtagaaggggacgggtgtagttgtgacaaaaactctaaatggcctcgttgatcgattcgcgacggcggtttcgctggcacgacgcacatagaatgatattctgttaatgagatctgcagcacatacatcaattatatcacagcggccaaaagatcagtgtttgaaaaggacgaaaaatactgaatcaaaaacatgagaaacagttgggaacttgggagggtattcgatcggctgggagttggatcatcacacagcacaaaccgggcatgctccgtctgatctaccgcccccgtctcccaccgagattcctatcacgcgcaaacccgccggctagccaaatcgcgagcgttttcggcccatatcctcacgcgcggcccactagctacaacttcttttttcttttttttcgcagcgactcagacttttttccctttaactcccgttatacgcaagtatggtctattaaacaaaccattcttttttttctcagcacaaaaaaattgaaaatctacaactttcaatgtaaattttgaaaacttttaactcaaaatttgaactttcaagttaaattttgaaaactttcatctcgaatttaaaaaatttcaacctgaatttgaaaactttcgacccaaattataaaaactttcaactcaaatattcaaaacttttgacacgaatttcaaaaacattcaactcgaatttaaaactttcaacttaggtttgaaaactttcaacttaaatttaaaaacttccaactcaaaatttaaaaactttcaactcaaattttaaaacttttcaactcaaatttataaactttcaactcaaaatttaaaaacttttcaactcaaatttaggaacttttcaactcaaatttaagaactttcaaatcaaaattaaaacttttttattctacatttgtaaagaggtgtgcgaaagattgaaaaaaaattgggaaaaaacggcgaaaaagaaaaagaaaaacgtgcccggaggcaccaaaatcggggaaaaaagtgcaaacaaaaaaataaaaaaaatacggggaggggggcagctggcatgcgcgccagctaaattgctggcgcagatgcgcgcatcagccacccccgcctcccaccgcctttgcacaaccatttgcagaactggtgctctctctcgtacgtcatcctataatccgtcacaacgctggccgggcaccaacaacgacaccccgcacagctagctcgtcgcccggccgatcttaattaaccatctagcctgttgccagatccatcgagcgatcgtgtgcgatgaccatgtgcggctggggtcgagctggacagcctgggttggatgtgggcttttacttgccggacgaaattgactcttcctaagtattgatgtactttaattttgtccaggttttttttcgaggagcgtagaagcttgcactctcaaactattattatgggagcatgtagccccctaaactattttcttctcattttatacccataaatgtttatgtggattgtctcgctcaccgagaaatctctacggtgttttttttttcactaacaatattgacattatgcaaattcttggagttgggttttgctgaaatgccatcctcacatgtggtttcattaaaatgcgatgctcaaaggatcaaggatgccataatgctagagtgccattttctatattatttgaggtgttttctcaatgtttttaccctcgtttttgtgctggcttgaccgaaatgcccctttggtcggctacagtggtcgcaacagccggtgaccaagactagatgacaagatgccttgtgctccctcaggggtgaatccactgttgtaggagtggtgtcagatgacaccaatgatttttcgctagtacatgtatcctctatcctctttgtattttatcattggtgacatcactctcagaattatttcggccaacatttgttctgattctcatccgtggacagcagccaacagaaaaaaattcatgcagctcaaccaaactcacgatgattggttgatttcttgcagccttcttcctagcctttcacgataccagaatggcattcacgcagttgtatcgcacaaacagatgtccgatgtctcgatgaggagcagctagtgtatggatgagttttcatttgctctagaccactgaatatcccaatttcgtacacacctaatttgcatacaaattttgatctcacctatgtattgttgagagggccttactcaattaatttccttaatctcacatgattatttagattcgggacatttggtttgcagagatttcaatccttcgacggattgagggttgttattctttgatgaaccactagatgctgggatataggatatctgatcttcttttagtcttctagctagtacataatatatttactttgaacatgttgtatcctgtagtttttgtctagtaatttataatttaatttttaccaattatgtcaccattgcttaaatgactgaatgtttgaattaataagttgtgttcatggttactctctgttttttacatttatcatacatataattaattaattatataagtcatgctagttgagaaccaatggtgacaccatccatctgaaattctggctcgggaactatcgccgatggcccgggcgaggggcgacaatggggtggctactgcagctatgggtggcggcagcccgcgtcaagaaggcgccggggctcgtcgactggttcctcgacctgtgtttatgcttgcggtggcagcagcagctgtgggaggaggtgcggtgtattctgggcagcggcgaggctaggttcacggagggaggaagggatcagtgcgatatgataggcatcgatcgattccctttcgtacgcacatgaaggaatagcctaggggaaaaaaggtcagtgtatgtgccaaaataaaaagaaagaaataattaaaaatggagaaaatggcataccagcaaggttaccttgtgagtggctggttgaacttaacgacatctcccccaaattcggcgcccacgattgaagattggtggatcgatttatgcaaaattacaccaaaagagattagaagacagaacttgggtgctttgataacaacctggtggaacgtgtggctagagcggaatgggaggattttcaatcatagataccggaacgaattccaagttgccctccaaattaaggaaaatattgagttatttgttaaatcgagagactagctctgctttcagttttctgagtcgctctctcttctttgtaatcttccagtttttctagcctaggcctatggcctaccaggcgtttttccttttccttcatgagacttttgtatggttttttttgttccttctaatatatccagcaaatctcctgccgttttatcgtttcaaaaaagagcaaggttaccttatttaatactggctttatttagattccaacttttttctttaaacttttaacttttccgtcacatcgaacttttctacatacgcaaacttcaatttttccgtcatattgtaccaatttcatcaaacttctaattttagcgtggaactaaacacacccactgtcattttaacaaagtcacatcgtggagtggcattacaatgtcaattttctcgcttttaccatgctttgtcttggggcatgagccatggcgctccacttgcgttgcgtgggggttctcttatacttcttctctattcaaaaatataaaggattttatgttattttcggttacttagatattaaaagaaaatatggtctcctcattcctttcatagttgattatatacttactagagacttaaaaacgatataagttatggataaaacttttatatatgtagttttaagctacttaaaataaatgctgaaaaaaataaactatattagaactgaatttagagttgactttaaagaaaatatttcaaagagaacttaaaaatcaactttaaattaagttttaaaatttaaattttggttataactgataaggtcaagatcaaacgatgagatagtaatctaaaataacttttatgatgtacaaaaaatatttttctatcaatgaggcgcacaaatggcgacttgcattgcaacgcaaccttctccagtcttatgatctccccggttcctcgaataatgagcaatgtgcaacgcctagctaagttcctattcccgaccacccagttattccgctcgagacaacaacaatggcgacattctgcaaggtacggaaaagagatgatggtatctacgtcctgacgctggccagcagcgacggccaccactatctgaccaccgaagccatcacccagctcaagcaagccctcgagagaatccgcagcaccaaggcgagaggcctggtgacgaccaccacgtcgggctccttctgcgacggcatcaacgccgtgtcggatgacgacgacgacgagccgctttcttcgttggagcgtggcatggccgaggtggtgcgcctgctgctggacctgccgatgccgaccgccgccgccgtccgcggcgacgccaggtggctgggcttcgtcctggcgctggcgcacgaccacctgttcgtgcatacggaggccgtgctgggattggccgccgctgccgacacgacggccaagccccgacggcgcccgctgccggactacgtcgtggcgctcctccgggagaagataccgtacgcgcagctgcggaagctgctcttgctcaaggcgcacgtgttcaccggcgaggagctcaaggggaactggcactcggtgcacgaggcgatccccaatcgggatcatgtggttgctgttgctgtgcagaacctccaaagcgtggttgtgggagacgggatggactacgccaaggtgaggcggaccatgtacaccaacagctgcgtggctgttgcggtgacgacgacgacgacgaccatgctgcctttcgatggatcatccaggtatatatcatagatattgatgatgattacataaaaaatagtactctttttttttctgagaaacatttttttgagcaaggatgattccattaaagttaactagaatatcttgaacatctgttaatcaacgtaacaaagcagcgtagccaacggtgtgacgataagcagtgaaatgacgccttcgggggaatccttcaactcaaggtatgcacccatgtatcaatttcaagtttaaaagctctctcacgattgaacaaaccatgcaaaaatcggtctttaatttaattttcctaaaaacgtacttctctcacccaaaatagtacttatatataataattaaaatttgtactaaaatgtaagcgctttactattcagtatactacctaaataaatcactacctactcatttagagtacctcgacacattcaaacttcttgacgtctgaccctcgacatctactgtttaacgaattgagttctatgatctttgacaatgagaagcatttgttaaacaatttatacgtgaacgcaaataaccgatgcacttattttaccattagttttgaaactatatatttctaaaactgttaaaataaggccccatcgtttcgcttgttcgggaaatgagcccaacaacatatctgcaaacgaaaataataaaaataaatctactaaaataataaaaataaaaacaataaaattttgtacatatctggaaactaaaataataatatttgtgaataaaacatttatacaagtattctttacgatttaaaaataaaggctgaaaaataaacttcaacaaaaaaaaccccaaaatcagctccaaatttcaagatgaaaattcaaattttggctgataagtataagcataaacaataaaaaaaagataaggctgtttagttttatgacaataaatctactattatatttttacattttatatcatgatcctctgacacaaaataattgacctaccattttaggacatactatttttaatagcttttgaatatataagtctttagtccatataaaaaatataaggcatatcttgtttcataaggataagtctttaaccaactattattattattattattttattttttttgtgatgcaaaattaatgttattatactttgttatacaaatgaaatgataagtgaagcaattggtggacataaaacgacttatttactttaaaatagagggaacagagggagtacgtctttactcactagttcttaaggacaaaaatgaatcaatgtgctagatctcctctaaaatcaatagaaaagcacaatacaatttgtactctcagttttgatcattgaattaattggccaggtctattccccgtcttaattaccattaattattagaacttcaatttctcttgcatgacttgcaaagctataattcaagtactacaccagtggatataagtctagctgccatagaagcctgtaccgatggattttcggaatcaaaaaaagttgggagtggtgcgtatggaaaggtttacaaggtatatcccttatgctttggactgttttctcaagtgatactagtagctagcaccagtaatagcgggaagtaactttgtatgatgtattaattacataagccaaatataatagggagtttacaacgaggaggaacttgcattcaagaagattgatggcttggccgtgcttaacgaggatcaattcaagaatgaacttaaacacctaatgagtgtccagcatagaaatatcgttcggtttgttggttactgttctcaaataaaagaaaaattcatctggcgaggaaaggaatacgttagtgttcaatatataacaagaattctgtgctttgagtatttgccaggtggaagccttgacaagcatctggatagtaagttcctacatacaattccggacatattttctgttgcgaaaatgagataattttcgtaagttctctcttttctctacattgcagaagaatctgaatctgatggatttgactggcgcacacgatacaatataatcaaggtgatttcccaaggattaaattacctccatgaattggaaaaacctattttccacttagacctgaaacctgccaatgtattgcttgatgagaacatggagccaaaaattgcagactttgggatatcaaagcatttcactggaactaaaactcacataacaatatcaaaacctacaggcacaccgtaagcgaaatctcctcttgcacctaatttattttaccctgcagttaataaatttgtgactttcttatataaactggtcatgaccttaacttccattggccccgtgcagtcgttacatgccgcctgagtatttgaataaactcgtgatctcaaataagtatgatgtattcagttttggagttatggtcatggaaatcattgctgggcctactggttatgacaacttcagtgaagcgaatgatcaagacagttttaaatatattgatcgtgtaagaaaatttatttgtctacatgacctatattttttattagaacacatagtttgcacttttcctcatgcatacaactacagcaacaattctgtttttatatcatatataggtgtataagcaatgggaaaagaggataacagcaaagtcgcacgatccatctgcagaaataaatcaagtgaaaagatgcatcaatattgcggtgaagtgtttaaatcagaacagagatgataggcccgaaataaaggctatcgtgggcgaactaaattaagctgaaagtgtgcttcctacctataattgacacatcaatcgagccagaagaaatcggcgcatgcaccgcctcccatatatagaagttgtgtgttcaactagagatactcgttatgtatttgatgagagttgttgtaacattttaaactaaaagaatttattttttctcttgtatgaattgttttataatccatttgtttttttgaagaatttccattgtctcaaccacccaagaaagccctgcatgcaatgccaaaaaaaagacacacacacacacatatatatatatatatatatatatatatatatatatatatatatatatatatatatatatatgtcatcgatctggagtcgcctaaatgcaggagcggggcagccggggcaaaatcgaggagtcacagtagtgcaggtcatccaaagcagcaggttagtatctgtgtattttatacggcaagatcgacgctcgattcctaaatttttctcgcttgcagagtcatgggagaatcagtttgtcaccgcagtccaaggtatgtcaccagaaattgatcatcttgttgcctatagagaggggttatgcatagttcgggtcatgcatgatctcagttgtggatggcaatttcttgactctgaatgcatatgctgtttatttgggataatgtatatgccgattttacacctgaagtatatgctttccatacatgggtatgtacttattttttttaaacataagtatctattgaacattgtatattctgcatttctgtggattggtatatgcttctttttcccatagagaggtatatactgactggtacatactggattggtatatactgcaattatccatagagaggtatatgctgtttttttttttcatctgtagtatgttctgaactttgcatatactgcattcctatggattggtattgaaccttgtatatactgcatttctatggattggtatatacttattttttccatagagaggtatatactgactggtacatactggattgatatatactgactggtacatactggattggtatacagtatgtactgcattttacaaagatatactgcttatttccttagacatgcttagtttttcaaagagggggcaaatacaggctgaatttgcttcacagaaatatatccttcatttttccagagaaggttatatgcagattttttaaaacagaagtacatgttgaatttttaaatacgctcaatttttctcagccttagtatttgttatatttgtgttctgaaaaataattatccgtaggctttcaaggtctcaggcacaaggggtagccttcaaaagacggctgcacgggtggtatctaggtatcggcaaagcagggtactaaatagacagaagaaagacaacactacctttggtatcaattgcaggtgccagcccaaatgcatagtgaatatcactaaagacttcgatgataggaagaaggagttgattgctgaaattggatttgatggaattttggatatcaaacttactaaggtaaacaggcagtttggggcatggcttctgagcaaggttgatccaaaatcaggcactattgttacagatttcaaccaggagttgccatttggtcccaacgatgtcaatgcagtttttggcttgccatgctcaggtcaacttattatcccttgctcacaagatgaattagacgggaagaaacaaaaattgtgtgaaatatttgagattccaaacttttcacacctgaaaatatcactcttagagagagtcctaaagaagcagtatgttcatcccatgacaatagatgaaaagagggaattcaaggcggcttttgtgtaatatgtcacaacaaagctcttggcaccgcaatcctgcgcaaacttcatatctcctaggtatattagagctgtggctgatgttgacaacataaaacagtacaactagtcccagttcgtcatagatgaggtgaagaaagcagcagaatcattgcccaaacgctttccgaatacgacgcaacaatccattaacgggtgtatcatcttcctaatggttagcactaatacctgccttcctaatgcagtatataatcaacacacatattgacattttgaagcaattgtgcaggcaaaatatttgagcaaactcgtgatacagaaggttgggatcacgagtgttaaatcatgccacatttctcagtttgaggacaatcaaattgctatgatgatccaacaagatatagtaagtaaacataatccaggatacactttccctcgttatgggaagctccaggtatgtatggtgccctaactctaatatacctatttaaggctgcaaaaaataagctaattagcaacgcatatgttcttcagttgatgaaggctccaagagaaaactaccctcaagcgccagaggtgtctcccctcaacttatcctccgtttcgaagatacaatgcagaggcaatgatggaggcgccaatttaatcaaattcctggaatcacacttcaattcgttagacgtgagtgcaatggttgggccacaggtacgtgaaccatagttacagtatgctacttcagactatatccgacaatgggattaagtataatttgtggttactatgattaaaaacacaggcctataaggagttgaaatcttacgttcaggatggattcaatcggattgatgagattttgcctagcatagcagatttcgtagacataagcaacctcaaaactgctactgaagcagcaaacatgttcaagaaagctttcaagtataatatggcagcggcagttaagatagcgacgagggcagcagttaggaatgttattgataccattgaggatatgcaagggcctctccatccatggggagacccctctgccatgggataccacacacccacgaactactccacacatgctacagaatatgaaaatatagtggagcaaccaacaggtaacgcttgactattaacaatatgaacacacaaaatccttacaaaatgtgactttaacaaatttcttacattcttcatttatcagatacccgacactgtgatcacaaatttggagcctcgcagtgcactcctacaaaatttaatggagctccaggttggtgtgctaaaagattaaaaaatcaaataaaaaacctgattactgcgtactaatcagtctcacatatccaggttcgaaagagactaattcttcaatgtcgcctacgtcgggaacacgcatgactaaccaatgttcaattatgctaattgaagaattcggaaccgacgagcagaagaagcgcaaatatactgttgaaaaccaccttctcacttgctgaaacacaaatcaaagcgtgcagttaaaccaaacaggaaactcatgtcacctttcctgtcaaaacaatgttcgactgagaggctggactccaggactactgatgaactgtattcctatgttatgtctatttctaacgaggcatcgttagagtaagtcctgttattcaactataccaagtatcacaccccacctaacctgacattcttttattctcttatggtttatttcagcacaaaatggctgcaatgttcctatccattcaggatttcattgacgctacgaaacatccaggagactataaagattgggagccgaatggattcagattctctcaaccttgctattcgaataatgttctaacaagaagttgagagatttcaaaacacaaactacttgggttggtggcatttcattaaccaagattttggggtaacattgcacacgtcaaaaaaatattcttcttttgctaatgggcattcaaattcaatgattttttttagatgtatgctgtagctggagatgaattttgggaagctagtcatcaacttgcacacttcacgggccccgaagttgtatatgatgtttcagatagtcacatggtgagtttgatttttcagtacgtaatctgtagtcttatttgtgaacaataacagagaagccatcccactaagaaacaattactttgcagatactaatacctgttcacctattcaaacattacgtgttgtacgtatttaacatggagagcaagaaggtattagtccttgattcactgaacacccaagatccactggggaatcacgtttcaccaggcatgacaagattaagatcatggtgtcccggtgcgtaatggaatgcatgcgtctggcatctccagggtggaacaaggacatactgaactgggactatgaggcagtggaaaatataccagagcagcaaaacgggtgagttactactccaccaaacagtatacaacctctccatagcttgaactgacaatacttttacaaaaacacatagggatgactgcagctttcacgtattcaataatatggtgaactgggatggtcttcgtcttgtgaactctacttcacaggtatataatggcttccaccctttgtagaccacactccaccataaagtcttcgccaataagctataacgaaaaactgtaacattcacaggacccgtactacctccggcgacaatttttgatccacctattggctctgcgtgataacgaggcaatacttccagaatatgtggtgcaccgtcttcgacatattaaatacaattagttcaacaattttatccttatagttttaccataacttttcatgtaattttcgatattcacttatgtcttcgcttgacagaatcttaaattcgttgctatgcatggacaaagaaacatctgtgttcaaatgacagttccacatacttagttatttcaatttttcgctaccccaaacaataacagtatgcaagtgtttattcaactgattgtatggcttatttttgtatctacacccaatggtaccatccatagggatgtggttattcacttaatcatccttccaaaatccccgctgccgcgctgcagcttaaacatgaactggatggagcaaaccaaaatccttcggtcctggcctaatgaagtagtacgtgtcttcgttgatgtagaaaatacaactcaaacccacgcaagtgcacataccttttccaaaggataaacatcacaaaaaaacacttccatttctctctttaaagagaaaataccatcatgtaaatgatatagattcctgttaacacacatccatttgtttccactgaagatacaaccaccaaaaatatccaattgtaaaaaattgaagcaaaatttacttaatatagtaaaaactgaccaatccaccacttccataatcataataaattgctcacagaaagcaaacgcaaacatctctcaacttaactggaaacaacttaaagcaaaaccactttaaacattcagaaggggctatacaaaactacaatgaaccatatactaaaattttctcttgtacgtagacgtccggccgcaggttcttgaattatgtcctgcttggtggcatgtgtggcaaaacctacgaggaaaaggcatttcatccgcatgatcattgtcttggttttcttcttcaacggaatcaccctcatttgctgctttactcttttcactccttacttcttttcttcttttcatgctggcagcctcaccgctagatttatacctattcacttttggccttcctctgcttcgctttctcacgggtggaagtacatcaccagtattatctccactctcttcctcactcgacatatcatacgcactgtcgacgtcagcagcgccaacatcttcatttccatcttcggataataccgttggccttgatatttgtatagttgctcgctttggggctgctccactattgtcatcgtcatctaaagataaccgacttttcatgtcttccaaaagttgattgatgactgtcattgccatcttaaatgtctgcacatctttgtttgcaacactagccacctccacagactttttattcagcattacatgtctataactcctctattgtgaagcatcgacatcatctttgtatccatgtagatgaggtggaacagaatcccgtgcattcttcgtccatcttttcaatatgtacctatctggaatttttgacaacccatactgaacaagcacctaacaggacaaaacaatgaattacaaaataatcaagaatacttcaatagaagttgcaaatgaagaaacatatacccttaaaacgtggctgcacagtatccccttatgctcaaacatcttgcaaacgcatgaaaattcctctctttccacatcatagtacacctgatattccttccgaaggaatgagctagactcttctgtgcacattcgtacaacttgcactgtgctttcgtcctccccaggtttcaccatgtatgataaactatcagttaactcctcagagaacaactgaaaaacagctctagtatatacttgggaagcatgaatctctatcggtgagcttgttttaatttcaaccttgtcctgcaccgagtgacaccaaaagatgattataataatcaattaaataagaacaacaaaaatgtcaaaatggatacttacgttactagtttggaattcctctgagtcgtccttttgcagtttctcattgaaaaaccggtcatacctcttaacaaacccgttcatagaactagagggtttcacaaacattttgaacacatggtttgcagactcacttctttgcgtagtagtcatcccagcaaagaacctatgggcaaaatatacaaacgcccatttgcgccttatgtcccaaatgtgacgcaaatatacattgttttccagttggtaatcactaatcagtttgtgccaagcagcttcaaactcatcctctgtcagtgtctgcgtgagaaccttgtgaaatgctttcttgaatgatcgacgcttcgagtagatgttccccataaattcttttgctttcttcagaacgtgccacttgcacacacgatggattgtgttgggaaatacctttcgaatggcagctgccattgaaggacagttgtctgcaataaaaaggtcaaatacttacaataagcatagtaaactttgaaatcctatcgaactctgaaaacgaccaaatacgcgcatacctgttaaaattccaataggttccttcccattcatgcagtctttgaatgtctcgaacaaccatgcaaacgattctttggtctcttctctcagcagggcacacccaaagaaggtactctgaaagtgattgtttaccccaacaaatggtgcaaatggcatattatacctatttgtcttgtacgtagtatcaaatgtaatgacatcaccaaaatgctcataattcaatctagacacagcatgagaccagaatatgttcttcacacggcaagcctcatcgagctgtatactataaaagaaattcttactccttttttgcaaatccttcaggacatttagtgtttttttgcatgtcgtcgctgcactcatcccgcctaattgcatacgctagcctatccatagcttttctcatgaatggaaccatggaagctccgccatgcatgctagacaacaaaccatacatatttgtcagactcatgctattgtccaccatctcttcaataataccccgagtcccctcatctattcgattgtgtgaatgataattctttgtaacccctatactctttttcattggatggttgtgtgcagcgacgaccttagttactgtccagcttcctgcacctttcaacctatttatcttgatcattgctgggcatccaattcgaacagaaggttctttggtatttgtgttcttcccctacagggatcaattacaaattaacacatactccatcacaaaaaactatcagttcattgccacaacaaacatactgtcataaatgttggtacctggtgtgaacaacaaatctgccgcattgttctctgcttattaacattaaggcgctctttattcagacggatcccaaatcctttactaacagcataaacattataaaaattaaaggcatctctctcagtcttaaatctttgccccaatgcgggagcaagaatattagcatcagcatactccagaggaatggcagcactgctgtcaacattatctactaccattctgaaaagattgtattcattcagtcttcagaacatacaaccaacaacatgccattaaaatcaaataaagcgaaaagaaatcaacatgagatccaaacctttccatcggtatccctgccccatctttttcagctgggtttccttcagtccaatctagtgaagggagcacacttctgtaatagagacagaaaatgattttataccactcaattccaaagtatatgatcaactgataactatgccaagaaagataccttgtcaccggagttccatgacctgaatcatgcgagccaactgtcaatgacatgtcctcctccatggctacaggactgcagaacacaactcaatatgcatcagtatcggccgattatttctacaattcagaaaatatggtatcttgatctcaccttgtctggacaccatgtgggattgaatcgccatcaggtatgccgaaggaagggttgcattcatccataataatttgactgaatcaatgatccagaatcattcttgttcacacccataaatcaaatgaaaaaaacccaacggcacatactgaaaaatcaatcatcaaatcagtataacatacctagaccctgtggtacaattgaaatcggtgtggttcttcacaacgtcatccatccaaaatcaccagctccgcgcggtggcttatactcgaccaggacggagcaaaccaaaatcctaatgaagcagtacgtgactttgacgatgcagataccgttcctcaccacccactagctgcactgacctattcttcaggtggttagttatgcattatcggtaattaatcacttttcaaattaataccacgcatcgttcggctaatgggtacatactgcgtgactctgcgtgactctgcactgccaacccgttaacaggtacagatctcaaagttaatcaatggtatgaggggagggagtatgtacacccgggtgtatataagagtcatcctatatatatatatatatatatatattatatttatatatgtttttcaatacatatacatgcataatatatatgtatttatacatatatgtatgcaaatgcatatgtatatattaaagcacttaacattttatgtgcatacatatgaccaaaatatatatttacactaaagtaaatgtgtacatatagaaaaatagacatgtattaattacaattcattatgtcctagctagcgacctatgaattgtatttccgtcgtagtagaattcacctcaggatcaaggacttgttcgttgatgaatcccatgagttgttcttgaaccgccgcgataaattccttgtgtatgagttatccctcatgcgaataacctatgaatgtatgaaattaattagtaaacaacaaatctatatgtacgtaacgaaattttgaatttatttgtacgtacaccgagctctcttgtggtgatgatttggtctgcaaggcagtggcaatactcgcacacgtagtagccacacaagttagttccctggtcttgctttgcacactatatatactgtaggaccttagattgatcaagaatcatgttgaggttctttttaccatcagaaaatctttgcaaagaacttttcaagtaagaaacctcttgagtaagagtagcacaatttttgcaagcatccaaaagacctttttgttttctacaagttgagcaagaaagcacctcatcttatttgacaatttcttccatgtacttaacacgacccaaagcatcttttaacttcatctcattagcaacacatgtcaaacaaggtttggtactatattgcttaatcctcttagagctaatcaaattaaacatcgagctagcaaacaaagcaacttgacatttatttaaagctctcttagtcaaaaacaattcatcaaccaatctagtgttcatggcaaagctaagtgcaagacaagattcaaatttccgagttttcttagattcaacatcaagcttcttggaataaacatctctaattgacttaatttcagcaaataaaacctcacaagatttgcattcatcatcatcagaaataagagatcttattctactattttcagcattaagagactcaatagtaacttcatgttgacttatctttttctcaaacttagaaattttgtaaccaagtctagcaatcacttcttgaagatattcaacactaggagtaggaattacctcattgtcatcgtcagaatactcttcaacgcttctagccatgaaacaaactccaacaacgttcttgcctttgtcatcatcttcatcacttttaaaatcagcatcacttgattcttgaacagctgcaaatgcctcatcaagtgccttctggtagaacttcttcatcttcatgttcttgaattgcttcttgttctacttggtgttcttagtgttcttggaatcatcttgaggttcttcctttggattccttccaagcttgggacaacgagctcgaagatgaccaagtcctccacaatgaaagcaacgaggtggtcctcctcttttcctagacctgagattacttacagctcgagaaattctgttagcaagacaaaccaagtcctcctcacttatttcctccagttgatcatcggacaaggcattaaaaatagaaagagctgccgtaggagaaatatccaaagaaggtccagaagaagacaccaaagcagtagatttcgaatctgttctttttgaactttttgaaagaatattcatctcataggttttcaatttagtataaagaacatccaaagtcaaagtgttcatgtcaacagattcctaaatagaggtcactttaacatcccaaaccgtcatatcaagaccattcataaagtgacgagcaatctcagattgagaatagttaacatcataagaatcatcaacagatctaagatcactcaaaattttattgaaacgccccaaataatcatccaaagattcaccagaactcatctcaaatttaatgtagtcctttttgaaaacatcttttcgcaactccttaatgtttgtagatccagtatgaaaattattcaaagctttccaaatctcattagcagctgcaagatgtgaaacacgatcaaaatcagaacgagaaatcccactgagaagaatatttcgtgctttacaattattttcaaaatcagttttctgggcaatggtttcaatacgatcaggaatctcataaactgtagcaactttcatccagatatcatagccttgagatgtaatgtaagactccatctttttcttccaataataaaaatcaactccattgtaaatatgaggtttgcttgaaaacttgtcagccatggcaacaaatctaaagaccggtaaagatcaaatagaaaaacgtggctctgataccacttgtaggatcgcacaagaccaaacaaacctaccagagggggggtgaatggtagggaagaccaaaaacccaaaaatcttttgcggaattaaagattaccctcaaacgaagtcgatgacgaagttcagtcgccgccggtcgaaccgcccacctgccgccggtcagactgccgaagccttgccggtcagaccgtccggacacctgcggtcagatcgccgctatcccgctggtcagactatgcgcacatctgcggttagaccgtcgggacccagaaacaccggtagatgataaactcgaagatgtagattgaaacttttcgactttattgcatcaactagtgtttacaaagtgcaccaacaacactcctcaccaaaatctcgaactaaactcgaaaccctaactttctctcaacttgtgtctctctaaaaccgataccaggaggcctcactctcccgctctatttatacctcaaaatcctctactcagagtaggtgtagaactcctatttacaataggacttaatccctcaatttcctttttctccacagccgcaccagccatggaaaatccagccgtcaccatgtcggactctatctacgttcgtgatcgaatccatcttcgacacatgtccttctccgtactgctcacgctcgtctcgcgtgggccgacgcctcgacctgctcggcctcccaacacttgcatggcacggcatgcatacatcacatgcacacgcatatactgctcgccacagtacacacacatatgcatgctacagtacatcgccgtactgtagcgctatatactccattccaatttcttcctgtctccttcgcgaaaaccgacgcttgcacgcacacctcatgaagcccgttgtgaagatctctcccacatggtgtctatccaccgtgtgccatctcgtatccaacttcgtcacccggtatccttgaccgtctggacctcaactcatccctgagtccagtcccgatccccaccgttgaccgaagttgatctctaaaaatcctgactctagtcatattctcacatggtatcccgactacactagacctctgctcctctctaagcatagtcccggttctcaccattgaccaaggctgacctcaagtcacctacacacaatcagacaaaacgaccgttactgggcacagatatcacaaccggacccacattagtcacacgcactcacaccaacatccacacatcttttcaaaccaattcattgattaaatcatttgcacagccaattgttcatcacaaatattaatcatgacaatgatttcatatatacatgacaaacggcgagagatctaattaatatacgcttgtatttgaattggagattcaatataaatttagagcatgtgtactcacataaaatttaaacttccgcctaagtttttctttccaattgccgcggaccaaatgacagaaccgataccaagccctacatggagtttaaagctatgattcatagtagcaattaattatatcaaaattcgtaataacattggaacttatgacattacatgtctatatgttcaaaaacctggtcaaacgtagactcttttttatccattgagtcatatacattgactacgcaagcctccaagtcgaagagtaaaaggacccagtggaatctgcaatgtgcgtcggatgcatgacatatgaaacacttagcatgtacgtacaggaatgcaatttggtaggaagaaagtaaaaactaactgtgtgttgtacggcaatagtacgaacgtcttgtaatgctgctctttcaggagatggacgagattgtcctctgtggcttgcggatacttgtcgatcattgcgacgtttattttccgagggtcgatgaatccagttcgaaaaccccccgccgtcgagccctttgaatatccattctacaacgataaaaggaagtatatattatatatggtgcacttatatacaaggacctaattaattaaaggaaacgtaataagaaatctaaatgaacgatacttacaaaatccaacaactcataatagagacgtcgagggcgtccagctcgtatagttcgtagatacccttgaaattgatccaaagaatatcttctccttgcaagaagtccatgtccctgatcctcgctccgatcatctctctaccggtggcgctcatttccacgtacggttgatggaatttgtatatctgtgtcggtagggactgcagctgctcaggcttgacaagcggtttaccgagttcgtacttgtatttcacttccgcctttgggattggtgcgcctcgtagaaattgatccgtagttagcccggtgtcagaaataaaatcttttattccaatttcttcaccggtcaccaatggctcgacctcctggtttggttgctctccaagctgagggactggtttggactttgcagaatatgctttcttaagtgttcgatcatagtccgatagctttatggcctccttggcaggtgcagacatacccctgaagaagtttctgacactagggtctataggaatcttcttttctgtaatttgaggcttcaattacctcttgacttctgctgccacataagattcaagctcctcttgcgtgcaatcgtacgccggctgcttgtttccggcggcgtcaactttcgccttcttcgttgcccttgtgcgggcaggcggtggagcttggtgggaccttgacttggaaggtgccggacgaggagcttgaggaggagtcggcgcaggagcttgaggagtcactgtagaagcttgagtaggaggagcctgaggcagagtcggtgcaggagcctgatgaggagtcggtgcaggagcctgaggtagagacggtgctggagcctgaggaggagatggtgcacgagacgccgcttgtcgcccagggaggatgatgtactgcttgcgccatagtataatggcgtggcttgtgtctcgtagatgcgtctcaccgtctcctccagggtagtccaactcgaagtcctcgtacgcggcttccaccaactcaacttcgaccttcgagtatcgtactggaattggcctgtagtggtaagtccctgaagggtctgttgggatggccattcccgatgccaccttcacgtggtgagaggttatctattagtaatcaacataagcagcaacttgcggaatggacaagtcaaaaatcataaaactatgagcataccttgattgataagttcttgaagggaatatgcaactcacatggtgtccgctgagtgatctcatcaacggggcaggtggtttcgtcctgagtttgcatggcgtccatgctctgtgatcctacctgccccgttgatgcgcagctgctatgattgcctgatgggctgaccattgcaggaggaatgtacggctagggatcctgagaccgatgtgcggccatgcgttcatccaccttccttgccacctcctcttgcatgctgagctcgtagctcgataccctgtactaaagatctgcaatctttgcctcggtatctcgcttgctcctcatccgactcctgtacgtgtggatgttctccttgaatccaatcttccaaggaatcacccctttccctcgtgttcgtcctggatgctcgggagtctgcaggttgagtgacagctcgtccttctctctgtcgggtcggaacgtgccctgagaagaggcttccactgcgttcgttagtcgactggcagcctcgtgtatctgatcgctgaagaccagggagccatcaactgggttaagcgttccaccgtgagcatagtaccagaacttcgatcgatccggccatttagcggtggccggttcgatacccctctcaaccaagcttgcctccatctcctcccacttcggcatcacgacgctatagccgcttgaccccaagtggtgatggtacttcttcttggcggcattttctttttttctgtccatcatcgcctgcccttgtttccctgtcttgtaagcaacgaactcgtcctagtgatcccttagcttcaggaatgtgttgacgtttggtgtctgccccatcaggatgtatttctggtagagatctcccttgaatctctgaaactgttctgccattttctttagagtccaccttttcactatgttctctgtacccgtaggaagggtgaatctctcgagcattgttgtccacatcatctctttctccgaatctgggaccaagctgtcatgatctccacgtgcccatgttctgcgccagtacaccgtactgacaggcacgttatcccacacaacccaaccgctgtgtcgtacttaattcttggctgcttctgccggggcactaggtcggccgtcttcgtccacttctgttgtgatgtgtcgaccctctaacttcttcgcggcacctcattgtccgcgtgccctcttctgtccagcggagggttgacttccactagcctcctctcctcgttcccctccgcatccctctccacgtaaactctaataatcttatattaaaattttagtaatgatatatgctaagtctaacattcacatatgctaagtataataatcttatattaaaaatctaattatcttatattaaaaatataataatcttatattaaaactctaacaatcatatatgctaagtttaagtgtcgtatattagaactcaaataatcatatatgttaagtctaacatcgtatattagaactcaaataatcatatatgctaagtctaagtgcgtatagtagaaccctacataatcatatatgctaagtctaattaagttttgtatattaaacctctaataatcttatattaaaactgtaataatcttatattaaaattgtaataatcatatatgctaagtctaacactcacggcgacgacgtcttttctgcaacatgcaaaaaaatgtattagtctaaatgcaaaggaacatatattgtatttcacgttttcaagtatatataatcatatatatatatatatatatatatatatatatatatatatatgctaagtttaataatcgtttaattatctcgtttgtacacgtttcgttcacgtttcaatggtgttcgttcacatttcattcacgttttgttcacgtttcattcacgtttcaatggttcgttcacatttcattcacgtttcattcacgttcgttcacgtttcgttcacgtttcattcacgttcgttctcgttaagttcacggtcgttcacattcgttcgcgtttcgttcacgttcgttcacgtttcattcacgtttcgttcacgttcggcaatgacggggcggcagcggagcggcggtgtggcggcggcatggcgttgcggcggcgtggcgaggcgggggcggcggcatggcagtggcatcgatcagcgtcgtcggcagtggcggccgtgtggacgttacgtcctcggtggtggcggccgcgtcgaagtcggggtcggcatcggcaggaggcggagtcggggtcggccgcgtcgtcggcggcggcgtcggcaacaaggcggcagcggtttggagagagagatcgagatcgagatagagagagaggcggcggcgacgttggcggcggcggcgacaacgatgaccgcgagacgacggcgagagacgatggcggcgtcggcgcggggatgccctaggctgtggcggcgaaggagaagccgagatcggagaaaaatcttctaagtgttggtggagaagacgatggcgcatcgggaatatatatacccctagatctttagtcccggttgttctctccaaccgggactaaagtctcggttggtgagaacaaccgggactaaagatattttcccactatttccaaattccttttaaacccagttagggttaagaaccgggactacagataatagcaccggatattgaatttcattacatatgtgtttctaaaatagtaaataattcattaaaattatttaaagtcaaaaaagtaatgacaaaaccttcgaaaaattattgttgtctgtattaaattaagtggataatatataataagcacatgaatgatttaaaattgttaaaaattctaataatcatatataattagcatatgcatgatattaaattgttaaaaattctataacatatgtaaataccacatgcacgatttaaaattaataaaaattctaataatcatatataattatcatatgcatgatttaaaattgttacaaattctaattaacatatgtaaataccacatgcatgatttaaaacttttaaaaattctaataatcatacataattaacatatgccataaaacaattgatttatatggatattcaatacatctaaaatagtttacatcgtgtacacaacaattacggcaatacatcggcggtgacggttgaccgcacgtactttctcctcactattgatccttccttgtgatcgctacgtgagtaaggggtatcttcatttgataggaggatgctaggatcaattgtcaccgtgaaagggggttgcccatcaaactgatcgtaatcctcgtcagtcttgtcctctactccgacgatttttttttgcctgggagaaccacgtggcgcttcggctcgtcaggccctttgcccttctttcctttgctagacatgtccttcacgtaaaaaacttgcgttacatcattggcaaggacaaaaggttcgtccgagtatccaaccttgtctaccgttgtcatcccactgtcatcaatcgttacgcctccaccagtcaacctaacccattggcactagaacagagggaccttgagaggtccatagtcaagttcccatatgtccttgatggcaccgtaatacgtgccagttgtaccatcgtgtcccatggcatcgatacgaacagcattgttctggttcgtgctcttcatgtcttgggctctcgtgtagaatgtgtacccattgatctcatatccctggaatgtcgcgatcgagccagatggtcccctcaccaggaaggccagttgttggttaatcgtctcgttacccatgagatgtcgtcgcagccacgcggggaaagtatcaatgtgatgccgtgtaatccatgcatcggacttaccgatgtttctggcgcgaactagacccaagtgctcctcgatgtaaggagccaccaatgaagattgttgcagagccgtgaaatgggttttacggaataaattgttgtctaccgtcattattgctttccttccgagagtcccctttccccgtagtctcccttcatggtgtgattcaggtaccccgattaggcgaaggtcttcaataaattctacgcagaattcaatgacctcctctgttccataccccttggcgatgcttgcctctggacgagcacggttacgaacatactttttcagaacgcccatgtacctctcgaaaggaaacatgttgtgtaggtacacaggcccgagaataccgatctttttgacaaggtgacaaagcagatgcgtcattatattgaaaaatgaaggtggaaatatcaactcaaagctgacaagacattgcaccacatcattctgaagggcttctgctaggcccctttccaaacactactttaagatcttttaccatagcaaacactgttttcccgctgcgatgtttagtcttcttacggtagtccgccttatgttcaaagtgcttgcctttcttccgtactggatggtttgcagcaaggaatcgacgatgacccatgtacacaaccttcctacagtgcttaagatacgtactttctgtttcatccatacagtgagtgcaaaccttgtacccattgttggactgcccggataggttgccaagtgcaggccaatcgttgatggttacgaacagcagcgctcgtaggttaaactcctcctgtttgtcctcgtcccacacagggacaccttccttcttccacaacagtttaagatcttcgaccagtggtcttaggtacacatcgatgtcgttaccaggttgcttggggccttgaataataattggcatcattatgtacttcctgttcatgcatagccaaggggggaggttgtagatacacatcgtaacgggccaagtgctatggccgctgctcatctctccaaaaagattcatgccatccgtacttaaaccaaaccgtatgtttcgtgcgtcctttccaaaatctttaaattttctatcgatgtttcgccactgcgaaccatcggcggggtgtctcagcatcccgtcctgttgacgttcttcagcgtgccaacgcatcattctagcattccccttgttcctgaacaaacgccttagccgtcgtattatagggaaattccacatcaccttagcagaaattatgttctttgttggctgcccgtcaacttcacctggatcctctcgtctaatcttgtattgtagtgctttacaaatagggcatgcttctaggttcttgtactcctcaccgcgatataggatacaatcattcagacatgcgtgaatcttctgaacttccagtcctagagggcagactatcttcttagcgtcgtacgttgtctcgggcaatttgtttccctccggaagaataatcttgacgagtttcaataaatcgccaaatgccttgtcactaacaccattttttgccttccattgcaagaactccagagtggtatccaactttttgtgcccctgctcataacctgggtacaacgacgttctgtggtcctctaacatccgctccaatttatgggcctccttttcactttcacagtcctcctttgcgtcctgcaacatctgaccaagatcatccacagcgtcgttatcgccagcatccctgtccacctcacccgtttgatttccttcaaatctagcgtactgagcccagttgggaatgttctcgtcctgcgcttcatcttcttccatttcaaccccttgctcactgtgggatgtccaacaattatagcttggcatgaaccccgactcaaacaagtggaaatgaatagtcctggatgcagaatactttttctggatcttacacttattgcatggacaacaaataaaatcgttacgcttgttagcttcggccactctcaaaaaataatgcacgccctcgataaactctttgaaccgccggtcagcgtacatccattgccgatccatctacatgaaatgaaaaaaaaatcgtacataaataaattttcgtacaataataacagtcaaacaataatgataaaataattaaaaactctttcgacaagcataaaaaataatgacatataattactcatacaattagtaattataaaataatccaacaaacaattcttattaacaatttttgaagttctgaactaatattaatgttgtacttctcttaattttcaatttagtttgttttctattttttaagattaattttcatcatattttaaactatgagaataaaacttttttaagtaaacaaacaaaatttctatatattcttcttccccacacaaattttctctctcatcaacttacaacaaagttttggagacaattaatgtgtgaaacataactccaaaagtaatataacaacaaaatacattggaggatgaagttactaaccttttagacacttccgatttgtatataatcactaaaaaaatttcacaagtaattttggcatgacctcccctctttctttgagaaattttgaagcttgctcgggctggaggaggaagaagacatatataaaggggggaccaaccggggctaaagatcgccaggatctttagtcccggttgataacaccaaccgggactaaatatcacgtatgtccgttgtagccaccaaccgggactaaagatcatgtttagtcccggtttttaatggatcctggactattatgaatttcgaccgaccgaccaaaaatggtttctccacccgtgtaagcttagagcacaaatgtgatccagataaaatatgtatattgtttatgtggattacacttgttcaaaccaatatttttcatgtgaatttgaatatatggataggcctcataaaaatatgcacgatatctccatattgtgtaaccgagcctgtgccatatgtccagattcgtagttttaggatgggtctaatctcgttctaggtttgctacatattaggacggagggagtataatagagctgtatacagaggttgctaactgataaggtatgtacataatataaagcaattattaagtaaatgacatggacatcaacaaacttagataaataatttttagctgtaatttaatttgtaaaagcaactaaagtaatcgcacagcgacacacacaaaaaacataatcacagtataacataacacatagcataaactgaggctgaaatagtcagctcaatgcaacaactatatatggagttaagcctcgtatacgacgtgttctaaagtccgttttgaagcgaattattagtcgcacgtaaaaggagaaatatgattaacatataattaattaatcattaattattaaaaaataaaaagtagatttgttttattttttaaaattacttttatatagagaattttgatgaaacgtaccagcttgataaaaaacgtacgaagtaggctatccaaaaacagtttatttgcgtggctagctcttgcaatcattttagctgcctattgctcaatttgaaacgaagaaaatcgcaatgattccgcgtttgcccttggtcagcgatccacatgcatatatattaggtacaagctgtcaattaaccttatgccccacgtatagacaacagggacacatgtgtgcattttcttttgctgaaaacataggtcgcgaagatcaagtcaacgtgtttcggttagcagtcgttttttccctatgcaaccaagtggtcacctctcacgattaaatggcgcgcctgtgctcgatcgctcccttgcaagagaaggtgcagccccggcttctcttgctcctttttccctttggagcctttctccagctcgatcagttcaaactgcgccactctttaccaacctacgttgctaaatccagtaaagccactctcacgttttgttttgcctcctctttttttttctgaattgagttctttttaccaggaaatggtattttgtatttgttatttgggattgaaattttcggaaatttttgttctttacaagttctgtgcaacgaaattcttccggccaaaagtttcctttttttgttttgtaaattaatagttcttcccctagatattagtttttttgtgaaatttcggaagtttcagtcctaaggaaatttttttttctttcatagtaccgtgttggagttgttccaaattcacttcaagatattggccgggcttctgacgaagcggagcggaggcccaagccggagggtatatatgccctttgctagggtttcgtggagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacaagtggtatcagagctttggttgctgttagggttcatgacgacgtcgatgaagttcgatcttccgctgctgaactacgacacgcggttctcgctatggcaagtcaagatgcgggggattctggcgcagactcatgactatgatgaggcactggataacttcggcaagaggagggccgagtggactgctgaggagatccgcaaggatcagaaggcgctcgccctaattcagttgcatcttcataatgatattttgcaggagtgtttgacagagaaaacttctgcagaactatggctgaagctggaatcgatctgtatgtccaaggatctaaccagtaagatgcagatgaagatgaagctgttcactctgaagatgaaggaggaggattcggtgatcacccacatggctgaattcaagaagatcgtggccgacctagtgtcgatggaggtgaagtatgatgatgaggacttaggtcttctactgttatgttctttgccaaattcatatgcaaatttccgtgacaccatacttttgagccgtgatgaactaaccctaaaggaagtttatgatgctctccaaaacaaggagaagatgaaaattatggtgcagaatgacgggtcgtcgtcctcaaagggcgaagctttgcatgtgagaggcagaactgaaaacagaacctcaaatgaaaagaactacgataggagaggccgttcaaagtccaagccgcctggtaataaaaagttctgtgtttattgcaagctgaaaaatcataatattgatgagtgcaagaaggtccaggctaaggaaaggaaaaacaaaaaggatggtaaggtctctgttgcttctgctgctgcttctgatgatgattctggtgattgtctggtagtatttgctggttgtgttgctggtcatgatgaatggattcttgattccgcatgttcgtttcatatttgcactaaaagaaattggtttagttcttacaagcctgtgcagaaaggggatgttgtgcggatgggagatgataacccatgtgctatcgtggggattggatcagttcagatcaagactgatgatggcatgacacgcacgctgaaaaatgtgaggtatataccagggatgtccagaaatcttatttcattgagcacgcttgatgcagaaggttacaaatattccggttcagatggcgttctaaaggtatcaaaaggttctcttgtttgtttgaaaggtgatgttaattctgcaaagttatatgtccttagagggtgtactttaactggttctgattccgctgctgctgctattactaatgatgaacctagtaagactaacctttggcacatgcgtttgggacatatgagtcaccttggtatgacagaattgatgaagagaaacctgctgaagggctgcacttcgagtaagatcaagttttgtgagcattgtattttcggcaagcataaaagggtacagttcaacacttctgttcacaccaccaaaggtatcttgattatgttcatgctgatttatgggggtccttctaagaagccctcacttggtggtgctcgttatatgcttacaattattgatgattactctagaaaggtttggccttattttttgaaacataaagatgatacctttactgcttttaagaactggaaagtaatgattgaaaggcaaactgaaaggaaggtaaaattgcttcgtactgataatggtggagaattttgttcgcatgcctttaatgattattgcagacaggaaggcattgttaggcatcacaccataccccatactccacaacagaatggtgtggccgaacgtatgaacaggaccattatatccagggcccgttgtatgctgtctcatgcaaggatgaacaagcgtttctgggctgaagctgcaagtactgcctgttatttgataaacaggtctccttctattccactaaataagaaaactcctattgaggtatggtctggtacgcctgctgattattcacagttaaaagtttttggatgcactgcttatgctcatgttgacaatggaaaattagagcctagagctgttaagtgtcttttccttggttatggttcgggagtcaaaggctataaattgtggaatcctgaaactgggaagacttttatgagcaggagtgttgtattcaatgaatctgtgatgtttactaacagtttgccctcagaacatgttccagaaaaagagttgcagcgtatgcacatgcaggtggagcatgttgatgatgatacaggtgttcaggtggagcctgttcatgagcaggatgaccataataatgatgttgctgatgatgatgctcatgatgatgttcagcaaactcctcctattttgcagctagaggaggaattacctattgctcaacgcaagtcaaaaaggacaacaaaacctcccaaacgtcttattgaagagtgtaatttgtcttactatgctttgagttgtgctgaacaggtggagaatgttcatgagccagcaacctataaagaagctgttcgttgtggtgatagtgagaattggatttctgctatgcatgaggagatgcagtctcttgagaagaacagtacatgggaggttgtacccttgcctaagaaaaagaagaccatcagttgcaagtggatcttcaagagaaaggagggtttatcttcaagcgagcctccaaagtataaggcaaggttagttgctagaggttacagtcaaattccgggtgttgactataatgatgtgttctctccagtggtaaaacacagttcaattcgtacttttcttagtattgttgcttcacatgatcttgagcttgagcagttagatgtgaagactgcgtttttgcatggagagcttgaggaggacatatacatggaccaaccggaagggttcatagtgcctggcaaggaaaaatatgtgtgcaagttgaagcgatccttgtatggtttgaaacagtcccctcgtcagtggaacaagaggtttgattcatttatgttgtcacacagttttaaaagatctaaatatgatagctgtgtttacatcaagcatgttaatggatcacctatatatttgctgttatatgttgatgatatgctgattgctgccaagagtaagattgaaatcactaagttaaagaagctgttgagtagtgagtttgatatgaaagatcttggtagtgctaagaaaattcttggtatggaaattagtagagacagaaaatctggtttgctatttcttagtcaacataattatatcaagaaagttcttcagcgtttcaacatgcaaaatgctaaggctgttagtacccctattgcaccccactttaagttgtcagctgctcagtgtcctagtatagatgcagagattgagtacatgtcaagggttccttattctagtgctgttgggtctttgatgtatgccatggtttgctctcgtccagatttgtcatatgctatgagtcttgttagtagatatatgtctaatcctggcaaagaacattggagggcagttcagtggattttcaggtacctcagaggcacaacatattcatgtttgaagtttggaagaactgataagggccttattggatatgtggattctgattatgctgctgatctggacaggcgaagatcacttactggttatgtgtttactattggcagttgtgctgtgagttggagggctactttacagtctgttgttgctttgtctactactgaggcagaatatatggctatttgtgaagcatgcaaagagttgatttggctaaaaggtttgtacgctgagctcagtggagttgaatcttgcataagtttgcattgtgatagtgaaagtgcaatttacctcactaaagatcagatgttccatgagagaactaagcacatagatatcaagtatcattttgtgcgtgatgtgattgaagaaggtaagctgaaggtatgcaagattagtactcatgataatcctgctgatatgatgacaaagcctattcctgttgctaagtttgagttgtgctcaagcttagttggtttaattgaatagtccaagagactattgttggcaccagtggttttctatctttgttgttcaagatgattggttgatttatgatacaagaagaatttgtcttaaggtggagtttgttggagttgttccaaattcacttcaagatattggccgggcttctgacgaagcggagcggaggcccaagccggaggcttgggccggtatatatgccctttgctagggtttcgtagagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacataccgaaccctggtttacctgttaccagtgaaatatatagaagttggactttcggctgacgttacagattgtctgtaggcgggaaaagtaacatcaaaggcacacctgctaggagagacatatcattatggagtttacattccatttgatagaagaaattaccaataaattttctgacaagcaaaaaattggtgagggtgggtatggaaaagtttacaaggtatgttctataagttcaactttttggttttctattttgcaataggatatcattcgacgcctaaaccatgttaaataaaaacaaccctagactataggaggtattaaccactgactattactccatctaacaaaataatataagcatatcaactttgatacgtctagaagtttacctgattgaaaaagataatgtcgagtgatgtaacaataaatacagatagggtgtttttagttccacgccaaaattggaagtttaactaaaattgaaagtttgaagaaaaaagttgaaagtttatgtgtgtcgaaaagctttgatgtgatggaaaagttgaaagtttgaagaaaaaattgggaactaaacaagagctaagtagcatagatctatgaatattttttatttgtggacaaatttaaaacactataaatataatacttatggacgtgtcgctcaagctcgagtcgagcttggtttagatacgagcttgggctcgagctcagctcactaaagcctcgagctttgtcgagcttaactaatgtggcagtattagatttgtagtactatcgtttttaaacattatataaccaatagtagtagtagcattaaatggaggcatgaagctgggttgcatgcatgcttgtactagtagggccgagtttagatgcaaaatttttcttcaaactttcaactttttcatcacatcaaaactttcctacatacataaacttttaacttttccgtaacatcattctaatttcaataaaacttctaattttaacacaccctagtactagtagaggctaggtactagtagtactagcagagactagggcctgcctccacgccatgctctgcttttcttcagctttttcttgggagatgaatcaagtactactactctactagtagactagcactgcttctagctgttgcatggaaaatttgaaagaactggagggagagtaatgccagctcaaaagaaacggagagaactctaggctcgacgagctattcgagctcggctcgtgaagctcgtgagtttgaagctaagcttgagcttagttcgaattaatgacgaatcgagctcaagacgagtctatagcgagccgagctgctcgtgagccttgagcttttttacatccctagcgcacagtagcgcgttaatcttaaagcgagacctctcaattttccaatttcatttgttacttttttgtcacagtcccccctactttctattatctaaaactcaaataaaattttctcttaaaatatttatccaatttataatccggttacacaaatgtgtttgttgcaattaaatatttataacacaattttacatgattatattataataaaaaggaaaaaaagtatgaattattactcccgaactatcgcggtcgaccgaattaccctctaaacccaaaaaccagtcatcatttaccctgaattttcaatactggacaaataccccccctgacccaatctagagcggttttgtctaacgtggtgcacgcgtggcaatccagttagcattttatttaattaaaaaatgtgggacccacctgttatactcctcttccactcctcctctctctcttgtctctctcgctcttcctctctctagcgcagcgtgcatgacgaggacgggcggtgggcatgggcggttggcgaggacagcgcggggaagggcgatgggcgtgggcggtcggcgaggacggtgtggacgtcggcgctcagggcggcacgcacggcacggcggcaggcaggcgtttggcgccgtggtccggaagggagcaacggcggtgagggacacggaggcggcgaccgcgtgggacacggaggtggcgaccgcgcgggacacagaggcagcggcggcgaactccacctccgcctccagccgctgcctgcgccacaggccgccgcccccatcccgagccccacctccagctgcatccaccatcgcccgccatccttatcccgagccccgcttccagcctccttcgccaccagccaccgcccccatcccgagcaccatctcgacggcgaagaagactggaccttcccctctgcgtcccgcgccaccgtttctccctcccagaggtggagttaattcgctgctgccgcctctgtgtcccgcgccgttgctgctccctcccagactgcggtgaaccaaccgcttgtcgttcgagtcccatcgcatgatgccgatgcgcagccggcggaggagatatcgacacgccgtactccgtctccttcagcgtgctgccgtcgccttcggggatacagctcggcgcgtccagctgccgctggcgcagatgctgaggcagcaggcgaggttccactcggagccgaccttgacggtgatcaggggacgagccgacgacgaggcggcgccggtgccccggagcgacagcacgcgggaccggcggttcgaccagttcaagaccttctccggctacctcgagcgccagttctccagtccagcctccgcgggatgctgccgtaggagttgccgatatcgagacggcagactcgaagatctccgaggaggaggtcgacggcggcgaggtgcccaccgttgaccgctacttcgccgcgctcgagggccccgagctcgacaccctccgagtacgtacacaatcaaccacgtcgcttctaaaccttagctagctcaaaatttcttgccattgtaatgactaatatgaggacgacgacgatgtcggcgtgagttcgtgcaagcgatagaggtgccggtgcttcccgaggacgagagccagccagacgatgagcagccaggcgatgctgtggaagacggtggcgtcggatccctccacggcgttcctccacaacagcctcgacgtcaacaacgtcctgtggtggttgtccgtcgctctcatgggcctcgtctcggccatctacctcgccgaatgcctgcctgccgccgtgcacgccgccgtctatgccgttcttgccgaccgcccacgcccacagcccgtccccgcgccgccgtgcgtgcagcgcgagagaaaggaagagcaagagagagagagagaaaagagagagagagaggagggaaagaggagtatgacaggttggtcctatatttttttaataaataaaatacttactggattgccatgtctacgtcacgttggaaaaaaccgctctggattggcttgagggagggtaatttgtccggtgttgaaagttcagggtgaacgatgactagttgttaggtttagggggtaattcggtcgaccacgatagttggggggaaattcgtactttttttctaataaaaaatatttatgttgtaaattacttttattatatatgtaagttacttttatcacatatataaattacttttggatttgattaaattatattttagacattcaatgaacaatttactctttggatagactgatgtttttactcctacaatagatttacttttagtgtcatgacaagatactttcaatttgatttaagttacctctataatatttctatgatatatataaattagttttaggctttattaaatttacttttatatgtctaagaaataatttaatgaaatctaaaagtaatttagatatattataaaagtaatttgtaatattatataaaaatgtaatcttgtgagatattgttataaatatttaattgttatgaacacaacggtaattagatcgtagatcggatgagtaattttaaaaaaaattatttgaagcatagatggtagaaatatattttctacatgcttgatggactagtactatagctaggtaagattctttaagttattttatgccgtcactgattacgactaaaacgagcctctcgatttagattttacaaatacttatattgtatatacgtggacaaagacaaagggagtaacaccgttcaatttttctctccttggcctaaactactgtggtgttttgtgcggcattccaatttacaaagtattttagtatgttgataaactccacctggtagtcacagtcttgtatcacatctcctcccttcctcctctctctttgtacgccacatcttctccatctgcttgcgcctggtcggaccacatgatgaggaccttgatcatgatttttgataggtattaataactcttgattttgtgaaaattgacaccaacgatccggttttcaatcaacacaatctgaaccttgcaatcacagcaccatatcttctctggttatcaatcgtttgttgctcgattgatcttgttgagaaggttaatccctaaatgggaattgaagaacacaaggtagattgcaagttaatcgcatatgaatgattaagcacatgaatttagagttcaacaactgaactagcgaaactgcaatggcaaaaatatgagctcatccataagacatcttggatgggcaatagggcgagcgagtgtgacaagatacagaacaggcgcaagtaaatagctcactgacatgtggaaactatgcaatagtatgcatcagtattaaatattaatgggtgtttttttctatatatggatgataatttcgtgattaaaacataatttgtatgaaaaaatgaacagggagtacataatgggaaggagattgctgtgaagaaacttaatttgttgccgggactcaatgatacggtattcaaaaatgaatctcttaaccttatgtctgtccagcatcaaaatattgtgaaattaattggctactgctatgaaacgaaaaataaagttgttgaatataatggcaaacttacttatgctgaaataagtgagcgagttatctgcttcgaatatttgaagcgtggaaacctagcaaattttatttctggtacgtaccatctaattaattaatttagtagtgtgcaaagaaatgattacatgtttaagtctcggtgaaaacaccttttacattttgcagatgaatctggtggtggacttgactggaccacgaggtacagaataattaaaggggcttgcgagggattaaattatcttcacaatggacaagaaaagcctatttaccatctggacttaaagcccgaaaatatattgttagatgagaacatggcaccgaaaattgcagattttggcttgtccagactctttgaatcgacaaaaacacatataacgaaaactgtgaatggaacaaggtaagcagacaattcgtatgtagccctcttacctcgagaattcaataagaactgcggataacttatcattattgctcaatgcttatttttccagatatatatattagattgggtatgtaagacaagtttttttccacaaatccgccgactacaatttgggctagctatcaatttaaaacacaaaacgtcaaaatagtactcacacgactatttcttgcgaaaaatcatatgacttaaattattgctgatttgacagtgcaagagatgatggttatgaaccagccgtattgatatattattttgtgcggtagtgtatttaggagcaaaatacgtttccgtaacaaattccacaatgtttatggtatcatgcagaggatacatgccaccagaattcatagaccaaggaaaaatcactaagaagtttgacgtattcagtttgggcgtcataattatacagataatcgctggaattgacggctacagacagtgttgtgacatgtcgtccacccaagaatttgttgattatgtaagaaatttcttttatgtctacaccattgaaactaatattcatttcaaacattttgtgatacattccgtaagtgctttaattttctatgagcgtgtttgaaaattatgtctttcgcaggtatatgcaaaatggaacaaaagagtgcagggaatatcgaggtatgcatcgcgcgaagcagacatgctcgcagtgagacaatgtattgaattatcgttaagatgtgtggaggccaaccgagacaaaaggcctgcgataaatgatataatccatcaactgaacgagttagatgctgagattgaaaacatgtttatgcgtcagcccaagtcacttttgggccaggtacgacgactatggactaattctgtttttcctacctgacttattgagcatctttcaggctttcattcatgcactttacattttgcagttcatatgaaaaatgttagaaaagaaagcatatatacttaacaagttcactatagcgtacgtgtctttagtgacagttgcatgttccatttgatttgccgtttcaaatagggataaatacgtccatattacaaccttttacaatcttgtttgcctgaaaaacactcttcaatgacgaaattgattgttttattataataacgccacatatattgaaattggacaaatacgctgtatggcaatacaaatatgttttaatagttattttcataattctaaaatctaatgctttttacaaataattaaaggggctacaatatggacttaggctgtgttcgattgttcaggttgggaacccatcccctttgcacggaagttgaagcggtccattagcacgtaattaattaagtttcagttaatttttttccaaaaatggattaatttaattttttaagcaactttcttataaaaactttttgcaaaaaacgcactatttaacagtttgaaaagcgtgcgcgtggaaaacgagggagatggggttgggaacttgatgcaactaaagcagccttaccctttgtaaattttagcatgtccccacctttctaccaatattgtactttgtaatcatttatggattgttgtattgaaagttaagcaccttattggtaattaattgcctttagatttgtttgatttgaccaatttaaaaataagacgactaagagactatgtagggagtatcatgcatgttcttttctattaattatttttattttacaattaatatctagggatttatgagatcgaccaagatatacaaggattatcagtttatcaccaacacatggatagtgtattccactcggaaatggatagaagagaatgtcccatgggaacatatcatgtgcacacaattttcccatagacactccgtgcataccaattagcaaatatcataaaaaattctaaaaaataaacatttactcctaatagtattttacatatcttcaaagtctcatattcaatttcattatattttacccgtaacaaaaaaagtgaaaaatctcacagttttaaaggtaagaatctgtcagctttttgttacgactaaaatataacaaatttgaaaataagatttcatacataggtgtaatactattggaagtatatgtctaatttttatataattttcgatgatatttgctagttagtgtgtacgtgaagcttgtgtgtataggatatgttccatgccccctcactattacatgatatctgaatagctatggaaaaattgacaggacattatagattaataagtgataaatcactatacaaacttccccaattaaattcgacctttagaagcgtaacaaacattcaagtttaactcaaactagtatagtataggtgtgctcatagctagttttgttttattaagtacaagaagttgaatttaaacttgcatgtgtttttatggttgtgaaatgatatatcacatattaatctatcttgtcatttttttaaaaaaaaaatactctctccaggttgataatagttgttgtttaaggcaacttaaaaaaatttaaccactattttacattataatttatatataaatataaataaatatatgattttattgaagtatttttttaagaccaacctatacatgtggtgtagagaaatattttagaaataatttatagtcaatgaattgaaaagtttggcatcacccttaacataaacacaactaagtattattaacccgagagagtatatgcacatttgtatgatatgtgaagaaacggagaggacatccgtcaaccgattaaaagagtttcccaatccagactatataagtctagttttttttcattaataaattccaatctgctgcccaactgcctcgttcaattaattcttactaatgaacttcatcctcgcagaaaagctctgaatccaaatatgttgggcttgatcctgtccgcgagcttcgattccccttcgaggtaaagaaggatatatcatgctgtctgcagctaacaaaccagacggattacttcatcgcgtttaatacaaaggcaaaccaaaagaagtatagcacacaaccaaacaaaggaaccattgcaccatggtccagttgctatgtcactgtaaccatgaaagcacaggagacggcacccccgtatttgcagtgccatgacatgttcgttgtgcagagcactagagtgaatgaggacctcgaacctgaaactgaagatatcactgaagaattgttcaagaaaacaatgggtaaggtcgtggatgaggagaagctgccgatcgtttatgtggcgttgccccaggcagaaagctagctgtttcacctgccagtcattgaataaaatcaacgaaaatagcctgaaatatgtattccgattgagcattttatttgcgtgttcagggttaatgtttgatgtttgcactcgttttcttacggtttaaaagttggttgaaaccaaatgtaggatttgctactacatttatatatccacgatgtaataagttctttaatttgtgctcaaactcgcagaagtcaccatcagaacagcttatttatttaggtaatttggaaccatatgccattataattttttaaagtttgagatatgccatcggtatctcaatgacatgtaggacccacatgagtcaatgacatgtgggtcaggatgacatatcttaaattttacaaaattataatggcatggttataattttccctatttatttatttaggaagaggattttgatccctccaggggatatcccctcgttgtttgtatatcagtcaaatggttatgataaaatttgaaaaaaaaaattgagaaggtgtattaacatgtgatatatcactccacaaacatgcaagtaaaaattcaacttctacatcttacaaaaaaaaaacaaattttactctaaatatacggtaactagctgcggttttactctgatccgccacacccgtcctcgggagtggcgctggagcgaccggtagggtgctcgagcaacgatggtgggcggtaacagcaagcgacgagggtggcagatccggcggcgccgccctcgggaggggcagatccgccatcctagggagcagctgtggcgaagacaagggctggtggtggatccaacggagcctccctcgagatgggcagatccactgccctagggatcagcggcttcggcaacaacgagggtgggcagcgatggcaagtggcgagggcggccgatacagcagcgccgccctcgggagtggctgtggagggctagggtttcggatttttttttcaaattttaattctttttgccgtatttattttcacgtgcggtttgtgttgcctgcatgcaaaaatccaactttcgcaaaccttttggtgcatgatggtcacccgtccgcatgcaaaaatcacttttttttagaattacacagtacaacgcagacactcacaacgcacacacactcacccctatgaacacatgcacgcaaaccctacccctatgagcatcttcgaagactgggccgacaaattctggagagattgacgaagtcaccacaggcgccttactgttgacgggtacgtcgcctaccactgaaagcacaacgccgttaaatcctgaaaaattcgctcccatggggagtcgaacctaggacctcaggtgctactgaggctcttgtaactactaggcttggtcgcatggaaaaacgatttctatagtagtgatgtttgtttcttgtgaacttatttaccaaaaagccccatttagtttgcaattgggttggaggattgtctcgtaaagaatatcgagtgtcagcgacaaatgtttggcatggaagaagagggaaaaagtacaatggaggtttgctccactttaatttaatttgctggtccgtggatgaactgtcacggtggtgaagggaatttatctccaagaagtgcagtgcttatgtgaaattggaattttctttgagataatgtggacatggatttatatatatggagaatgataggacaagagcgtgaaagcaagaacaaaaaattaagttaagttattttttaaacgaaacagacactactatgtaccggaacgatcacgtctgcaaaaaatcatttttcagggaatgttgacgggcggcgtacaaaaatgcattttcataagagactccttaagaggtctgactgtgaaagtagacttatttttctagcgagactcttaaacggctatattggaaaatgtatttttgcagaagaatctcttaaaggtccacctagaagtctaacttaattcctcctttctttctcagcacttcaagtctcaccttctctctcatatctcacctcctatcctccttatattatctctcattcctctctctcttcaccgagttcccctcctgagcggccagcggccagctcggcgacctcgaggtggtgggcagcagtgggcttggtggcagtgatggtgactatggtgccatgacaggccgatccgccaccgcctgccccgtgacggaagtatccgccgtcgccggccgtgtgacgggtgccaaatccgcaccaccatcgggctgcgaaggggaaatggaggtgtgtggagggcggccttggcgacaacaacgagggcggacaatggcgatggcgacgatgacgagtggtggcggactgcggtctgcagcgatgacattgccagcagatgggtcctagctagggtttcaagtcttgattttttttttggatttttattattgcgtgcggatgatataagcacccacacatgattttcacacacgggtgcaccaactgcatggaaaagtagcaattttcgtaaacacttctgggcagacgtgcagctcaaccccacgcaaaataggttttgatagtacagaaaaatgcttgttttaagtagtgagacacttaagttgtcctagtacatggagtacgatatgttgttttgagttaatggattacgcgtatatcaagatttatgagttgataatttatcaagatttatgaagatttttgagttgatatacttcagtattacttgataatttgttctaagctatctttgaatacataacatataattcatcctataaacaattatccataatatgcccaaacaattactggtttactagctcaagggtaatgtcacgccccgaaccagtcccgaccggaactagcccgtgacgttccaaattaacctgttaatcgataccagtcccaggaaacagtgctggtatcacagggagacagaatatcacagcaacagaggtctctttattatagagtagaggtacagtcatgttgggctgcggacagatcccgagctcacaactgcattacaaaaggggaagcggaagccaagactgggaccaaacatcacaggcgcgacttgggaactaggccgaaaccctaaaactcatcgtagccggcttgctcctggaagaactcctcatgagctggatccgcttcatcttcttcagcaactggggggagattatttatatagagcaagggtgagtacgggggtactcagcaagccagggaaaataagtgtttaatgcaggctttaaggagaggctggtgtttttgcaattgattttatttgaaaccttttctgaaacaactaagtgagtgcttctcaaacgacacggatgagacagtgcgtctcgtccggtcggagtatgtgcaatgtatcagtctttagattttgaaacaaggttggcacccggccaacagcttttcaaacggccacccgggccaacaacttttcaaacggccacccgggccagcaactttcaaacggccacccgggccaacaactttcaaacatcgaaccccttttcacaacagccatatcacaagcagtagacaaacaaaactacgctaggaatcacctcacatccgcccatgaccgtgggcacggctgttcgaacagtttgttaacctctgcagagggggtacactttacccacacgacattactaacccggatcacccagcccgaggggatcagccacgtcgggagacctccaggctttcatgacaaggcattttcaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcaggaaaccgtacacccagtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggcgcaactggatggttacaaggggacatggtgtagtaattaacaaaggaaggatcaaatgcaacaaattaggtaggtctgccagtctgccttgcagacgggacaacaggtttagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatcttgagatttgaggaattttggaagttgaacggagtcaaacggacttacggttgggaagatattgaatttctaagattattggatttttggtctaaaggaaaaatgatttaactaaatcctttttggaaaagaaaaagaaaagaaaatgaaagagggagggattatagacttttcctcgggcgactagggcgcggcccaagggaaaaggagcggaccggccgagctaaatgggccggccggcccaaggcggcccaagtgcgcgcgcgcgggaggggaggagagagagggccggtggaccgggctcactgtgcgcggtcccgggtgggacccgcttgtcaacggctcggctcaccgtgcggagggagcacgtggcgcacgcgcgcgggcgggcgcgcgcgggcggcgggcccatacgcagcctcacggctcgaggtggaacgcgcgcacgggaggggctgaccggggtcggcccgtcccgacctcggctgagctggcgccgacgtggcgcctacgtggctgccacgcgggccggcgggaggtagatgacgacgccggccggaacggacggcggacaacagcggcgagcggcggagcgaaccacggcgataccggcgaaagcgagcacaccgggtggttgcacgagacgaggggagacgagccaatggctcggattcgccggaggaagcttgacgtcggcgaatcgcggcggcggcaaccggcggggagggaagagggaaacggcgatgaggtcacgaggggccgattcccggcggtgagagcatctacgcggtttcgggaactcgatgctagcgtcggattgggcggagctacgccgagtgaggctggcgacgagcgggtgctacggagctcgagcggcgacggcggcgagcacacggcgagcgacggcaacggccggggcggcgccagctagctatggggaggctactcgtgctactaccgaaaactaagggggagagatggagcgaggaggaagaacggagggagcactaccgcgaagaggaggggcgctgtgacgagaggccgacggcgcgggagtaatctctccagcctcgggccgaggaagaggaaggagagggcgcggccgaagtccccttccgcgtcctagtgcgcaccggctcctccggcacacacgcgacggctgcgatcggcgagagggacggcaatggcgcgggcgagaaacagagaagattgggaggggaaaaagggaagggcgggcgcctgggtttataggggcggcaatgtcggtttggaaaccgactttggcggtcaaaggagagggtagcgctcggcggtcgcggccaaagcggtgacagggaggagggaggaggatgacgctggcgggagggaaaaaggggaaaagagggagagaaaagggggcttgtccccttgcctcttcgggaaaagaaggagggagcgggggcgttgcggcagagggaggaggggttctctgcctccgtcccttggaggctagcgcgggagtggcggggccgaggcgatgacgacggcgatgacggcgggcggtttggagcggcgcgacgacatgggcgacaggcgtgggctggcgcggcagagggtgacggcggcggcgaccaggcg

SEQ ID NO: 5231 - DNA, 27765 bp, Oryza sativa
agaggcccgggagagaggagaagatgggccgagagaaattcggcccatcgaccccgggggaggcaaaataaacttttacagaggaatttgatttggagggatttggattcggaattgaactcgatgatagatcggggatttgagatcttgagatggcacggacactagacaagaagcgaagaaacaaatttcgcaattagggtttttaagagatagttttcccgctaggcgccacgacggaacgggcgctacagaccaaccccctaacaagaatctcgaccccgagattcagcacctaagggagcagctccgggaactctgcgcggagaagatcttctcgctcccaggttgcctcatcttcagaatggttgctccattggactttgtagaacttgatggtcttccttcgagtctgacgttctgcctcttcaagaaccttgatcggtctttccttgtaggtcaaattcttttccagctcgatattacccaggggaacttgctgttctggaactcgaagacatttctttaactgggatacgtggaacacgttgtgcacatctgcgagactttccggtaactcaagctgataagccacttcgccacgtctggcggttatgaggtaggggccgatgtagcggggtgctaacttgccggacatcccaaacctcctcataccacggaggggtaatacccgcaggtatacatgatctcctttttcgaactcaaggtcacgcctccgattgtcagcgtaatttttctgacggttctgcgctgtctttaatcgttctcggatcagcttaacttgttcttctgctgacttgagtatgtcaggaccgaatatcagcgcttcgcccacctcattccagcacaagggagtgcggcactttctttcgaacattgcctcattcggcgacatctgaatgctggcctgataactgttgttgtatgagaactcagcatacggcaaacaacgatcccaagtgccttcgaaatccagggcacatgcacgtagcatgtcttctaggatttggtttaccctttctgtctgaccatcggtctgcggatggtaggccgtactaaaatttagatcggttccgaaggcttcatgcaactgtttccagaaccttgaggtgaactgagtgcctcggtctaacacaatcttcttgggacagccaaatctacatacgacatgggtcatgtagagttctgctagtttcttcccatcaaaggtggttttcactggcatgaaatgagctgatttcgtgagtcggtccacgattacccagatggagtcgtacccgctaggggttcttggcaaaccggtgatgaaatccattccgatttcttcccatttccactcgggaattggtaggggctgtagcagaccagctggcctctggtgctctgtcttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaactccttcttggccggtacacagatgcgtggaccgcaccaaactgtgccttgatcgtctatggagaaattggtgtctttcttctcctgtattctttttattaactcttttatcccttcgtcgtccttctgagcctcccggatttgcgactctagggtaggctgtactgtcaagctggcagggacgcctgactataccacggtcagccttaacttctccagttttcccgctaggtgccacgacggaacgggcgctacaggtaatcagtaactctagagaacatcaaccaaacaaaaaagtttattgatcttttcgtactcaattgatgtgaagatacgtcgtgtccttaataaattataacataatgtgtaggatcgaattacaagaattaagctactagaggaggtgaatggtaggatatcatcaaaaaccgaaaatgtttaaggaaattgaaagttactctcaaacctgatgaagttgtgctggttgcaagatcaatgtcagtaagaccatatagaagcctatggtcaaaccagagtgttgtcgacggatacaacgccttgctcctacatgcctgttgcgcactgccgccgctgatctgaccacttgcctaacgccggttagaccactggctggttataccgctcgcgtaatgccggtctgactgttgggatctagagaaacaccaaacaacaaaaagcctcgaagtaaaccctaaatttctctgccaaaaagttgatatcttctagccgcaactcccatacttgcttccaatatggcttatttatgatcaatcaaacaccattcataatctggaagagatttaacaaaaacagattgcatcgtgattgatttcctgagcacgatgtcttacaaaactgcttttatatgctcaggttatgtgctatcaccgaggcctgatgcatgcttcaaggttgtatctcctagcgatggaagatgtgactgaattttccttgccataaatgtggccttcttaattacattttctacagctttgctaccatgattaatattacatatgaacctgggattgtatttggaatgtgtctagatttggctgttacctggttgtaagatttgtgttatattggatgtttgtcgggttgtgctatatgggttgttattgtgtttgattgttgggcttatatgggcttagcccacttgttatttgatattaatataaatgaatataatatgacgggctgaaaatggtgtggtacatgtttgggcctatatgggcttttacaatggacttgacccatttattatttgatattaaagcaaattgatacaatagaattgggctgaaaatatgctacaacatagatgggccaggctaaactttagtcgggcttgccattgggctaagcctataaatagggtgctcaatacatggattttaatgggccatcagatattttatgacgttttttagctagataatgacgaatatgagagtcacaaagttatgacgacagaatgatcgtcactagattaatgaggaaaaataaggtttcatcgttgaacgccattagagacgcataataagtgacgaatgaattttcgtcacgcgagcgtcacagattacgaaacgtgacgaaaaatttaatgtttacgacgtaaatgaagcatcatctatcataagatctcttgtagtgataccatagtgaaaaatcatatagccctttattgcaaaattttggtggcataatctacagctaccgtgagatatgctagaagggattaaatgtcttttaagcagtatggcggcagcaacatgcgcttcttcaacatagaaaaaccaccaagttcgtcttggttgttcattcagtgcttgaactctgcttgcacttatgagattaaaaaaaatgctgtggtacttaatttattgttcctcaggaaatggaaaattttcaccaagttaattccgagccgctccacgctcgaatttaacttggtgaggggacattttgttcgatgatattttgtacaccttttctctaattttaattttgttagaaatagggtgcatcaaaatattaatctcgggaacaacagtataataataaattagtgattaattatcactaatggtacaatctagcatacacgagcgtatatgtatgaatgttatgtgacacgtgccaatatctgctccagtgcctagaatacagacgtgtatatgctcatggtattgcttgaatttttctttttattaatctaaatggaagcatgccaccgagcatcgtcattagagaggatgctaatcacgtgatttgccggcagtggatcgcttggattgcttgcatggaaaaccatgtgcgtgcttgcatagaaactcaagaaatataaaggcaatgtagctctgtctagagaatcccttgccatatgcagtgtgtacgcgtatacgaatacaaggaattaatcgctctgcatcacgccggttcggaaagtggatcgtcccggtataatttggatggaatcatattgagtatgatcctcgctaattggaagaaatcataacatatggaaggaattgcaaatcgtagaatcaactgattggcttgccatccatatgtgagccatgcatgcactgggcagtgaactgcattcccttcacgctataacagaaccagccatttcacagagcaagggggacgggggagactcacgagagaaagaggaagagaggaggacacccacagcaacacacacaatgcacgcagcacatgctctgcagccatattgctgagagcaaatccatatacagagaagaaggtgaacatcgtcatcggcagcacatggcagtggtgctattacttgccatgggtaatgctatatgtttctttgtctcttgttttctctgtttcagttagcaggcaagcaagggcgatggattcatcggtgatgatgaggatcggtggtccgttgggagacatccatggcatcactgtcgccggtcatcacacccgcacggtcaaggcgtcttcactcctgccgtcaccaccggtgatgtgctcgcgcatcgtcgacctcctgtgttcacttcatggctgacactgatgatgagcttgaccccgtcatcgtcgccggcgccaaccgtgcgttcaccgacaacggtcgcaagcttgcagtcggcgctggtgtcatcatcaatcatcatcgtttatcctcacggctgccaccgatggcgaatctgatcctggtcatcgttgtcggcgccgaccgtctctccactgccgacacgctcaagcttggagctgtcatcggtgttgtcatcaaccatcggcgtctatcctcccggctgccaccaatggcgaacctgtccctggtcatcgtcctggcgccagtcgtttctctgccgatgacaagctcggccttgtcatcgttgccagtgccaatcgcgcattcgtcgtcaacgtgcaagtttggatccgccgactgttgtcaccaacgtgcttggcgtcttcgctggctaatgacgacctcgcgtccgtcgtcactaccggagtcatcctcacgtcaacgacgatggcgtcacgctcgccaacctcatctgttcgatgacgaaaccgttatatatgtatgccctgccaccgttcgtctactgccggcgaagtcctccgattcgttgctgccgccggcgtcatcctcacatgaatcctcacctcaccgtctagtgatcacgagctcggcatccccaccggtgcctgtcactccgcagcgcccatacacatgacggcttcttcgtgcccgccatcggcgcactcccgagtcaagccactacgatcggaggtggctcaacatcatttgagttcggccccgattgtcggcgcatatacaagaggaccacccagttcctggaacgcgtatcatcgttcccaggctaggctacgcccctaacatcccctaaaaccactcaatactaaatatgtgctgtagcgatcagaagtgactcctgtaccatgacgatggtcggccaatgccgtgcagactagaagggcgattctaccccatcaccagtgaccacaagcttggcatctctaccgacgaggctgtggaccgttgtcggcgcccacacacatctacaccaccatcaccgtcatgcatgggagaacgtgaagcgaagaccgatgacaacgaccagcgtagcttaatgagaggtttctcaggagtttaactcatgagagtaattaatcgggtgttttccgagaccccaggaaccaggagaacacaatcgccaattcagatccaccttgcctacaggccatggagcgcatttgatcaaggattttgtatttttgtaattctttgagaattataataaatgcattttccttcatctattttatttgtgtacttagtacactggcacgcccgcgcatcttattttattttatttccctaggcagagggacggaaaatttaatttttctctccaaacattcatgaacttatattttaagttatacagtttcgactcattggtgcaacaaaagtaaaatacctgcggaaacattttgctcttatctatggaacacataattttaattatccgagtatatgtttttctttttatcaaaatataaccaaatatcaatagtagaaaaatattttttcatggtgtcgcactataattttcactggtggttatatgctaaaaccgccagtaaaaacatcaagaggggtgggggttataggaccgccagcgaaaacctatttttcctggcggccatgttaagacgtccaccataaaaaatactctatttttcgaggcggacctcttaaatgtccgccagcgaaaaccaatattttttattggcggttactaaacagttccgccagcgaaaaaaacagttccacctgcgaaaaaacagagcccgctaaaaaaaatcgacgtcatttaaaatcacgcgcgctgagatattcccttcaaccacccactgcctctgtctcctctatctcctctccacccacccacctccctctccacccacccactgcctctctctctcctctatctcctctccacccacccacctccctctcctcctcctcccccactgagacccctcctcttccctgtgcggctgcgcccccagcctcctactcctaggacgggcgcggcgctgacgacggcgaccacgacggcgggaggggcgcggcgcggatgtgcacggcgacgacggcaactggcgacggtgacgacggtgagcacgacggaagcggcgacgacggcgaccatgaaggaagctgcgacgacggcaaccacgaaggaagcggtgacgacggcgaccacgaccatcctgtgcgtgctgtccttcactgactcgctatcgtacctcgggttccatgtcaggagcgtcgacaagaggcagatcagccgtaactacctctactggggcgccgcgccctcccatcccatcctctcccctctcccagatttgtctgtggggaggaggatgggcaatgggaggacggatccgccccggcggtggcgcgggtagcacggccgcggggcctcgggaggtggagcgcgaccgtcggccttgacctcgtcacgaccgacgccgccgggccgtgggcggtggtgctcagatttcaatggatttctgtggatttgtgtgcatttgtgtagatttatgtggcttgtgaatggaaaatatgtgttgatttgtgtggatttgttttgattgtgaatggaaaattttgactgtttttattgtaaattgttggtgtaaatttatgtgaatttgtgaatcaaggagtggatttaggaataatttgaattggtgttgacagaggtgaatggagcggtgttgctccgttatttttttttatcttgtgctactattttcacaggcggctggtataacacaaccgccagcgaaaatcaattttcactggcagctgataaccgctagcgaagattttgatcttcactggcctttactttgtggcggttgcaaaaaccgccagcgaaaacctaaaatagccgccacgaaaaatggttttcgtagtagtgtatggtcttgttgtgaagacataattctaacaagtacaataatgtaattagattataaatccgataggtaacttttaatgaaaaataattttaagttgttgtatctgaaaagttattagaaggtggtagtacataatggattcgtcacatacagggcaaagcatggaaactgttttaaacactcaggtggacgttcacccttttttgcatgccatataaatggttatgaaaaattttcaaaaaaaattgagatgacaggttaatatgtaatatatcacttcataaacatgcaagatcaaattcgacttctatatgttgtaacaaaaattacaaatttgactgtgaatatacatataccagttagagtttttttttgttacaatttgtagaagtcgaatttgaacttgcatgtttatgaagtgatatattacatactaatctatcttgcaaatttgtttggaattttttcataatcatttaagtgacatataaaaaatgggttggacgtacaccctgagagattagaatccatcttcggcacagcatgcatagtaacagaagcatgtgccgcagggtgaagggcaccccattttcccgtagctatttatgttatgctgtcacgtaacgtaagaaacgaataggatcccaacaactacgagaggaactcaaagtggacgtttttccttttctgttttgtcccaagttgggcctggcccccaaggttggatcccaaaaccggaaggactttatcttgggcctaccggtaccagaaacgagtccgagtccgactagatgaatgctagggttcgctgagcccctagtaataaataaagaacagaaatcagaaatcacaacgaacgaaccgtctgtgtgaggaaggcatcgagaaaaccagcgacaagaagaagaagaagaagaaatcctcccgtcgagcgccgagatggccggcgagaaggtccagatgccaacggaggcggcggcaccttccctgtctccggcgccggtcgaggggaagccgagggaagccgccgttggtgagaagaggaaggccacggaagagccggctccggcggagagcgacttattatccgatgcttctgaatcagcggcggcggcggcgaccattgctgacgatgggggcaagccagcttctgaagcggcggttgctgaagatgagctgccgtacgacgagtggaaaatacagcgcagagcgcttctggatcggctgtgggaggagaccatgtctaaggtcaagcttccagatgatcccaatctctactacgactactccgatgatcccgatggtctcctcctagattatgattctgaaactgacattgagatggactaatgtatctatctaactcggtttatgtccacatttatcttggcctagctatagtggagaactagttaatttaattagctcttctatgttatctggtctaaccatatctgaggctctaagcactgcacttatccttttgattgcattccaatataaaaaagttctatcttttatgtgtatatactattagtactgtactccatcaaagattactctagcactgtactccttaactatccgagctatttgtatatgtccttgtttatccatgttttctgcaattttgattttgggagcatatggaatctcctgtctcgcccatcaaagaggaggtagctgctctgagttctaaccgacatgcagaatgccaagttatccttgagactctcagtttaggattcactttgtcgatctgtctatacatctctgtacgcatttatgggagtggatcctaatccctcgaggggatatcccctcgtatacctttttctttcaaattcgatgcaaatagttgtgaaaaattctgaaaaaaatatacaatatagagtataatgatacctacaagtccaccaaaattcatgtttaaattcgatctacacatcgagaaacaaaaaagacaaatttagatataaacagtacgctactattcatacgctgaatttgtcttttttatatctcgacgtgtgagttgagtttggacttaagattttgtggagttgcatatatgtgttgtatggatgttgtcaaatttctccagaatttttcataactgtttagatgttctttaagcaaacgagggaacatcccctcgagggattagaatagtttccccgcatttatctatctttgtaagcagttatggcttggtgttggttggtcaatgatatgatctttgttttcatccatccatatctatatggcgccatgatctgtgttgctaattgctacgaattaagtttggaagcgatgaagagcatgattggtactgacgaactagtaagtgtgcagtaatttgacatcataaatcattgcactcttctttcattgaaaatttcatgtgtatgtttagcttttatttgttttcataaggttttatatttgtcatggcaattcctggttgcctgattagattggatggttcttgactactgccaatccaaaatatccacttggcatctgtgaagctctattcacttaaacaatgtgtttttcgttgttcctgtctcttgctgtttattgatgatttttttgaaaaattttgtccatgattcgtttgagatcattgttttttatttgtgagtaccagatcatatgggttctgtcaaacaggctcattgaaatgggcagtacatgataccaggcagcagaatgcttttcatcttgaaatactaagtttatagggttttatttttcttagtttctatagtgtgataattgtacggatctgtctttgtatcccttattaccctttacaatctgatgtatgcatcatttttcctgtatataatgctgtaaacataagtttttgtgtgttgagagcttacagttgctttgtcctttccgatgctgtttcagagcttgtaattggcttttttttggtaacctgatgcaagggttctgcaaagcagagtaacacatgctgtattgaccttgtatgcagttgtgagcaagatatactattgcactattttacaaggtttgctttctcctctactttcttcagctacctttctgcttctttaatttcctaaatttgaataatgcattgacatggcttcagagatgtatgtgcctttctaagctgttttgattgctcatcctgatgcagagtttcatgttcaggttgctgtctgtttgtctttatatgatttagaacttcagaacaaaaaaaaaaaaacaatctgttggcattgttgttcctcttgaaattgtcacgtctgtaccatcactttaattatttgaatccttcttgaccagccggttccatttttcactgaaaaattgacagggtttgaagtgtgtcttgatcatgtctctgaaggtaagaaacccccctgaagtacttgttgttctccaggcaggacattttcttgacagtttggatacttacccggagcagcatacccggtgcagccttgttttgcaatggatttctgccttcccaaacttttggaagatatctacgaggctctgttactctccaaacagacaatgagacaattgcaccagaaattgttgtgtttattgtcagatcctaaacctggagtgtggctgctatcatgttgtgctgattcttcatatattatatactccatccattctaaaatatagcaatatccagacaaatagttacaagttactatattaatactattggagtatgtgcctagaaacatagttacgagttgctatattttgggacataggtagtactttcttcacaacgtaagcattcgtaaatatttggtcctaccatgtcagagcttttgttgttttcgcaccaggaaatctcctagatatataggcctgttcagattgtagccaaaattttggcaagttggcaatattgttaaaattttagcatgatttcttttgtatttaccaaagtttggcaacaaactaaacgtagacactttttttataactatgataaaattggtatcgctaaaaatggcatcaatctgaatagttcctatattggatctctttcactgaataaacgtgattacaattatgatgatgatgaacatgtgaaagctgaaataaatgctgctccaaccctttggtaggtactctattaagataaaacgatttcgacgcagaagataccctactaagagcagaggggtaccctactgtagagatcagtgaccactgttctccgaccaggcccaaaccagtcaaaggtgagggtttactgtcgtcagaggtgacctgatctggtgtagcgaatgtttctctgcacaaaatattatgggggtatgtggatatgatcgtgcagcatatctgtaatcttgtgcctgtttctaggtgtgactccccccctctgtcagtttgtagatgggttccacaaccgataggtaccgtatcgatcaatacagatgctgcaatattccggtcagagaccagaacttcatctgtttatttgcatgcaatgagcttgtctcagggatcagtgccagaagttgctgaggcagtggcagtgcgccaaaccctgttcttagcaaaggaagaaggattccacaggatcatcctagattcagatcgcctttctgtcatccaacgaatcacgttggttgtgtgcaactgctcgagggtaggctgtataatcgatgatatcaagaaagatccaggccgaattcctgctctctttcattcatgtgaatcggtttgctaatgttgcagaacatattttagcccgtcagtctgtgctaagtccatgttcttctaatcgcagtgtaaccctggagtgcatctaggatactctatgcattgatgttaattaattagtcagtgaagtgctgcgattaactcaaaaaatatgactgaatcaaaatttcattcagctttgatggactgctctgactgaatcgacactagaggtgcccgaactcaagaaacatgtccttttcatctagtgccgacgatcgacccactacccacccactacctactgtacagcagtacatgtctctatttagacaccttctactctcatgtgtatatccattcatctacaagattcctttgaaacacttctccccttctaaccccccaaactatttctcttctttaggaaaacaaaacaagtacacaatcacaaattagaactggaaatgagcgacatcaggagtggaagtcttaggttgatgtacagggagagttgatatcagtttgcagtatctttaccaaggtctggtactgcccaagatggttttagatgttgcctcctgatcatgtacagcggaaacaaaacacaatcagagtgtggagtgtgcttgcaggatatgccgcgcgcgttacattttgagaatctgcgagtgagcggctgtcctggtatgctgattcagttcagtgcatggttgtagtctcggaagttactacttatcttgcctgagttaaaaggagaatatgtatggtggttgatagtctttttttttttcgttttgcaaaatcaatccgtcagatcctttcatcctatatcgatcattcttttgtaatatttaaatcgctaccatttgtagtgatccatctttagtgacattttatggtcagatgatagttgatggttcagcgcattcaaatgagaagtccatagacagtagggagtctaaggaacatacaaatttgcaacggtacatgagtatatatgattgtgacaaagatagttacaggtgtacatgagaagtctaaggaacaaagatagttacaggtgtacagcttgcttagttgttacccaaatattttgaagcatcggatatgattgtgaaacggttcttctccccttaactaacatcacatttttgtaaataacctgccggtataagctcattaattaatttctggtttccaattcctcctggtttttatagagtattgcgctatgggtcaaagaacatggtgagtggatcgatcccttcaaagtttttatcaaagagtgcagtgcaatagactagcccatgtgtttttatcaaagagagttgcatgtgggatctaattcatagtacaccagtggtccacccaagtagtgcggcacatcagtacaacacaattgcaaaaaacaaaacagaccagtcaatagaactatagtcaagtgtggctaaactttatgtcgttttctagtaaaagaaacatcataaatcgatgatgtcatcaacaaagctcatcaaatgtaattactctccatgcccgacacagatggggttgccgcccaattgagatgtgggtgcccgttgtagtgcaatattcaaaatttcttaggatcccccaatacatgccccttgggttctatttataggcttagtacttagctcatgtaccctagggttactaaatacaaaggaatttatatgactactcttatgataaagacatttatgagggtaattgtaacaattcacccaacgcttcatcttgggccaccaggtgggcctccattggtcggttggtcacttcggtccctcagccctttttggtctggggcaaaggtcctcggctagggggcaaacatccttggcttcccctagccattcgtgctgagcgttcgtctttgtgacaatcggcactttgccaccatgctttgccctggcggttgtgaactagtttcggcaagctcggtcgaaggtcctcgtgacatacctccaacagtagtgatcccattcaattcctgaacaaagtactaagtagttttagttgtagtagtagcacaaattgtaggtatgtgcaagggttggagtaatttgagtactggtgtagtcatgtttacttacttgcaccacagtacacgttttcagttatagtgaatctttactgctgtctcctcttgctgttccacaacactgttgcccatgaccgtgtcctttatcatcctgtctacgttggttcgtctcatttgaacattgagatgatcggggagatgattgtttgcaatggcattcttcgcagcaacctctgtagcctccacttgttctgccctcgcctccctacagtctacctcaatgacaagattcttgaggcaagccatgttctggaggccttcatagaagttgctgtctagagatcctagtgttcgtgcccacacgttgaaccgaaacttttcgagctttggcatagccccaacctcaaacaataaaggacctaagacatcttgccatgaatggaagtcaaattctttcagacattggaacccattgctgccgaagactagcctttcagatacaattgtttttgtcgtaattgaaagagataagagagaaggcaagtccccaaggatccgaagaacatccttccccacagaagtaacattgatgtccaggaatgcgacgttaaaaagcgtggccatccactctggaattatggggaaacagtagtaagtgatcatctgaaaattgtaaagcgggtaaggagggtgagaccaagaatccagcatgaaatccagagatgaatcatcacatccaagttgtaggtaccgaagcttgaatgtacacagctcgtcgatgcaagaaacaaagctatctgtgtatgttttcttgtcagggtatgcatcactaacacaccatattatatacagacatctcaggtcattcagaccacccagttcacgcaaacaatccactgggatgctgatatcaactttcacccctataagtttctgcaaagctctcatatttccaattccttctggtagagttatgccatcagcaaccaaaaacactaaatttttcagccgaactatgctcttgggtaattcttttatgcgggtacgttggagctctagtgtctgaagttcttgtagctcgcctatttcttcaggaagctcacttatgcctacttctctcagcctcaagcattttaactgaaataatctccctatatccctgagataacaatttttcagtttatcattgctttctatggcaattgtgcgcagaacatggaaggctgaaataagtggaatgtgttcggtggacccatacacaacaagtgatcgagcactcgaaagaaccatggttgctggaagtatagcatctcgctctcggcagtcgagggaaagtcgacgaattaccttgtcttgacatcccaataaataattatgagaaaatgaagtgatgaaattttcaacaactgatttagatataataagatctagaatcatatcatgcattcggcaagcatgagcttgcccgtcgtattggatttcgtccggttgtatcatgctcctattgattagttcattaaaatagcactctccgacttcctctaaagttcgtccaccttcaccttgtgcagtgacgaacccttcggctatccatcttcttaccaatggatcccataatatcagcacatcctctggaaatgtacttagatatagcaagcatgtcttcaaatagtggggcaggtcattataactaagagatagaatcctctgcatgttgcttacactgggaacgttctcagttgctgagcaaacagaatttctgtacctcccccattgttcttttgtgcgtggtttggtagccaataagctagctagagaaataattgccaatggtaaaccaccacatcttctcaagatgtcaatatatatgtctttcaaataagcaggacattgatcttcagagccaaaaatccttttgatgaacaatttttcagcataaacatcactcaggggtttcatttcataaatatttttgcagtcagccgagcaacatgtttcagctacagaaatgatacgtgttgtacacaatattttactgccacggtaattttcacagaaagcgcatctgattgttgtccaaactgttgtgctccagatatcatcaattacgacaaagtacctatataattaacaaatgataatcccacacataggcacatatacatgcgtgagacatgcgaaaattagtaattcatccggtcataattaaaatatgcctttttagagttggcgtagtaaaactaggctaacttttatttcgatgtatgaaagcatagccaaatttaatttgttattattaactaaaactttcgtaattgtgtacctgcgtaactattgtttggatattttacgaaaaataattaagcggtcataattatgtgttattaactttgaaatgcttaaataatagtattcttttttgtctggaggattaattactagtaaaccaccaaaaaaatgcacctataaaccttattattttatttaggcacgaagaggaattggagaaacaagagagaagtaattttgagtgaaatgtcatggttcgttatccattaattaatatcttcgaaaaagtacagggagtagttagtcggtgcattaacatgcaaatgttgaaaagagagctagatagttacatgtagagaaatgagaaaaaaaggttatttaccctttatacaagcctttagaatactagtgattcagggtagtagctcatggtcgacgtaacttttttgcctcgttgtgtcacaagttgagttagttgtatatgagctatatagtcgagtaaaatgaaattagttaattggataaatcatccatagtgaatggcaccactagaatagatttttacacgtgggcaaaacaggttttcatataattatatgcggctagctggctagccagcttatgattaggggatatgaaaaaggaaattttcactcgctagctggcgatcccacatgtgaaaatccattttcacaagtaggcgtattaggatggtcttatgtaagaacaattttcgcatacgaccgcactggtaggagaaacagatcaagatatttttataaacgagtcaccccttgatagtttttgcggccaaggtctatcccggtgtttagggatagggtcctggctgcctgtttggtatgagaggtatgagagggatggcatggttttgttctttttttcctatgttctactattagaaatatatgttcttgtcaggggcggatctacgggccggcaaacccaggcagccactcgggctggtcggtggttaatccattaaaatttcatgtaattagaaaattagaaatagaatttatgtagtaaatattagctatagtgaagtttgcccgagctccaaaatatttctagatgtgctactggttcttgcagtaacaaaatgctcatgggtgaagaaactcattcatctaagcgttttaggctattttctctttgaaaataatttgcaatgaccacctaatattttgaggaggcggttgtacatgtacattgataagagtaggggtaatgaaataaataattatcgattagggtaatagtacgaagttaaaaatagaagtgcgtaccttttatcgttgagaaattctctgagtttattgatgagccgctcctcatcccatgcatctatagctccgtaatcgagctctgttatattgatcagtatatttttgaatattttccttatgtcgggtttttgagaaactgatacaaatgcttggcaatcaaactgcccactaatttttccataaacttgacgggcaagagttgtctttcctagtccaccaattccaacaatagacaccacctgcagtttttgcagcaatttatcatccccttcggtcaaaaacctgatgagctctactcttggtgtatcaatgcccactaggttttcttcttctacatagagtgctggtaatcgaggatcgatcggcaccacaccaattgaacttgacaaggtctcatcaaagttgtacctcttgcgacgttcactcgccatgtcaacacgagcctttaactttattatttgatcagccatcttgtcgcgtgctcgaagcatccgcagttgtcgaatgctcttctgcaagaaacctttcatgctttcacgcctgtgggcatcaccatctacctggaacatgaaataatcaattctatcctcaatatcatacgacaactcccggatctggtccctccactccttcacttggatatcgaggtcatcgatgtcctctagcttcaggagtagagcgttcatactacttagctcatccttcagggagaggatctcactatctactcccttcagcctgttgtacttcatctgcaatagagtagagagtttcccaatcacagggcacaggacccctgtggcaacgctcaccatggtgtgtgccatggctgaagcgtgctgaaaaattaaccgctacaacttcttgcagatgctacaaaggattaggaactaaatataagctagagcagaagtattgtgtacacagagatgactatatatgcaatctggccgagggtaagctgagtggtgggctctatattaattaagcctgatgactgtccgatagttacaatgtactccctccgtccttaggattttgacattttgcttgcactgtttgaccattcgtcttattaaaaaaaattagaattattatttattttatttgtgacttactttattatccaaaatagtttaagcataactttttgttttttatatttacacaattttttttttgcataagacgaatggtcaaacagtataagtaaaatgtcaaaatccttatattaatggacggaaggaagtagaaagccgatacacatttagtactagtactgttattgggttgcaagttggatataattagcttcaagtttacacaataagagatttcaaggtaattattgtacggtatcccattaattcaaaccaaataatagcagacaagtaccagatctggtaccctattggtactagttgatacccatcgatactggatctactatccatcggtaccacgtgagacccctcgatacaagccgatacctattgtatattgttgatggtcgttatgtagcaatttcaactgtcaattagctcaacaaataaaagaggctagcatttcttacacacatattacttacaaataatgtagttccacttattcttcgataatacattgaatgcatggattatacaataaagtgaagtagaaaatatgatggcatgcaaaaaatcacaactccgaggaatcacgtgaaagcatgtatggattgaagggctcacaagtcagaccaaaccaacttaattttgctcaatccaccgtgcaccgccataggggtccacatagcagcctttgggacaaagtcggtggagagaggggtggcatagaggttggctgaaccgttatcttcccccctcatatccaccttctacgtggatgtcattgattgcctcctaatgacggttgtgagcgttaaccgacattggcaaccgtcataagcagctactagtttatacctcacgctttgcggcgggatgtgtggatgaatgcatattatacattgtagaaatgatagatatatatatttaaataatgtgaaaaagatatggagataatgatttaacattgcttgtatgacctgtaaaaatataacaaaattctaaatgatatgttatgtttgcatgatattcaaaatactatagataattattgctggtggataatgatgtggtacacttgtatgtgatttaaaatattctaattaataattgttagtgggtgatgacgtggcacacttacatgatgagctttaggagttagtggacatcatctatacatatagtacagataaaggagggaaactctcacttcacaacactcaagaagcaataatagaatagattagtggagtttaggcttagaatagttcttatgtttactagtcttcttaaatattcaggtatgtatttgtaagactacgagctcaataatagaattatcttctttatttaattgtgctcagggattttatgctcggttgtcgatctatgctgcaacattggtccgatgatgttaacgggtcatactagttcttacttgtccatatgtagagtgcgagtcctgaggaaattagtgatattatttagcaatgtaagcatagtgcatagattgattaaatatcgttcgatgtgggtgtgccccacaaaaagtgagataggcggcaggtggtgacagccttgtccgtcctttgtattcctccacatttaggtatgatgtaagatttggtaaatgccataaccatactagcagaccaacaggggatggtctctcggtagtgtctgggtgcatagaactatgtcctagctatatatatgtatatgattgttgtattgactaaacatgataaatatagaagtacatatgaaaccatagctattcattttgtctttctccaatcgctagtttacttattgaggtggttcttctgtgtgtcacgctacctaactattgtcatgattatcatttacccatattagaccatagtatattaactatagcatgattttgaatatatcggcctattcttcatattgttgtcttccctacggaaaaacaaataatgatactaaaaaggtcacttaggcctagagggagggtgaataggctagtttaaaaacataggtaaatgtggaagcaatactttttgaatatatccgaaagtattttcggatattcccaataatcacagagcaaatgaaagtcaaagagaactggatctagctagtcacaagaaagatgagcaagcacaaacaacaactagactagaagcggcacaagcaagcaaatctagagaaaggagtcagagggatatcaccgatgttcttgcaatatgaggtgttcctgaagttcgaatcctgaagggtattctagtctatgttgaggagctcacaaagagtcggatcttcgccaaccctttcctcaagaggttgcacaaagcactcattttttcactagtggtatctcttccctttccgaggtgagattcaactttcacaaacttctccccgccaaccacaagtagatcagtggcttaagaccgatgcctagccctctaggaggcctcaacccctaagagtaaaagtagaagcaagattctcttggggacgaatcaagtcctcagacaaatcttcatgaagtcaacaccaagcacgcacgcaaactcaaatccaacactctctcacacaaatgaaatctaaacatgaagatcggtggagaggaagaagcaaggctgaaagtagatctcaaagagttgcaagctgttggtatttcttgtggtcgccggaaaatccgcaagcgcacggataccgcagtagcatttcacccaagagaattcaaagggtatcgtatttatatttccgtagggaagcggtggtgtaaaggtagagttcatatatccttaatcaagctatatgagtagtgtgacgcacaagagattcatctctaataaagatacactaagcaggggagaaggactaaagagagctaaggttcatatgtacttccatactagtaatgtctagtatacacttaacacatacgtgtttacaaggctaggattttgttcccaggtacctaggtacatatgtgtttacaaggctaggattttgttcctaggtacccaggtacatacgtgttcacaaggctaggatttaattttccgtcatagccggatgtgaagaaatataaaggatggacatggctgtcaccacctgccacccccctcactttccgtgggtcatactcacatctaacaacatttaactaacctaagaaccatgcttatgttaataactaatgttactaattcccaggagactcccaactgtttcgccgaatcatcagtaccacctctctcaaccacatttcactgaggactgatatgtgggcccctaaggcggtgcccggtgatttagtcccactttaggtcggttcaagctaacttttgggcccatcaatccgtctgctcacacgtgaatcgcttgaggtgtgtttctttgggtgtcggctcatttctccttcactttagtttataatctctgcatacatagtatttatccaatacaagttgaactatattatttaattctaatatatgtgcaagaaatgttagttctccgtttgtttattatggcagttcacgatcgaaattggtacttaacgaccatcaccaacaccaccaagctaaacctttgctcatcctcgagtaaaggtaaaacttaggttgttcattaggagttgctactatgttttattccacaatagcactatgcctacaacatatcgttttacctagaatttgaataagttgacaatagtaattttacctctcttaccttactccccatggggcttttagcttatcctcgtcttaggtagttaagagatagaacggatcgtagagtatagatcacttactctttggtttactttatcagtaatgtcggaggaggttaacttttctcaggagaatgatatttgcgcttacatttggggaaatcttaagtactcttctcaaaagttttatgccccaaactttcaggccatgcaaccacctattcatttccattggttatggaagagaaaggccacctcgaaggttaaagtttgatggacaggttgaacacaaaatatatgttgaaccataaacattgcggcccccatgattgtgatatcagttgtgttctttgcccagctcaccccctttagaatctactgcatctctttttttaatgtccctttgcaaagtcatgctgagctgttctaggtatctcttgggacacatctttgagcttggacaacatgttggtgcactgaagaaactgttaccaaggccactgtttcatgtaaaaatttctttatggggattggaatatttggaggcaaaggaatggtttcatcttatgatcataaacccccttccttggcttcatggagacagctatttaagggtgatttccttgtgttgttgcttcgggtgaatgagaaagacaaagatgtagttcttaaatggatctctttgttgtaatttcccttttttatatactttttcttttctaataaaatccttttaacaacaggggctgtgttcctttatttattttctagtcgaagcacctattatttattttctttggaaattttcacatcagcgctccacagcctcttatgagcgtcagattggtgaaaagcactccggtgacaattagaatatgggagcaattgacttttggttgaacaagcttgggagaaaattctttcccacatgtgaaggtctcgggggctgctatggagattatggataccccatacacactcggcctgcttatccaatagattaggacttgggtgtagtgttgccttgtttgctacggcatggcctgtagtcctagttagatacaattaagtaatagttaaggaaattgatgtcgtattcggctaggtttttcctctttgtaactttgcctcctaacctatataaggtggcagagagcccctccaacgatataacacaacttgatcatcagatcaatacaatagccgacggatttaatccttaaaacaagagtagggtattacccctcgtcgagagggctgaacttatctaaatctttgtctcctttactgatccactttagatgtcgtgtactaccgtttttcctatttccgatctagaaaattgacaagtatccgtaaaatcacacggtgtttaactttgttgaggttcatggctaattgtccccctatgtatagtagtgctccctccatctcaaaaatactcaacttaggataacaaatctgaactaccctttgtcgagatttgtctagattcgttgtcggagaggatcacatcttgagttttttttacggagagagtacgtatagtagggggtgttttatatgcaagcaataattgaatggacttgtccatttaaatatcgatgtgacatatgtatgtaaagtcaagagagatgcgtaatcatctgaccaaaagcaaatactacatggttatatatatactttctccgttcataaatataaaccttttttcttacagatttagattgaaagggaaagacttcaatgtgtcccccattaaagagaatgaactaacttctaattggctgaattgacagaaatacttatttacacaaatattatcaaaattaaataatagtggttgggtttgtggaagtagtactgcagaaatattaatatttatgtacaaactttaaacgtcatacatgcttatatctgagggcacgcagaaaatatttaacatgtaatttcttggtgaaccccacgacctagtgtactgagcacaagctggctttgatcagaggcagcacctgtattgtactatagttctctgtcaaacttgcatcacggttatggaataatttgcacatagccgagaggattctgcctgatggagctcggcagttgggcaagcaaggtcgccgccaagtggaggaggctgacactgatgagagctgttgtggtggtacttgaccagatgtcgacgttgggggcgccgggcgataatcgggttggggaaaaggaagcgtggcaagggcgccattgcagatttgcagatataggtttgtaaagtcaagagagtgtaggatcgaatcataagaactaagctaaccagagggggggtgaatggttggcatacccaaaaaccaaaaaattttagcggaaataaaagttaccctcgaaatcgatggagatcggtctgaccgagattgatctgccggtctgaccgagtagatgccgccggtctgaccgcccgtacgctgccggttggaccgccgaaactcggtgaaacacaaatcgaataactcttaaagtggatgacgactttattacttctctctgtgtttacaaagtgcaccaacagcactccttacaaaaattttgactaaactcgaaaccctagctcaaaactcaactctattgctctctaaagcgataccgggaagcctcacgctcccccctctatttatacatgaggtaggcagcctaaagccacgaaccaaactcatactaggagtcctaaacaccttaggaaaccctctagtacaagaaagaaactttacataaccaaacgtaccaaatttggactccttccaaattcgaccccgcatcccatacgcacacaataactccatcgtatgccatatggaatctccatcaaccacgtgcatcaactctagcctaagtatcccgcatgatctctgaccaccacggacatcgtcttatccccaagccgactcccgatccatcacggcaaatactctcccgagacatcgagtcacctacacatggaacaaacaaagaaaccatattccgagaccaagctatctccaacttgactcattagcagcaaacaacagtattacatacgtatagtatccatctagaagtcataatcatgaaataaactcggatatccaaataaacaacccgaaaccgaaactgacacagtgtcggccggtcagaccgcgggccgcgccggtctgaccgcgcaatacacgccggtctgaccggccgcaccggcccggtctaaccggtccacataaattgataaacctgcgattcacctgtgaaatctccaatgcccaattgttcatcacagaataataatcaaaaacacctttgattttacaatctcccccttgatgaacacattggcaaattcataaaaagttttggtgtttggaaaaataaaaaacaaaagtggtaaaaagcacacttcgtacaaatgtacacatcgtgctcaaaaattcaaaagaaaacttctccccctttttaaaagaaagaaattcccaattgaaccaaaaacatgctcttctcaacaactctccaaaaattcatctcgcttctcccaaaaatccaaaaaatttcacattacttctcccccttttgacaatgatttcatcaagcataggaattatgttcattaatgtgaaagagcatagcatacatatagcatctcaagtcacgtgttgcaataaaaagaagatgaacccatctataacagaacaaccatgcattcaagtataaccatgaaccaaagattttacaattaagcttaaatcaacaatcaaaattcatgatttcatgtgatttataatgcaacatcttaacaagcacataggttgaagaataaacactaaacatatatacctattgcatttatcactctttctcaaataacctttagcacaaaataaccaagagaattttttaaccttttcttttcttgagcctttttgctcatatttttctcttttattccgggtacgtccctgtcgtcaagactgtttccagggattcggcacctattattttgctcacattgaatacgtccttgtcgtcaagactgtttccaaggattcggtattcattttttttatattttttattttctttttcacaatgagcaattaaatctatttgaggaataacaagtcaataaagcatatatatagagcatttatagatcaaaccatatgctagcatcaacattgcacattttcttaattcaagtataaaatttaagtgtcatgcatcatctcccttaaaagcaaaaattaaatctcatgaaaagactagaacacatacaagctatgctagagacaaataaaccttcaaagtattgctagcatgcacaagaaaataccatatgcataaacaaagctctcttttatcaattttttcattatcatattattgcttgataaaaccatgaggtacaaactccccctcaaaccatgccaaaaggatgaattacgcccaattcaccacgaagaaaagcaaagcgattagaatccaaaggtttagtgaaaatatcagcaatttgcaacttggtgtccaaaaacagcaactcaacatctcctttctcaacatgatccctcaaaaagtgaaaacgaatatcaatgtgttttgtgcgtgaatgttgaataggattcttagcaatattgatagcactagtattgtcacaaaagaaagttactttctctaaagtaagaccataatctttcaaagtagataaaagccaaagaatctgtgaacaacaactagcagcagcaacagattcagattcagcagttgattgagcaacactagattgtttcctagaagacgatgcaatcaatgatgtaccaagaaaatgacatgttccactagtacttttcataccaattctacaacctccaaaatcagcatcggaatatccactttagcatatagaagatgaa

SEQ ID NO: 5232 - DNA, 1068 bp, Oryza sativa
atttttgaaaccccacttgttccaataatattacgtctagaaggtggttcaattaaagtccaaactttgtttctctcaaaattttcaagttcttcatgcatggcgttaatccacgattcatcagttaatgcatgtgacacatctttgggttcaaaataagcaacaaatacagaatttgcacaaacatcatgagtcgttactttagaccttgtagtccgctcacctatattaccaataatttgttccggcggatgtcgtcgttgaatgtgcaaaggagcagcgacttctgaagttgattcacgttctgtatcattactggtcgaagtagtaatttccggaggaccatctcgatcagcatcaacagtacccaaacccgatgaccctagccggtctgaccgctcctcaggagccggtctgaccggaggtgtgccggcggtctgaccggcctggcgcccggtcttaccggccgagccgacctcatcgtcgtcgtcgtagtcgctctcatcttcaataatacgaccatcctcccctgaacctgtgacagtgtacctgcaatatcgggtctagtacctggactagcctcatcaaaagaaacttcgcaagtctcaacaattttgttagtccctaaaataagtacacgatagccatgagtatgagcaaggtaaccaagaaataatccatcggtagaacgtgcctcaaacttatctaaatttccagatttcaagacaaagcacttgcaaccaaaaacacgcaaatgtgaaacattgggttgatgaccaaatcgaagttcataagaagtttttccaagtttagaacgcaagaaaactcgatttgaaatataacaagcagtgttaattgcctcagcccaaaattttctaggagttttatattcatctaacattgttctagccatctcaacaaaacacgatttttcctttcaacaacaccgttttgttgaggaacacgaggagaagaaaattcatgttcaagacctctttcgttgcaaaattgttcaaatgaagcatttttaaactctccaccattatcactttgaattcttttcaaaga

SEQ ID NO: 5233 - DNA, 21058 bp, Oryza sativa
  unsure (1)..(21058): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggggccccttttttttggccctacctggaatggtggtcttcgttgttctgttgttattgttgttgttattcttcacagtgatatgtcattcaccgcaccttatattgttcccttatcctttatagggtgtccttttggattctttcttgagtaatcttctgaatttcttctatttcttttattcttcttccacgcccaaattattgatattctattatcaatatatattgaaaaacatatttagcttaaagaattctattcatctggctgcccatgaccaccaagatccatacttatctggaatagtgtagattccttatcttgaatagtgatctttgtcggggatgacaagatctttattcattatcttcgttgattatcattggtgctgattgcaccgtgtcaatctctgatgggtctgatctctgaaaccactgggccaagcgtttgtcgaactcttcttggagcattcatttccaaaatacagtttaattatgcgccctgctcccttgcagtattcataactatggctgtagaatttgctgataaaaatccttgtgatcttgttttggaaaaccagctgatattcataatctgtggtgatagcttcttcaatttctgcagcttcagaaaataatctccaattttcatgattagcaactgttgtatatatttcttcctcttcatccaatagtttgctaggaccgtcttcttgaaaattaaattgtcccttcatgatatatatataatgaattgctggacgaacaggtggtgtgaattttggtggtattgaggagaagataatcctgtatcttccatgtccaagtctcctgcatacatctttcacagcgtttcctaaatcagattgaaggatctgatcgagggttgcatatatggaattcacaagaccatgatctataatggtttggagagatatttcttcatggttgtatgtgggtaggttccggaatctttgaagatttatctcagctttgagaaccaggaatctataggatgggtcagaaattgcctgttcatctagtcttaagagagggagcatatatatgattactcgtatggctgggtttctttctctcccttctaagagatcaaagaaataatcttggagtccaaggaatattttcatttgtctctccttaaacttttgccaaacaagatcgaggatgtcttgcccaaagcaggataaagtttgttccgttttgaagcttaatctgggttggagattttcgtatgtagtactcatgggattttggcttttaagtttctttttgcaagaatctttgtaggcacaagatctacatggtgcttttggctgggtccggagtatatattgtggaaggaataaattaggatgattatgcagtatgtatggtgtttggggaatggtatcatgcctttttgtggatgatgatggtttattatgtggaaaagattgcaataggttattgatatttatgtggaaagcaaccatgctcgaagcaggatctgctgagatcaaaatcttatctgagaataccttggtattcttatctgttgccatagattgttcaacttccatgggaagtatatcttggccatcacgggatttctcctcgcgataatctagtaacctttcctcatgatgagggatatcttgtattttagcccttttttctgttatcttttgatctgagggcacgaaatttttgaaataatatgccaggccatttaaggcatgagctttttcttttttgttttttgtttgccacaagaggtttaataacccttgttgtagctctgttattctgaaaattgtgattaaatcgttctccatggcctctgggcagttggggcagtctccatgaactcatatttgtgagccattcagacttctgtgaagccatttccctgcatatatattcaaaatctttagtagctttaataaatatctatcttcccatgatgtcttacctggcaattccatagaattttggaagatatgatgagaaagaatagttgtctatattctcactaagctcatattcattaattctttcttcagactcaagattaggtacttctaagttgtcgagtttgggggagactccaccacactttcgtacctctgagatatatggaacattattttgatatgggataaaagtaattccttgctcatgtattactgtgggttgtactgattgttgaaggaaccttaggccaattatcatgtcatcattaatcattgacaaatctcttattgtaatctcatctattatatatttagttgcattaatgtaaacctccatattataagctaactgattatgaattttctttattccggacatgtctgtggaaacttctgccttattgtcgtcaattgtgtgaactatttcaggacatcttgtgaaatatttgtcatgaataatattctttgtacacccagtgtctactagtgctaatattttataagatactttgggtgtcaattttactttaacagggattcttatacctaatatttctttgaaaggcaatcttactatatatttatttccaaaattagttatggcatctcttagttgaattattttagcagtattactgtcttttagtgttatcaattgctctttaaattcggtgttttgtatgtccttattttctggtaatgctttaatatcacaattattttttaggttctctaattctatttctaatttatttagtctattttctaacactcgtactctactagataaaatcttttcatctgattctaattctatttcttttctccatttttgtttatttgcttttatacattcagcacaagcttgttttagacatatactacaagtcactctattttcttgactagggtaatatatgcaaaaagcacatttgatattatagtcaccctttcctctaatccaatcatgttcacaatttaattgatccatcatttcaacctttagacctgctaattcgtcaattaaatctaactcttcatcggatgattcatattcttcgttgatagtttcaacttcgtctgtttctatgatagaatatattgactcgtcatcttttatttcatcatcacatactaatatgttttcatttacgctatctataattagaaccctctcttgttcttcatatttactagaatatctcttttgatctttatttgggcatgttctacttaaatgatctggcgagttgcatataaaacatctgcatgttttgtcataggttttctttggattatatcttcttacatttcttttatgtaagaatggtgctctattatctgatcttcttaagaaataccttttctttgttctaatattattatggtttctattttgatgtttataaatccttttacttctaggcttgtcttctccatatgacaagggtatttgaactattttattgcagaaattgtaatccgagtgtttcatagatctttgggcttggatacccgtgcatatttttcttagttgcttaaacacaaaagttatggcttgagagatattgatttcagctccttcagtttcctttttatattcttcaaatatcatacttgctagtgggtcaggtaatttattgaagtaacgttcaactattcccctgttatatccttgtttagcagttgtagcattatataaataatgttgggagaattcttttatgcctttccaacttgttaacgttaatttttctatttcttttaacctttcattttgcaaagttgtataacctaattccggatcttcagctataataatgttagatataacatttgcaaaattatgcggattgctaccagctcttttcaattcttcataattattaggattcttttcaacccattgttcccatagaaccttagcagattcacctaaaaatgtttctaagtaggttatcatatcttcaactttacttcctatattgtgctggttttgtatatatttttgaactattaaacctttccaaatactaataatatataggccagtctatgggatcatgtgctgctagatttagtatagccccatcacttttttgattttgaaattttattggtttctcaaaatctcttcttttagtgcccatgtgcctatactgtcctgggatataatgatatgaatattcttctttttctggaggccatcttcctgctgccctggctggtctttctctttctccttcattttttacagaaccctctccgtatcttttcctttttcctgttcccaaatctacttccatagcttccattgcattatctagattatgcaaaccttcctcatccaatgagtctataaaatcattatattgttctgcattatcttcttcttctatattctctatttcctctatcaggttattttcttcttcataactctctagtaataatttctcatttacttcccattgctcttcctcacttaataccttatctaacttttggatttcttctcttggttcttctgactttatttgttctattttaatttcctgggttctgggggtttctatggccaagcttttctcttttttttgtttcttaatcctggatagttctctatagaaataaagtttcttgtctctaattttaggccactcacttttcatagagttattatattcatctgctatatctcttaatttatcttcataatattttatttcactttcatggtctaatttttccatcaattcagatatactatgtcttctgttatctataatatctctgtcagatgattctgcatccaaatcatccgaagctctggttttataatttgtaaatctaatactaacattccctttgctgtcttggtaacttatgaagttttcaggctgactcaaggttttattttttataaattcactaattggccatttttctcctgctctttcttcagagtctattattaaagggctcatgaattttattcctttagaatgcattttttctatcacatcatttacattgattttgtatttggaggcacttctattagtcaatcttcctataaattctatacttattaataaatttgttcccttaaactcttcgtatccttttgtttggaaaccaaaactcattttatctatgaattcatttacaggcatcattaaatcaggcgctatataggttatcaacatatttccattcatatctccttctagatagcctaaagatgctttgtttattgtgtcccatcttttatctaataaggttattagcactttagctcctaatttctttcttgtcattcctttgattcctattatgtacataccttggtgaatatacttatatcctgaatattttaaactattttcaaattctttagctactatttttaattctactggctttgttagaacacttaattctacttctctagatattctataaagcccattcttattctcaaaaaatcccatgcagtatacttgttgaggccttattgcccttaaagtatctcgttgatatctttcgagctgcttatctacttgtgcaacatctttcagctcatctatgtcatcatatttgcctttttgtttatcagaacagttatcatctctgcttgctattcttctaaagagactcctagatatgtccatttttcagaattaatggcttgtgaagatgagactatgccagatgaagccaaaactatttccttacctttactagagttgattttgtctagtaattctttaatataatcactattctgtgaaattttattttgccttatcttataatcttctaataattctaatgtagtatttagcttattattaagaaaagaatattgttctacaaattgcttttgttctttatatatatcttctaacttttgctctaaatcttcttgtctcttactccaatttatatagaaattatatattaaatctacaattaaatttagttggctattattagagtgccaactatgttcttcagtatggcttagtctacaccttatgttgatattatctttggtatttattaactttccaatattagcttctaaatttagcttctctatgattaccaggctctgataccactttataattaattcacaaattaattcataactattcactactatttttagtgctgaattcacttattatgagtacagaattacttcaataaacttcaataaatactcggagataataaatacctattctgtaccccctcccgcgccaaaccaccgcgccacccgaccatccaccgaaccggtgccaccccaccatccaccgaacgcgggcccaccacccagtcggttttttccgcaccccgccgacaaaatcaggattgctcatcctcctccgcctcctccgtatccacgcgccgccgcctccatcctttccacgtgccgctgccctcggctccgtcctcaaccgacggtggccgacggcggtccggtgcgcctcctcccccgcctctcctgcctcctccgcccctctcagtgcctcccccgacccccttccccccgcgcctcctctagggcttgcgtcaacagggaggggcgtgagaggccggcaacagggatactggcgacggcggccaacggtggattggctgcggcgcctcccgccggaccccgtcctcccctctcagcgcctcccgccatcccccttcccctcttctagggttttggggcagcggcaggggcaagggcagccggcagggctgcagctgaaggcgcggtagcggctggtggttcggagcacggcgtgggcgtcttccctgctagctggacaggtttctaacccatctttttttttctgttaactgaaatgctacttgtgctaagtatagttcagaaatccttcctaggaatgtattttgataatgctaaagtgaaacatgagacagattcttgctgctatattcttagtcagaccaaacatgtcaatgtgttatgcttgattggttattgaattaaaaaaaagttgaacgttcatgtgtacagatatatatgtgttatagtatttaagttctctcagaattttaatgtgtacagcatctaattatgtttgcttcaaattttcagttatcaattcttggaaagttggattgcctttttgtctgtttaatagtcccaatgagtgaacataatattgtctcgaggcattctttgaaaagtacagccgggtttttttttatctccatcacaaattcacaatgcttcaagctttgcaggatagatgctcattttgcttctgtcatcctctagcagtgataattgataatgctaaagttaaaaacacagattgtatactacaatttttttcttataccttttgatttgtgtcacagtggcgtttattaggaggaacctgtgagcaacttttgtatcaagtctacttctcgtgagaagagggtcgacaatgaaatgtcagtcttttatgcagtaatcgtgctttatatgacagtaatatatttttatagacatgcatggtttccgatacacattaaatgttttttctgttagtgcacggtgcctgattttatgttttcttagtaagatggttactcagtttacagttacatgtctttgtccctgcagtaacacaaaccttactttgcagtaacatattttattttttgcagtaactcatctatgtgctttatccttttttcatgcagtgggttcagttgttaaagacggcaaggcctagaaagttgcaaaggttgtatacagagatggtgatcataacttggaggtatcttttgacccaactcaaacccaacctagtgtaccggcaacgggaggggtagaagagggtgagccagtagcagcagcgatgggagggggagggggaggggagagtgaggtagcgacagtggcgactggagggcaagaggagaggcaaccaccgccagtagtgaaggctcaaaacaaatcacagcttcctatgcgtcagaagaggaagaaagtttttacaagagtaagagtccaagatcaagaagaagacaatgactttatggaaccagcttgtcaggtgcctataagttttcttttttttcagcctatgatttgtttttccccaacaactatgacatatttttgctaaatgtttgttttacttactttttcctgttacaggttaagagtaaggtagctgagaaagcaacacaagatcatacaaagcataagcttagtgagcagggaaccagaggatgaagtggaagaggaagatgaggatgaatatgaagatgatgttgaggatgaagatgaagaagtagaagaggatgacgacaatgatttcatggaaccagccctcaaggtacatgcaagtttctttttcctttttagtagcacatcatgttttttctttctttgcatgacatgcacatcatgttaactttgtttttctcttatccttttgccataggtcaagcggaaggttcctcagaataggaagacagaagcaatgcaaggttctaaaaagaaggttgcttcaaagcaaaagttgactaaggatgtgccggtcaggaagcgtgatcatttctctgtgaacaccagatgccagcctaatgccatccttgaaatggttggttcgttgaacaaacctcagagggatagattgcatgctttgggatttgattgggttttcaagtttcggatgaatggccttcgatctagggaactcattgaatatctaatagattgtcttgaccctgattctatgtgccttgatcttggtggtcgtgggaagttaccagtgacacctgatgttgtgcactgtgtgttggggctgcagaatggccacttggatccaccagtagtgtctgacactactccattggatcctatcagggaagaattaggtcttggaaaaaaggagaaaatatctagttcatccattctggataggattaagatggggggcactgacgatttcacaatgcagtgcattctgatgatcttgtttagcaagttgctggccccagactctagcaccgacatcacagggaatatagtcaacatggtgagcaaaaacttggagcagtacaaagacatggccctctacaagtttgttgttgatcatttgagatggtcagctgagaagtggaaaagtggcaagaggagtacagtctacggctgcacagctttacttgtggtaattctcatcatcttttgtttgcatcttcaatgtttatttatttgcagtatcacatctgttagtttgcagtaacatccacctttatttgcagtaacacatctattcagcttgcagtaacagtgtagtaatgcttttagatatgttctgcagtaacagttagtttactttgtagtaacatccacctttatttgcagtatcacatctattagccaacagtaacagtgtagtaatactttagatatgctttttttttcattttgtaggtgtattaccttgacaaccttctttgcaaggccatgatctcaaacaccaatacaccacgctcacaatttttcaactccagtcttattgacaaaattgagaatctcacaaaatcaacaaagaaggatggctctacctcttttgggaaattaaatgtaagtttgttttttccccactctctctttctttttttggttggatagtggttggttgtggcactaaccctttttttatctatacttctcatgcagctgaggtgtagggaaagcacttgctactttgtttcaaaggagaaggtgaagagaaaggttggagctgctagtgggagtactagaaagaggaaacacattgatgaattagcagctcaagaagcaactgtagcaagatccaaagaagcgcctcgttttggtggtgacttcccaagtcttcgtagtaagctaggaccacttattgagtcacttgggagtacccgcaagcaaattgggttggatgctcttgagcaatatgacaaggaggtcgagcagattatgggtaacctacacaaggctcaagaccgcctagtggatgttctaacttcgctttgctcgacaagtgatcctaagatagcttacacacggaaaagcaaaaagagaagagatggcctcccccctctagattctaatgcagtaaccgacaaaacatctggcagtaagttctcatcctagtgcagtaacatgtctttttttttgtaatcaaatctttttttcattcatgtggttttactttttcaggtggcaatgagaacacaacccaagcttctatcggcacacctcccactcaggccaatgatgttttaggagatgagcaaagtagaggcaatgtggagagctctcccccaatgcatgtcgaggacccaaaagatgcagaagctggacaaccttgcgagccagcaaaagatgcacataatgacagtaagattcttctttctttgtattaactttctttctttgttgatatcttttgccattgcccctctgtgaacaagtagcctttttttatagatgatgctgagttgtctaacttggtggacaaaatctgtacaaatgttgaaggcttagtggacaaaatatgtacacatgttgaaagtactcctatgctggccattgccccatctcttgctgcgaacctgtcgcctgcgatcatgcctattgagatggaaaagaggaggccgttggcaaaccccaagtacatatcccctttcaagtgtgtttccattgaaccactatgggatgacactggagacattgccatggaagtgtacaaaattgtatggaacggtcaactccctgatgttgaaaggtgaacatctttgcccttcactcctcttttttttttttaattttcctaagtgaaatgcgcatgtgcattgaatttttttgtcaacactacagtaataacgtacatacagtaaaatatatctaattgtgcagtaacatataatgtatcatgcagtaatattacttctcttttgtctttgtttttggttgtacaatttttagtgcgtatctcatcgaccaaatggaaggcgccattgtatggaagggcgatgaattgaggaattgtttttcagagggtggaaagttgacaaatgatataatgctcttctggtcaacatgtttgatttttgatgatgccaactatcggaaagacagcattggctacagagttatcattcccaccagcgccattatatgctaaagattattttcatgcatttctttttttatctgcatggtccttttgaaaatagttctctagctcaaccttttttttcttcttttttgttaatgacaggaagtgctgaattctgaaaaccacaatcttacattctcatttgatgctgccgtcaacataatctctcgtgaatgcaagagttttaacctacctaatgcaaaactggttagtaagattgtcatgatgtgtgtttagtaagattgtcatgatgtgtgttactatatgtgttgacatgcagtaccaaatcatttttttactatggggtagatatgtatttgtgttgcagattaatgtttaatactaccattgaagatgcatatcaactctgtagtaacgtcatcatagtttttgtagacatagttagtctgttactgtacttttgcactagtgttactgcaatatagttactctgttactgtacttttgcactagtgttactgcatatgcttcatatttctaatttttttactgcttgacgattgaaatgcttcttttgccaattggtcagagttttcttccaacgattaacaatgaccattggactattttctgcttcaacttcaaccacaaacgaatcgatatacttgattcattaggacatgacagagacgagaaagctctaaaggctatgaaagacagagtggtacgccccatttttttcctttttgtttttttttgtcctttttctggttttgtgttctcatcattagttagcatggtatttcccttgttttcagttgggagtaatattctgtagtaaccattctcttattttgtagtaacatgcctattagtttgcagtaattgttcttagcatgggatttttcagactgtgtttctaaactataatcttattatcttgtctctatttctaccctgcttttttctgctacaggttggtaggttccttgatgttcttgatgtgatgttcccaaagaagttcacagatgttaggaagtggaaatgctatcatgcttgtaaccaaaagcaagtcttgacaaatgattgtggctttttagcgatgaaatacattcagttctgggatggcaaagtttttgtgaagaaagtttgccctgtaagtgcatgcacatttgcattttttttataacattgcctacttgtgattcattccatcatattgtttctaatacaacaattgcatgcccccctctattgcagaaggatggaacaaaatatcgtgcggaggtcctctattacatactcttccacccactgaacgaggcgaagctccctgcggctattgagcgatataggcctaagattaggaagatctccaagtagttcagctctgttcttttttccaagttgtcttttggaactttgtacctaaatgattgcagtaacatacttagatgctggtagtaacataattagttggtggcagtaacaggagactgttaggaacattgccacgttttttaagtaatgaaggtgtacagtggcagtaacgtacttggatgctggtagtaaaaatacttagttggtggcagtaacaggagactgttaggaacattgccacatttttgcagtaacgaattatatagtggcaggaacataccatatattataagtcttttgtgtaattccctgttaactctgggttgtttcacatgtcacaacatttacatcatctcttgaatgttttgaaccatgttttctattcggtttgatagcagtaacggtgctaattatttgtagtaactcatatgtacagtgacagtaacacacctgattttgtatttattgttggtaccacaaatgcaacagtacgcccgtgtttataattaccaaagttgacaggaagacataatgacattgcagcaatctgcattacgtcgtgtatctatagttcacgacagcaaaacaagtttatattgttcttactttcctgctgtaacagattactaaatttacagtaacatacatgtatcatggtagtaaacaaataggtaacatgtaatttcaactggcatcatgacaaaccatttaaaatatagcagttctagaatcatgtcatatagcagtgatgctctgccctaactgatgggaggataacattttttagtaaccaatatgctaaatgacagtaacagttgggcactatggcagtaacatattacaaatgtccaagtcagcagccatgtactatgacagccaagtcagtagcctcacttactcttcttcctcttcttcctcttcttcctcacttactcttctacctattcttcctcgtcttcctcgtcttcctcgtcataatcatctcttgcttggcgggtggttgttttttgtcttttgcttctactagggcatgtcctagcattgtgcccttcaatcttgtgacatacactacacctcctgctgtggtctttcctctgcttgctctctgtttgtttcgatactagtttttctttgtctttcttccttccttttgttgttgaaattggtggcgccgtcaaaggtgcttgcactggatctgtttccatctctccaatattattttcttcattattcaataattgttcacatggaattccatcaatctcaatatccaactccttaaatacctccatggctctgtcgtagcattgcgttgattttgatgcctttttggcaactttcgtagcctcatttatcaacactgtgtggcggtaaatctcacttgtgctgtcaaggccaaatctccgatagtcatggtcatcaaagacacccccttccttggcacttcttgtgtacctcttcaatatatatctgggcagtattttttctacctggagatggctgagcaccctcacaatatgtgggcagaaaagacctgcagcaatatggtacatagaagttgcagtaacagagagtggaagttgcagtaacagagagtggaagttgcagtaacagggaatataatagaagtaacagagtataacagcagtaacagagagtgcaatttgcagtaactgagagtggaagttgcagtaacagagtataatagcagtaacagtgagtataacaatagtaacagagagtatagcagcagtaacagagagtatagcaacagtaacaggactaaacatttgaagtaacaaatcgagacctagcaacacacctgtgtgtatccacgttttgcactcgcattcatacagcccagactccacatcagcagtaacttggaaagcgtgttgcgaccacgggttctttcgaattgtcttaccatgggtcaccacgtaggctcccatggcgttggaaacctcattcacaagaaacgccgtgctatcgaacagtgtttccttgaataaggtgaagaccgcccttgtgtacaatttgctcagttgttcctcgaacgcatatcttgtgctcaacacgggctcacactgcagttgcagtaacaagcattgtttattgcagtgaagagacaattctggcagtaacagtaacaaatagaccacacaacagtaacatgcagtacaacaggcggtaaaatattgatggaaatgcagtaacagtgagtataacaatagtaacagagagtatagcagcagtaacagagagtatagcaacagtaacaggactaaacatttgaagtaacaaatctagacctagcaacacacctgtgtgtatccacgttttgcactcgcattcatacagcccagactccacatcagcagtaacttggaaagcgtgttgcgaccacgggttctttcgaattgtcttaccatgggtcaccacgtaggctcccatggcgttggaaacctcattgacaagaaacgccgtgctatcgaacagtgtttccttgaataaggtgaagaccgcccttgtgtacaatttgctcagttgttcctcgaacgcatatcttgtgctcaacacgggctcacactgcagttgcagtaacaagcatagtttattgcagtgaagagacaattctggcagtaacagtaacagatagaccacacaacagtaacatgcagtataacaggcggtaaaataatgatggaaatgcagtaacagaatagttgaaatgctagtttattgcagtggagacaattctggtaataacagtaacagtaacagatagaccagatagcagtaacatgcagtataccaggcagtaaaataatgaaggtaatgcagtaacagaatagttgaaatgcaataacaaaatggtgattcctacggcaaatgcactctcaaacaagctcacatgcagtcaatcagatagtaaaataataaaggaaatacagtgagtacctcttgagcattagtttctcagtcctccttttgtttcctcatctggatgcatctattcatctcagctgcaactctgtggagtgcagtgagctctttgagatagcctgttttaaccatatggttcacactctcgctccgttgagtggatgtcattcttgcgtagtagatctgtttgaagtaagcaggaatccattcggcacgcaagttataaaggttttccatcacctcacaaccttgaagttcaaactcttcaacaagatctttccatgcagccacaaattcacttggtgtcagcggatggttgatcacaaagtgcagcttctctttgaaatttctatgcttgaacatttcatagagcacacctaactgttttttgtacttctttagtacatgccatcggcagagcctatgaatggtgttctttagcacctcccttatagctgatgccatagctgggtcctcgtctgcatttatattggtagaacagtagccaagtgttaattaggcagtaacatataaacaaaaaagaggtaacaaaatgtaagcaaggtaggcatctgagatatttttatagttcaacgcacctgtgagaatacacatgggagctttgccccccatgcacttcagaaaagttttaaacaaccactcaaatgattcagctctttcatccctaaggagagcaacactcagaatcacactttgcatgtggtgattgcatccaacgaacaccgccaatggcatgttaaacatgttcgttcggtatgttgtgtcaaatgtgatgcaatcaccaaaatggtggtaggctgccctactacttgcattgcaccaaaatatgttctggatagcatctttctcatcagcttggatatcaaaatagaagttgttgttcttgactttcatttctttgaaaaacattagcagcttgtttacatcatctgagttctcctccaccttgttctcagccttcttgcagtaacacgctaactaaaattcagtaacatgatgtatactaaccagtaactcacaacacggcagtaaaaggaagcaaccatgttttagcagttacatgtaaactaaaatccagtaacaagatgtatactaaccagtaactcacaacacagcagtaaaaggaagcaactatgtattagcagtaacatgttaactaaaatccagtaacaacattgctaccccgtggaagtaatgcacatcaacaatgctaaaaacaaacaagtatagcagcagtaacatgcatttgggtagtaaaatacagcagcaatgaaaatagtcgaatagtgcagatttatcaaataagacagaaggcccaaatacctattcgcaaggtccttgttagtgaaaggaatgttctgggggccaccatgcatttttgatagtaaggacattattgcaccgtgagatacgtggcattcctgaagttgtctaacaaattgcatgattgatggatcataatttttgtgggactgttggaaaaccgccattgatggggagacatacagatgatgggtgtgatccagttgtgctcttgtgatttcccaaatgtcaccatcttgcttcacccttatcaatgctttgcacccaactcgttttgttgtctagtttcttaccctatttacctcctcgcctttgtaagtgtgattgccttggcgcgtgcaatgcagaaagcgtgcacgacgggcattgtcaaacttgcctttcttaatcccaaaacctgcataccgtgcatatctattgtaaaagctgtaagcagcatcttctgattcaaacatcgtgccaatcaaagggacaacatcttcaggaatatcttggccctataattgaaggaaaaaagtacataaaattcattatttgttatgcgtaggacaatactcatggcagagtagtaaccaacacaaaatatgcagtaacatactcacatgtgtgaatgtaaggttactgtcaggggtgatgcatgcctctggattgatagggggaggtggggtgataactgttctgtgcagtaagggatctatgaaagtttgatgcagtgatggtggtggggggctcactgctattggtaagacatcaagcacatcatcaattgctggcggcgaagggggcggtatgtcacctctgaggtgcacacccgaataagtagatgttgatgccatcttcttttgcacccgcctatcatatcgacatgcaatatcttagatagcggcagtaattttcatacgcaatacgtacagcaatgagcagtaaaaaaatacttgccataacagtaacagatagaccagtcagcagtaacatgcaggaaaacagacagtaaaataattaaagaaatgcagtaacagaacagttgaaatacagtaacaaaatggtgattccgacggcttcaagctctttcgaacaagctcacatgtagtaaatcagacagtaaaataatacaggaaatacagtaacaaaacagtagaaaagcagtaacaaaagctttcttttaagacaaaactcacatgcagtaaaccggacagtaacagggaggtctatagacagtaacaacacagtaaccacagatttttctgcataaagctcgcatgcagtaaaccaaacagtaacatcgcgatctataaatagtaaaaacgctgtaaccaaataattctatatgacaaaacttgcatgcagtaaaccagacagtaacatagtgatctatagacagtaacaacaagatttttttagggcaaagctcacctcaaggaaaaggaagggattcgtgggcggcgccgaaaggacgagctgagagggatgcttcgccggggttccccacgacggcccggcgcactggaaggtatgagagttattgggagagatggaggaaaggagggaggctggtagggaagcagagggagggagggaagctgggaaagaggagagggagggggacggagggaggagagggatggggaacgaggccggagggagcctccgcgcggcggcgcccgaggttggcgcgtgactccctcctctcggcggcagatgcaggagttttttctctcttttttttttcttttttcgtatttctttttgtttctctctatcttttcgctattttttttggtgggccggtggggcggctgcgcgagggcggatcgctggatgtttaggcgggatggcgggatggcgcctgggagtgggagagggggggagggggcgtatagaatagttattctataccccaggtgtagagtagtctcaccctatacatatatatatatatacacacacacacacatatatatatatatacatacatatatatatatatacatacatatatatatacatatacatacatatatatatacatatacatatatatatatatatacatatacatctatatacatacatatacatatatatacatacatatacatatatatacatatatacacatacggtagcgctagacagcgctagacacaggcgctccgcgccaggaaagtacgtggcgtgagacacagggataatccccccctcccagggcaagcaaccaactgcggagttaaaacttaactcgcgacaaacagggagtgttccgcagtcccggtgctagaaccgactgcggagttaaaacttaagtcgcgagtcgcgacacacaaggattgttccctactcccggtgccaactttccattgcggagttaaaatttaactcgcgacacacaggtagagttccccactcctggtgcgcacataccgatttaggagttaaaacttaacttgcatgcagttggtgcctaggttacgatgccttacagattcagttaacattggtgatatgttgatgctggttcctatgtttgatctgtttactcgtacacatttttggcgtgggattcgattgaagatgtacttcagttaaaatttaacgcataggtcttgtagcatgcaaagattcgatagatgtgtttgtttttttaccgcaatataaaaacggtggctctattttatttcattatatccaaccacaaatctcgggtatgtattcattagaaaccctttttcatatacatcatatgcttggtatccttattgagtaaaaaattaacttggtatgacaacaaaattttgactcaacatatacatcctcataatatatagcataagttaaatttttgttggttcttgctccagacatcgacggcggcgtgtcattaacgtggccgccgctgctcctccatatccatcaaagtccgagttcgccgccgcagaggtcacgccgtgggcgtgggggcggagcggtggcctgatccgccgccgccttgcctcctgcccatagtgacctgtcacagccgcgcccgccgtcacctgtgcaagatccacgcaggatctgcgcgcttggggcgcggagtggcgaccggatgcgccgcctcctcacctcccacccgtagtcgaccatcaccgccgcgcccgcagccgtgctgtgctggaaccgccgacgtcgcgcccgcccccgatcagcgatggaggtggatccgtcgcgcctccagcccgctgtcacccgtcgtcgccgggcccacaaccgtgctgtgccggatccgccgacgtcgcgcccgccaccgctcggcagtaaaggtggagacgtcgcgcctcctgcccgccaacgctgcgcccgcagttgcccgtcgccaccacgctcatagccatgccatgccggatccacctcccgcccgccatggatgcgacgccatcatgcctagcctgccactgctatggaagacgatgggagaagggatgatgttgcggttgcttctggtcgtggcggccgccggtggtgatagatccgacggcgtccctatcgacgacaaccatgccgccgttgctcctccccaccaggtcgccctgtcaccggccaccactcgggatggcctctctgcgcggtagccaccgccgtaccgtcgccagatccatgtaaatcgggataaaaaaatgaaagtgagaaaaagtaggatcgggatatgtggttggttacaagatgggggaacaacacatgtatatatatgctaaaagttgggtaacatcaagttaaaaatttactagaactatgagcatgggggagggggcgcaggggtggggtactatgagttaaattttaactgcgttatgtggacggggggggggggggaggcaggttgcacgagggtggtggcactgtgtgtcgctccacctagttaggtagcgcctatagcgctgtatagtagttctctatacacatatatatacatatacatatatatatatatatatagatgtatatatatatatatgtatatg

SEQ ID NO: 5234 - DNA, 5650 bp, Oryza sativa
tttaagttctcgtctcgctgcaaatgcatagtaacgcgacagtcaatatgtagtaacacgactactttccacaataacaatgttataaaatagtcatgatggatctagtttcgttaaacatcttgtctcgattatcgtatagtaacagggcaattgtattattgtttaaagattagaattctaaaagtttacttgtactaagattgttactatgtatctttgtatatagaaagagaagtacttttagcacttgtgttcacttgtgaccatgcacatgctcctttttagcacttgtaatttgcacaatattgagatttaaaaatttagctatgcacaagcagtggtactgtaatagtacagttactaagtatgttctcatttactgcaatttcgtcatgatgttactgcaaaagtgcactaacgaccgataaattttacagtaacgacctataaatttcgcagtaacgtatcatgttactgcactcctacgataatgttactaccgaatcgtaataacaaggtatgatttataacaaggtatgatttatacagtaacataatggatttgtgttcacaaaatttgaatagatgtacatagaaaacaaacaatgatctcaaatcacaaagtgtcatagggtaaattggttaagagagtttgttatgaaccatgagatcatgggttctaatcttgaatttatcaatttatttttatttttttctagaaaagagaagaagaataaaaaatggagagagagatcgggatggggaggaggaggagcgatcgggaggggaggcggggccgggcgccggtgctgcacgtgacctcgaggaggcggggccgggcgtgatccagagggataggctttggtagttgggctgagaaggaggcgggtgtagaatagagctgtcatatgtatatatatatatatatagagagagagagtatatacccaattcaaatgagtatgaaattgttttttaaatagttaggtatgaacattaacttctttacaaactagttcaaacaagtttgagctaaatttaaacatgtttaggtatataccatccaaacatataattagttaggtatgtaatactcctatatggattgtgaaataaagttgaatttgagttgtttttgttgttaggtataggtatgaatcaaattcttatacctaggtatatactcacaatttgaacattttgaaaaattcgagttaaactgtgtatttcatattatatgtatgtatgtatgtatgtatgaatgtatgtatttgaatttatatatacatgtatttatacatatatatgcataaatataaaaaagcagcaagcaataaaaatcattaaaaaacatttttagtaccgattagtaacgccaatcagtaggtcacgtggtcctacggtactaaagatgtttttttaagtcccgctttgtataatcaagactataaatattcatatttattcatgcattttgcgtccccattgcacaaacgggactaaaatgggctgtcaaccgggactaaagtgtatttccccagcaaaatactcttctagtaaacaataaatgcatattttttggttatctaagccatgaacttttttgtgatttgtgaataataccacacacaataaacccatatgaatataatagtctcctacatcaaattctacgcttctaacagtatactcgagaaatttatatgttccttcaatgactaagtatgtgttcttctcatccattggagggagctggttcctcacttgttatgagcttctaaactgctaaacggtgcgtctcgtgaaaaagttgtttatatagaagtttcttaaaattttcaaataatttattttcaaattagtaatagttaatttttgattaatcatgagttaatcatcactctcgtttcatgtttcttgtgcacccgttcagctccgctgaacagttcgaaccacatcctaataagggcaaaatgcacctatcttgcagctatttaacgctcaaccaacgatcaattgacataataataagtataaaagggataaaaatcaaaattcagtgctataccatggaataagtaaaactcgaggatatacaaggattggctaaatttgaaaggggcagataaaaaattttctcaagaaaacacgcttccctgtgcccaactgccgagctctatttaggcagcattgtctcggctatgtgcaaattattccataatcgtgagccaagtttgacagagatatgtagtacaattcaaagcaagcttgtgctcagtacactaggttgagtggttgaccaagaaattacatgctaaatatttcccccgtatccattgatataggcatgtatgatatgacgtttaaagtttgtacatatatataaatatttctacagtactacttacacaaaacccaaccactattatttagtgttgataacaattttataaataagtatttctgtcaattcagcccgattagaagttggtccatgctctttaatgtgggacacatcaaagtctttccctttcattctaaatctctaagaaaaaatatttatttatctgaacggagtatgtatataccatatatttgcttttggtcagatgattgcgcatctctctgtaaaatcaaaggtgtttttgattattattctgtgatgaacaattgggcattggagatttcataggtgaatcgcaggtttatcattttatgtggaccggtcagaccgggccggtgcggccggtcagaccggcgtgtattgcgcggtcagaccggcgcagcctgcggtctgaccggccgacactgtgtcggtttcggtttcgggttgtttatttggatatccgagtttatttcatgattatgacttctagatggatactatacgtatgtaatactattgtttgctgctaatgagtcaagttggagatagcttggtctcgtgtcgcgtcccaaaacaaccctaaaatatatcatttaaattatgactagaataattaaaatccttgtgaaagccttcaaaaattaaaatgtgcaaagttaaaagtcaattaaggcttggaggattttttatatttcctaaaagcctaaaatgtgtaaataaattttagtggaatttccagagcacaaataataattattaagaaataaacaaagttaaaatgattttgtaaaaagaaaaaccctaaaacaatccctccctccctctcttgggccggctcggcccatttccctccccctctctcctcttccccgcggcccactcggcccctccccgcgcgcgcgccgctgacgggcgggcccgcccgccaccctcgctgacgggtggggcccatccgtcatccccttactcccgccgctcccgccgtcccgcccgcgcctagcgccgacgccgccgccgaatctgccgcatcccgtcgcccccgcgtgaaatcaataggggggaattactccccgtgagcccctctccattttcccccattttcccctctctctctctcattcaaacgagcggatttgctcccgcaaatctcgccggcgccattaatagcggccggacctcccacgccggtttccttcctccccggccgccctctcccccttccaaccctatttaaaccctccccgcgcttctcccgtccgtttccgcctctcgccgcccttcctcctcgccggattcgagctcgcgccgtcgccctctctctcctccgtcgccgacgacctccggccggccctcctcgctcgccgggactgtctcccgccccggcgtcgcctcctccggcttcgccgcaccgccgccgaccccgtccaccacctcgccgagctcgccgaccgccggaacgccgtcgtccccgtccacccgagccgcgccgccgccttcctccactccagccgcctctttcgtcgtcgccgtcgacccggggtgagccgtggaccgccgcctcttttcccccttcccttcccctctctcggccgccgctccgccgtgcctatggccgccgccggcgaccataggggcgtgggcgccgcctcccgccggccgcgccgggaggctgccgcgtggggcccggcagtcagccgcccacgtcctcgggtgcggctgatgcgtggggcccacggcgccggccggtgtgagcccgggtgcacccggtccaccgtggaccgtgaggctgccgcgggggcccactcccgtggacccggtccgcgcgcccttccccctcggctgacgcaataaaccattttttaaattaaaatttaaatgaagaaattcgtaaatattcatttaaagagcatataaacttcaaatgggcataacttggccatttgaactcggaattggaccgttcaagtctctaatttttccttaagaagtcaagtacccatttttgtgctttgttcttgcttgttatatggggtttattagagtaaaagcccttttcttttccgttggtcgtgtagacgctgcagcttcgggagatccgctcttcgtggaggttgaagccgacgtttgggaaagcgagcaaggcaagtcacatcatctttgaacatattggatcccactttgtgaaattattttgatttaaattaatgcattaccgctttatttaaattcccgcgttatcactgttttatttagccatgcctatttacctttgttatgaccttattattattgctattgttattattaccttgttcaccctagaataaacaaaaccccaactagtgggcactctattcatggttccactagtataaatttaggtagatgcttcgctggttaattaggcaaactttaggtggttttattaattctagactttgggaatattcatattacttggacattatggaatggttggactattgtggaattggacacacacctccccctctattcaaaaccctcaaaatggttttaggctgggctaggggtgcatttgatagtagcacctcggccacataaggaccggtcttcgggcctatgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcagtcctgcctacctgtcccggaggttccggccgtaggtagggttgggtcggtactcttgtctatggctaggatgggttggaaactatgtcatgtcttccgtccatatgccgtggtggtatgtggcacgtggctgcacgtgaggaagacgtgtcaaaagggggagaagtaatgtgaaaatttttggatgctaagctctttcacattaatgaacataattcctatgcttgatgaaatcattgtcaaaagggggagaagtaatgtgaaagtttttggatttttgggagaagcgaggtgaatttttggagagttgttgagaagagcatgtttttggttcaattgggaatttctttcttttaaaaagggggagaagttttcttttgaatttttgagcacgatgtgtacatttgtacgaagtgtgctttttaccacttttgttttttatttttccaaac

SEQ ID NO: 5235 - DNA, 1872 bp, Oryza sativa
ttattgtgtgcgtatggaatgcggggtcgaatttgaaagaagtccaaatttggtacgttgggttatgtaaagtttctttcttgtactagagggtttcctaaggtgtttaggactcctagtatgagtttggttcgtggctttaggctgcctacctcatgtataaatagagggggagcgtgaggcttcccggtatcgctttagagagcaatagagttgagttttgagctagggtttcgagtttagtcgaaatttttgtaaggagtgctgttggtgcactttgtaaacacagagagaagtaataaagtcgtcatccactttaagagttcttcgatttgtgtttcaccgagtttcggcggtccaaccggcgacatactggctgtcagaccggcggcatacgggcggtcagactggcggcatctactcggtcagaccggcagatcaatctcggtcagaccgatctccatcgatttcaagggtaacttttatttccgctaaaagttttttgtttttgggtataccaacctttcaccccccctctggttggcttaattcttgtgattcgatcctacaagtggtatcagagcttcgttttcttctttggatttttattgatctaaagtttttgccatggctactcccgctaggttttcaactaagcctcatattttcgatggaactgattttcctgattggtgtagtatgatgcaatcttacattatggctgaaaattatgatatttggaggaaagtttctcatccttatgtgattcctgaagcaattaatattgatgctttaaaaactgaatttgaaaataattgcaaagctcgtaatattcttttgagtgggatttctcgtgctgattatgatcgtgttgtacatcttgaaactgctcatgagatttggaattctttgaagaattttcatcaaggaacaaataacataaaagagcatcgtcgagatctttttaaaaatgaatacattaaatttgagatgaaacctggaaaagctttggatgactatctttctaggtttaataaaattttgagtgatcttagatctgctgattcttcttatgatgctaattatccacaatctgagatttctcgtcactttttgaatggtctcgacatgtctatttgggagatgaaagttacatctattcaggagtttgttaacatgtctacgttgactttggattcactttatactaaattgaaaacacatgagatgaatattctttctcgcaaagttgattctaaatcgagtgccttggtttcttcttcttcttctttggatgttgatgcttcttcatctaagtcgttttttcttgctgtttttaatgccacatccgatgatcaactcgaacaaatcgaggaggacgatttagctttggttgctaacagaattgctcgagctatgaataatgccaggaacaggaaaagaggtggtccaaatcgttgctttgaatgtggttcaattgatcatcttcgttcgcattgtcctaagcttgggagaggcaaaagagaagataaagatggtgagaagaccaacaacaacaagcccaacaacaacaagtcgaagggttctaacccaggggggaagatggagaatcttaggaaggcttttcaacaagtttgcgccgctttcgagccactaagtaatgtagatggtgaaagtggagatgatgataagggaaagaacgtctccgatgtttgcttcatggcgcgtggtgaatctgacacagagtatgaagataatgaggagagtgcttttgaggaagctattaatattttgagtgctaaaaataaaaagtgtgggaagatgtataaaaaacaggaatttatcattgaatctcttaaatctgaaatttgt

SEQ ID NO: 5236 - DNA, 1426 bp, Oryza sativa
cacagatgtcaaatgccccattgaaatccttggagctgagaatgacgctgtaacaccaccaagattagtgtaccagtttgttaatgccttgcgccaaagacctgaggtaagttcctgttgattttcattggcacttgatgccaaatgcatcagcatagtcccacggtagacacacacgagaaaaatctcccactgatgatgagaaattgaaagatcatgctggctctatttttctttttgaggcaatattggatctagctaattagtaacattaatgaaaagtccaaacactagcacattgtcaataaacaagtttacaattgtttcttaaacacaaccactcaatgatctttaagaaaagaaacaagttatgaagagcctcttatggattgcatctttgttgcaggttgattactttgccaggatctttccaggagtggctcatggctttgcttgcagatataacgccagcaacccgtttgctgtcagaactgctgaacaatctcttgccttaatgcttgactggtttgagaaacacttgaaatgacaatagctaatcatgcatgtaatgcaaggccagtgcaattgtttatttccatcaaaatacattgctagtgtccatgtatatcctggtgttaagtgaaacttatataaataagcactagtgtaaagtgaaagtatgtgttgaatatggtgcgaagtgaaacaaagtgtactttatgaagtgcaaaatgcaaactctttttgttccgaagcgaccattagcatggcatattaaaacatctgtttgtaggagaacaaaaataatgtgtgcctcagttgccattttaactagtcgatatgttcaatcaaatgttgtatgctactcatcttaagcacagcatatattgggtacctcttgactgtttcttatggccacaaattagacagatgaaagtcgtgcttccaagaaattgctggcccttaaataggatggggacttctcctgaagctgtagaggaaacaaggaattctgattccaaccaaaatggatgggtgatgaaccatttgcgtgcaaaacacagaaaacattcccagtatttcatctcctattgtcctaagtcaacaggcaaaagatgacaaatcatccagccaggttgaacagttaaaaaaactttttttgtttgaaaaaaagctaagatttaatgtcctccagggagttaggcatacctggtctcaccggaagccagtggcgaggttgctgtagatctagccagagctgtgtatcctgcctccgccggatcgtggggatggcatcttcagatgagcatatctccacctcatcctatatatgtgcgctgccacatccagtgccaccccttgggttccatcgaggaggtcaagggagattcatgtgccttaagcttttgacaagggtgaggggcag

SEQ ID NO: 5237 - DNA, 631 bp, Oryza sativa
tggtagacatgataccagcatatttaaacacagttttattagtatcatgtttaatcaaaatctcaccacttctagcaccaacacctaacacaacaggaggatgtctagaattatgagcataaggataaaaccaaaaccacggttatgtgtgctaacctttgattgatccaaaatcatgttgaggttctttttaccatcagaaaatcttagcaaagaatttttcaaataagaaatctctttttccaaattagcacaattttcacaatctaccatgacacctttgcctttacgacatttggggcaagaaagcacttcattgtttttcacaacatcttccatgtactcaacacgacctaaagcatcttttagtttcatcttattcaaattacatgttgagcaatccaaaatatcatgaggttgttttaattttttagcagaaatcatgttaaacatcaaactagcatgaaaagctatttgatatttttgcaacaactttttagttaaaaacaactcatccaaagtgcgtgtgtgcaaagcaaaactgcaagcaagagaagatctatttttcaaatcatgtgcagcattaacatctctaatttttgaaatctcattcattaaaacctcacaattt

SEQ ID NO: 5238 - DNA, 357 bp, Oryza sativa
ggcccgttaacaacgcagcgtaatctataaatagggatcaaatgaaaggtggagataatccaggtgttagataaatacaatagttctcttgttaattaaatgtaggaggtggtgaatgggattacaatttcccgcaggatttggcggattctattgggatctgggggggtgtccggtacttttgtacttacgtttcatgttgcgctcttcctttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccg

SEQ ID NO: 5239 - DNA, 222 bp, Oryza sativa
ttggatatgcttcaagattcgtgcagaccccttaaccctaactcctctcctcctcccccatccagatcgcgccgccaccgctactcctgtctctcgcacgcgattcccagccgccaccgccctaccgcgccgctgcccgcctcgccggctggccagagggcgtcaacggcgccggcgaggcccctcggccagcctcctccccctcgtgcttaccctcctcct

SEQ ID NO: 5240 - DNA, 8782 bp, Oryza sativa
atgagcttggtgacttcttccgacaacgctttcaattcaactcccgcagccgaagccaagcctttcgcgtacgtgctttcctctagtagcttctggttgcgagtctctagttgagcttttacttcaatcagctcacacaccttctgcttcagctcatcaatctcaactgactgaaggacaccccccaaaagaagtaagttaaatgtgcaaaccaaccaagtcatagagaggcagcaccataatgaagagcaagattgcttagaacctcaaatggtacaagcagagatcattttgagtcatatggtgtaaaaataagaagctgcaataaatgtttttgaaatctacagtatgcaaagattatgagatagtgcttgcgtggaagtgcatgatcaatgatttgggataactgcctattggaacagatcagtttaaactgaaaatctgatcctcgctccataacacagggtcaactggccaagataaactttttgatcatactaaaacaatgttttcttcgatgtctgtgttgctgtggggaaatagaagtgtgcatagttgtgagggatacagtgacaatttggtgttaataagctattatatggcaagcagacatagattaactgaggaacttaaattttgaaggaggttctaagtggtctaggttctgatctgttggcccagttatgaaatgaaaggaaggcaaaagaaagaagatagaattaaacctgtggttcttttggcgacgtttcaccagggacctctctaggaactgatagttcttgatcagcatgattatcagtttcatggttaattcctgcattcttctgcatcataatgctatttgacagtgaatccttagcttgaagagtttggtaaagttgctctttcaggtgagcaacctcctcttgtaattccatgcattcagttgtctggcaacaaaagaaattcagagaagcaatacgaactgatttcagttatccaccattcaactttcagcaaaaaaaacaaattgattttctagcacatctaaccttttcattaagttggtcttgtattactctgttatctgctgccttcacctgcaataaaaaaaggggaaaatgaagcttcacagactaaacttgttgtgcgcattcacatgatagaaacaaatgcgctgttctgttcataacaaaccacacaaagctgtatctaattatgcacatgtatagcgaagggacaagaccaatcctgatctgaatttaaaccatcctaagtttgtgaggggagtaacaatttgtttgttcaccatatgttccatgacaatagagtaatattgcacaacaaagggaatactatggatgaaaaaactattacatacaattcgaatattatacagtcaataaaactaattgaaagttgtatattatctagcatagcacaataatctgctaccaaaaattggtgtgctagattcagttgcaataactttggaaggaatcaaggaactagttttaaaaattgggtattggctgataaaaggtttgcggcgatgactcctgttgcatgcaacgtagtggtgataattgagcttgaaacttgataatactggctgtgcatcataaatacctcataggaagtttacagttgataaaattcatatatataagtttctcttctctttttggttcatgactttttaataaacccttgtacaatacacatgaaagactgcaaagtgcacaaactttttcagtacctcgagatcaaaggatttctcgttgagttgctcaagcagttcagcataagactgaaaaaccaataataaaaccatcaaattgtttaatagaatacttggaacaaaacaacatgaactgaagcgaatgcaggatgttaccggagtaagttctaacttgtcagccatcccttgattatttgagatggaatgaggtatctgcctttctaaagacgctatctgatgcttctttcccttaatttcatcattaaccttcttcatttccatcttcatatgtaaagaagatagagtttcaaggtgaaaagcttttagcaacatacgaaactgaatatcaggtaaggtatagagtacctgaatcttctcattatttgggctccttccagcttcctcggtaaggcgctttaggacacttgtatgaagtgcaacctcccctgacaaaatcttcaattgctctctcagtaagtcaacgtgatctattgtttttctgctggcctgtcaacatatcacgtatcaaaatatgccaaaaagaagtccatagtaagacatcatgctgtttatattacatcactaggatttgcaactatattaatcttctacctgtgtctataaagaagtccacactagtaaatatttgagcggtttagttgtcttggtaatgctaaaaatgtatcatgtaccccacaccatgtgccatccatgtatagcacttcaaaatttaaattatgctcttagttaatacacgttagccaacaaaatatactacaacaaacaaacttcagctgttggctatgagttcaaaaataacacattataaaccagtaagccaatcatgactcattagtcgatcaaagattgtttaaaagtggattgctggtttaaaactttaactaagtcatccttttctgctttagatgtatttgtttagctgatatttcacatccgacaaatttcggcctttaattaccaacaatgcatgttacctaccagaggtgtttcttctccatgaaggctgtcagtagcgaactccccatggccaatgctaaagagatcaaccgatgcactctcaccaaccaaagaatttgatattcttggttcggaaggaaaattaacactctccccaataggtgttgaaggagcagttgatttagtcaaactggacttgtcaccttctgaacttgtcagaatagaagctccaccttcacgtttctggacaatagaaccatgggaaaatgttcgtgtgaatcaattattatttcaattttaaaatcaggattggtgcacatgagttcatctatattgtaacaattcatgacgattgcacttgcatctatgtaaaagataaatcaaaagaattgaataaatggactattaagaattgcccaatttaactatacccgaagtttaaaccaattaagaattcctttccgattctttttctcctccttcgaatcttcaagtgtcatgccaagtccttcaacaggagaaagtaattcattgctttcattatccaacacgatatcacgtcttttgtaaggtaggtacgcaagctgcaatttgaacaagcaaactttatcatacaggaagttacccatactaactataatgaggaaaaaaataaagtagtaactcaaattttctgcaaacacactaaaacagagtctgccgatttattgccaaaagtatctcagtaacaaaagcaaactacattatcgaaaaaacaaaagcaaactaaggtcaaagtgtaacatgtgtttgacatcataaccatacctcctcttccccaaaagaatgtcttcttcttggtccaggatgtggagaaaatctagaagtttgtgtcgccttagtggagaccaagataagctttgtgagacgctgtatccttgcaagcaaagcagctttagcttcctcctcttgttcgagcctagactgcagcttgacgttaccatcttctagcttttcatatgataaacaaactccagttaggatgatacattcatacaccggcaaagtgaacatgcaacattatataacttgtaagtataatattattaatctacagcacagttcaagcagacaggagtagctgaagacaaatctgtaaacaactcagttaatagcatagcagatctcgcatacatacagttaagcataatgtgagcagcaaaggggcaattgctataagacaataaatattccaccttttgtttccaaaggatgatattatcttctccggcatccttcactggagtgccagtaataatacccattttcagctgttctagttcttcctttaatctgcgaatctcattctggtatttctttattaaagatttttcatctataatctgcccaacataaagaaagattcaggagaatatgtcagaaatacttcatatgatatttggcacaaaaataatggttaagaattcctgctaacataacctactttgttttgtgatgcttggacctcaatgcgttttgcacggtgggcaaatttcagtgtattatgagtctcttctgagttgctcgatgctggagtcactgtacagatcagctgcaaagtataatagaatgaagttgtcagacatccaaatcacattgaatattaaaagaaatacattagctttaaccaccatcccaactgataatgaacaacttactgaaacacgtccttgaccactcaaggatgactgaagtagacgtgttagttttgaatcacgaaatggaatatgtgtagcttttccgtcagtaagtttcgatatcacctggaatacaaaagggaaaaaagcttcttaacttccaacctatgatgataacctctataacagatttcatggatcatgacttgcggcattattttatatgtaaattgaattcatttaactggataataaatgcaaacatatcaacagaaagtcaagcagtgcaacagaacacattggaacttggaacatattatgtcgaatgaatagcaaaacagatacaaccacccattatgccaggatgcaaagatcttctgatgtacagccaatgactggacagtaatcatgagacttacagttccaagtgttagcaagcttttattgatataagatccttctttccggcgtactccagtagtttctgcccttgagctctcggaacctgccagatcgatgaggttctgcaaatgagtgagacaactaaataatcaatacatgattttggcagtatggtcaagagataactgaaaacctaaaacccaccagttgtgagaaggtaactgcctcgccttcattagactcaccacaagggctgctctctacagtctgtcagataacaaaacgaaatgaaaagggagaaggaccatatcctgatatctaatgttcttccactagtgagaagtatattttgcatgcaatttataatcttgcaatacagcagtgcaaaggaaatatcaatgtttcgaagttatataaagatatctaaaaggattaccagtgtgaaaattgtatgacttctgctactaagtagattgaagttagtggatccaacatgtctatgctctgcaaaggaaatatgaaggatctccattagtgaaagaaaactttaaaccatgatcatttttattactcacgatcctgataggttgcttctgcaaataactaaatgttaatcatgctaaaaatgaatggcacagctggaatagtgaacaagttgaaagattctaaaagatggtaatcacaagaagaccttctccagcagcaatgagggatagggcatgtgcaggagataatactacttcttctttgataccctcaacaaatgttccctgaaaaagtaaatgtagatgaaggaactatcagtcaactgtataaaaatgatgctttaaattcattcaaaattctataaagtttaagaatgaacttcaaagcatgctactatatggggtatgaagtatcaaaagatacatttcccacacaggggaacaaatgaacaatgcatggcaccattgtctctaatgactaagcacatgcatgacaatgtttacacttaactttacactgtttttttactctacacatttgaagaacaagacatagccatattaagtgaaaatgcacatgttacctgaggatcctctctaattcgtaagttctgtccagctggattgagcagatcattgacaacctagattcaacgaacccttaattagagcagcacaaaacatgaatatgtgaacgatgcaatgatacaaatatgattgcaatgacaaacctcattgtaaatttccaagtatgatacacggagaagaaactcgcgatttggtgtctacaatggtcagacagtgacataagtgtacagtgcataattgcatgttagtttatttgtatatacatgatgggtccatgtttaaaattacctcttgtataatgctaaatgcgtctttgacagccaaaggtatgatccctggggatctttgatctccctggcccaaaagaacatgtgcatcaagatatagatgaacatttgaaatataaaggaaccaacctatattgcacaatataagcctagccacatataaaaacgaaaagtaaacttcaacatgagtaaattgcaaataatatgctgcagatgggaaatggaagctgcctatctctgtgaatggtaaccacaatacatttaaaaaattacatggtgataatatcatattatcagtagcatttaacatgtgacactttgattccctgtcttatttgctggacttgggacttagagagggtcagataaggctgagtttttattagaaaagaggaacacataaccaacaagcagttataataacttgactgcttcgttttttttttcctggatgcacaatatggttatactctgaagccagtaaaatctatgattaaaagattaatagaaacatgaagctgtaagtgttctcacatgcattgtgtgggtcttcccgctgcttgtaacaccatatgcaaatattgtacctgtggcaataaaaaacagaaacatttatacatcaatctttgcttgaaaccaaaaaaaaaaaagaatccaccaccacattctatcaatgaatggtgtgcaacaataaatagcttatgaaccaaaccgcatatatctgtatcgctataatgtttagaagatatctcatagccatagtatcatggcattctgtaaatacaacccaagcctttcttttcttgaaaagttagcttgaaacagtaaacaagctgttatcatggccctatataaggatagtaaagatcaattaccatttactccctccatggcaccgctgacaacatgttgagcagcaacatcatatacctgacgggttgtagtagttggtgcaaaaacccgatctgaacagcatactatattagtctctgatcaagtaaatttgaagggggataaaacaatatactgatagccttagaatagccccttaaataatattctctcttttcatgagatggcatacatactcgcttgactagctcattttatagaagaatatattgtttttcattcataggctagtatatggaaacaaggtatgcagaaactcttttattccaaacaacaattttggtgccttaaccagaaaatgtcaacaactgattcccaaaaatggagagtattgtgcaaagttatatatgttaaagtaaactattgaagtccttcacgcatctgtacatgtgtcgattcacatttttataagaaaaattatgaataagactccgttccattaacatgacatactgccagtgcaaaacctcttataattagcacaactctagcaagtccaacagtgatgagccattgaagtacaaactcaatattcgtttgtacatgaatagaacaagttatattaccatgttaacacttgtttttacaaatagcctgtatggagccacagaatacaaatcagcgtacagattatgtgttagtacaggaacagcaggtctgcaaacataatttactcccaagtgtcccagtacaccagttggcaaaactactatattgaaatgagaaataaatataattgatgaagtgatattgagaatcccaacaagtaaaccgaacacttagcagaattgagcataatcttttaggcctttctttctattgcactgctaagaacagctgtaggtccaagtcgcaatacagatttgagaagcatttccgggacactaatttgagtgatacaatcaaactggcacgagataatttcaggcatccaaggtacccacaaaaaaacaaggaagtatcacgttcacagaactccttctagaatctagatataggctagaggactcacaccaatctcacctaatactccagccttatgagaacagcgatcgtttggacagaactcaactaaattcgcatatgccaaacgaggtgatgatcagaattcagccagcagagcgccaatgtcaatgccaccaaaagcaggcacgtaccgtaagcataagcaacgctgggattctgctcgctcctcacgaccgtgtcgccgtccgcataccatgccacctcctccccttgccgaatctcgcgggggcttcacaagcgaaaaccaaaacccaaatcaaactgcattcccccaaaatccaagcgcgaccaaacgaaacaccaccaccaccataagcaaagcgagacgaacctcagcggccggaaacggacggtgacggtgacattctccttgggcgccgggtcctcgtcaagcccggcgaacagcggcgacgcgggcccgtcgagcgagagctccggcgtgagccgcgacgaggacgtggtggtggtcgtcgtcgacgtcggcgaccccgactgcggtatcggcagttgctgctgctgctgctgctgcggctgcggcgaactcctcaccaccgccaccgccgccgccgccgaagacgccctccgctgccgcgaagccggccgcgtcgccattgcctccacagcccgagatctagcagcacgcggcggcaccaccaccaccacccgccattggatccaatccaagtatccaccaagctaatcgccccc

SEQ ID NO: 5241 - DNA, 5649 bp, Oryza sativa
cgggatttttcctagggctcccctttttcctttccgtctggctcactcccccccttcactcgtgggtggcggctttcggatggctttcgcactcacgcctttttgcttccgtcggaagcgatgcgggaggaagaggaggaggaggaggacgcggacgccgctgcaaaatgtagaagaaaagaaatcctccctctctccccctctctctctctctctctcttctctccaactggctcttttggtgggtttattacgccacgggagggagcaggacggggtgggtgggtggggaagaggaggctgacaggtggggagggcgctgatgggtccacatgtaggtgagtggatgttgactcgtcggagtcactggggtaggggtttccgtggattttgattggttgtgggcgttggggtggtacggaacggaaggagaggcctctctcttctcttccaactgttgcgtagggggaggcgacggtttactccggtttgatgatgatcatctagcgagattgctgtttttcgagtcagtggtctcattaagaaaacgtactagcaagtttatcatggtagagtagtagtagactagtagtttgatgaatcaaataatgtagtactaccaaaaatatggtagtactatcataagccttgttttgcaaaatttcataggaatttaatctggccctgctcggctgtcatgttggcagctgtgacaggcccattacctgtttcaccccaaaattaagacgtgtgatgcgaacgttaattcttcactttaaatgcacaatggcgatggttgtttctgtaagtcgctgttagtagatcgcactgttatggtggtggttgcggttgtgctggacgagtggactcctggaccagtaacatcattctccctcacagccaatcgatactccttttgcgcccatttctagttggtgcaataatctccatatatgggaacctaatacatatgctcctctcttaatgcgtcacttacactgtggcacaccgaaaataacacctcttgtcccgtatccaggcaccacgcgccgatcccatctcctgtacccatcagcgttgtctttgtcgcgcgcgtacgtagctagagtagtagctacggcctacggcctgggcgcgtcgcgcaccagcgcgagcgggcgcgggcagacaggacgaacgtatcacggcgcgcggtcccggttggatggatcccgccgatcgagcgacaacagtgccaggcgcgccgcgcgcccgcgcgtcccgtccccccatcatccgtgtgcccgcgcggccggtcgttttccaacagcgcggcgctagctcggccgcatcccccggcgcccggtcctcgccatcacacgcccgcgtcggggcacgggaccgcgcgccaagcgccaaacgcgcgtgctccgagggcgtttgcaaatgcaaatatgcaacaacgcccgtgagccgccgtgtggccggcgagtgctcggcgctcgccaccaccatggcaccataggcggacgaccttcccgggcgtcacagacggagcacgggcaagagacaaacccgaccttcccaggtggctcgatcgtctcacagacggaacacgggaagcgacaagtcgacaacccggggcgccactgtttgggatacaaattatatgatgctgcagctcgcagctctctgcaggtgcgtgctgctactgtgctcggtcctctggtgccggatttctttcgagagaaaatgccgtggaaatggaatagtttccgtcacttcggtcagctgagttgcacactcgcaccacatgcgttcgcccagtttgttttgactactggacaatggacatggcgatttggcgagaccgtcagtagtggccgacgtatagtagtactagtagacgagacgcacatggctcaacgtgacaaaggcaacgagtgctagctgcttgttgcactggttcagtaagaaaaacgaagtcaaatatgatttgaagtgtattaaactcctccgtgtaagctcgtagtctaatggactatcccatcatggaaatgagtggacatggtgcccttggacgtacgcagtagcttggatggtatagagtactacggtatgattatgtcctgcacttagcatagattcgattcgcaggtggagcaattagggcacccacaatggttatctataagctatctacaagagatccatgtcagcatattttcctacttgaaagatattaaatgaagagagagagcaaagctatctactagcttagagatagtctatagagaaaaacgagacagtgcatgagagagctatagatacctatgtagacatactattgaggtggtttactattaatctagtctattgctgagatgtacatgttttatagagagcaccatactttaccattgcgggtgctcttagcatgctactataagatgattgtcaggattctattgtcatcattagggctcatgctctgctccatttcttttacagctaggagatgctctgcaaccttggactgactagtgttttttcctgaatgtcctaaattgcaggcaattgaaaaagaaatttcttgtcagggatcagaattcagaagtactccatccgattatctgaacttgtttcagggaaaaacaaacttagaagcatgaactagcagaacctgccatcgtcacactatctgtattttagtaggaggaccgctcaggctactcctacttcacaagtcctttgcagcacatctccagaagatgcagtcatccaatgagacatacgcctgaaatagtagcccatgcaccaaacaaaaatctgcgtgattgagacacttaatcgcgtgcaacgacgagaaagaaaccgattaaaaatactgagtagctgggctggtgattcatctgcctttgtttactggcataatgccattccgctccaaggcaggcagggtcctaccagactatcaaccatcgagattaagataatcgattccttgcaccttacagaataataattgtccggtcgcatgcctgctctcccagaataatacaccactaacattacgaatcattagccatggaaaagctctcagacaagacaaaaagacccaatccataccgtataaattataatcatattccagtgatcaattcatccactgcaagcactattcagtcttcacacaaacaaaaggaaacgaaaacgataactccggagacgtcgaagcgaggggtgaattgactgttgttgccttatcaggtgtgtgtatagtgtatactcctgtgagaggaagcgtgacttgtgcgtgccgccgacaggagcccagtgccctccctcgtttgcttgcaaccacggcgggtctgacgagctgatgggcacgcgagacccatcgagaacgtgacggcaacaacaacagcaacaaccaactatttaagccaggctgttgctgtcgagcgcgacttgcgttgcatcgcgggcagcatccatgctctctgtgccacgacaacgcgacggcgaaagctgcactggatctctctctccaacatgcgacagatcgccgcaacggcgtacaacgtgcgaaggcacggcagcgaacggaagtgcgacgaaagcgaaaaggggcctcacgggccaaggggccgaaacgcgcgacaccggtgtggatttggagcaatggcccagtatgcgttggcgactccggagctccaaacttgggccgagttgctaggcctggagagcccaagacgaactggaggaggaggaatgcaacgttgtgggcttggtaggccatgaagtggataccgttctttctgaccgggcaatcaatctataacgtgggcttgttgcgtctaaaaattgtgaaagtctggtgtgtcgatagtagatcgatggttacctctcgataattcctatgatggaacatttatatttctatttataaattcagtctataactgcgaatgcgaattcgtagacttatcttggaaaaatactatcctgacattgcaagtctgttggactttgcaaatatatccatcacaagggagaaagaagagactggtttctctgggcataattagcgagatgaccaaggtggcggtgaaaagggcaacaggcaagcctagtaggaaaaaaaaacggacagacggttaaaaccaaaaaaccagaatcagcatccttgacggttttgttcgctcacaagaccgtccctgtaattgatccagagtgaaatggttgaatggtctagcttttcatactatgatggcaaggtagtggtggtgctaccgtggccatcaacggatccagaaatttgatacatcggtattataatatgttgattgtgcttaaaccgtggtgttatcttctacaaaataagtattttagtagtaggtttgccaaaaatcgtgggcgtcacttgaccataactattacactgcagatccacccctggcattgggggtcaaaggaggtagtgggtaaggttgaagatggaggcttaaaatctgaagtggttagtcagtggagctgttgaaaacaaggaagaaggtgaggcgggggcatgccgttgccgctcggaggagaggcggttgggttagggggaggggagtagggcactagggcaggtcccaccaatggtgacggttgagtagaactatagaggaggatggcatgagtgttgcaatctaagataaggagtggctgacatacctcaaagggaaggagaggagatcgagaataagttttcatattaatgtagcagcacgaatcttttgatgcgatgaaccgtccaaaataattaaatgacaaaaaattatgggtattttcatgtgacaaaagctaaacacccaagtagaataacatataggactacatatttgtgatttactttggtacacgttttgtgtacacgcatgtgtttgtttgggtgggggtgttatatttttgtcgttaggtaggagtacttgtgagtggtgagctgatgatgctatatgcagtgtccctgtgtcagcacgagtggaccacgcagctgtcacgaacataggagtatgagactgagatgcagcaaaaccttttctagcattacatggtgagcaaccagtaaacccagcttttctttctactagtggagatgttaccacgcagcgatgcaccccgaaggagcaatgttgaagctataggttcgttgtttgcccctgcgccgctctgagcactgtgtatggcgcagtgaatcatcaccgctctgccctagctcagaattgtttctcgtgtcagattgattgtacttgtacagttataatctcgtccctttcctggcaacaccaagtacagccaacactgctggtcaatagattctcctattgtcgtcgttcattcataaaaacaacgaagtcctaagacctagctaggctacaacctctgattatatatggctctatcatatgacatgcgtatccaaatgcacctaacttcaataatgatgatcaggcctttatatagtatatttatgcggctaaattcgtctgtcgcttttcgcatcagcaagtaattaacagttcacagagatatatcgatcgcgttgaaacactggtactctctccgtcccaaaaaaaagacaaaccctggtttccgtgtccaacgtttgaccggccgtcttatttg

SEQ ID NO: 5242 - DNA, 8076 bp, Oryza sativa
ggacggagggagtatcttgctagaaaaagttcatgcatgttgacgtcgaaagattgagagatcagcgggtagaatctttcagtcaccgtactgtgacagattcatgatctaaaatgatgcatgcacgatgcatgatgcaggtctggggataatattacgaccatatactacttcatactgttagtatatatgagtagtgcatttcaattaacagtatgaagttaaaattccccggagaagccaatcattttctgcttaacgacgtcccaccctatgcaaacatacaattcatatcttgatgggcagtactgcagtgggtacccatgattttcaccttaaaaaccgtgccaatcacagcatgcatgcaaatggagaccagatcattcattagggcggatgcatatgcatgcatctcgtgtcagatcggtaggtcgatcgatccatatgcatcgatcgatctgctgcagccagtaagtatatatagcctgcccccaccgcattgcatcatccagtcggagtacgtaggcagcagcagccgatctgtctccgattggcgccggccggccgcctgcccgcctcggcccggcccatgtctgctgccttggtgtcggaagcagagcttcgctcgcgtcgtcgtcgtcgtcagctagcaactgatcaacagttgcgctagctgcaacgtacgacgagcgcgatgagatgagcaaactcgccgtacgttacagctagcgtctcgtactgctccggccagcgcgcggccggccggctgcccggatcggagtaccaccaactctcgcccactcgcattccgatgcggttaaggctgcacatgctagcgcgcgcgcccggtacgtatagtagtacagtacatgcttacaaacagcggcaagaacgaagagcaaagaaatctgagaaagatcaatgcgtcgtcgtcgtggtggtgcaggggaagcacatggattgaatcagtatatagccttagctgctgaggcgaagacgcgaggtgagatcgtgatcagatcggtgatgagtgggcggcagtagctgaactactggccgatctgtgcatctacatggcttcgctctgctgggcacaagtacagctgcatgctgcatgcgcgcgtcttctctgggcgctggtcctgcattcatgcatgcccggcaaccactgcatgcgacgcggtggtggtggtggtggtggtggtactgactactggctgctgctgttgccttctgctggagctggacgcatatgtcatatgtgcatgcagtactaccaccgctgcagagcaaaccaattggcatgattcagtgccccctatttagatctgtggagagtctcttgatgctgtgtgtagtagtactgatcatcgctgcatgcaccttgctggccagcagtgacctgtagctttctatagcttcggtgtgtgtatgatcctatatatcgtgcgtcatgacatagcagtatatagaaatagttagctgcatctggcagcagcatcagcttgatagctagtatgcggtgcgcgcaggcctatcgccgatctcattgtttgtctctgtccttggcctgctttcttgcttgcctctcctctccccctcaaaattgcatattgtgcttttctgtacatgggacatccatgcatagagcgcagatcagttctctctgctcttctttatttgtaatggaatgataattgaggtgtttttcgccggagaaattaatcatcaattccgcatgcatgttccagtttctgtccctaagaccaaactttattgccaaaccagtgactttgtatctgaatgttgtctgtcctgatgcgttttaattatctatggctatagtatacacatctgaaagaacaaaatggttgcataataagtagttgagagcatgcatgaattgacggagatgatcgacttcggctttttttgcagcatctctttgagctttgctggctagctcagtaccggcttccggcacagcatgcatgcagccgtgcatattggagtaaaagcatactataggagtaaaattaataacgatcgaagcactgcagactatgtcaggctgctgtgccaccaaatgacgacaagaacgtcgaccgaaattgaatttcgtaaagtacgggggccgtacgatgatcgatgtgcaatgcaatgcaatgatctattagctgttctgaaaattcatgacgtgtggccggtggttacatatgtacttgatgagattaattcaggctatttaatcaaactatgtacacgtacaccacgaggaaatccgtggttttgtgatctcaattacgtacgcgtatagatggtcagtagatccagtaaatgtttgtactgtactgtgtgttcctaggctattagcccagaatgtttatgtatgacaggctgcattttctcccgatgtattgattagacttagaagtagtactagctaatggaattagcagctggtcgtacgtacatgtgtaagtacatctcatgtctcgatttatatggcgctgaatgattatcatctatagtagttcatatttcttcatgacatttgagacccagaacttttttttatactagaaaaatgatgagctaatcacacagtagcgcattccattttttattttacgggtccaattttctgtctcggaccctgtgaatactctttattgattctttttcctcctctatcaatataaagtggtaaagcttttgcttttccttaaaaaaattattgttcactaatatgatgctagctactatacttttgtcccattaattcgatcatcgcgcaggggtataaacaaacggaaagttatcctccgggattgtctattagggtttagctaggtagaaaaatcagactgactaaaattctatggagaggtgggtcaataccgtaacgtaactagtcgccaatctatatattgcacagactattatatatactgatactacaaataataaaattctaaagttatgctaaacatgttgattacctttttgaattattgtagctacttatattaaaagaacaagtcacatatcagtttcaacttactaattaatttaattttgaactttagttagaatatattaacttaataaaataataaaatagagattgcaatctaggtaccatatcacatatattaattacaaatttttagattattaaattagagccatgctattttcaattgcacaatttattaaacatgtactatgcatggtcacgataattaatacgatgcatcaaatcaatggccagagtttatggttaatatgagagctttcttgaattatccagttagtccatgagaccatagggaaatcattactagctagttaaaacaaatcatatgtgtgctatgaaattcttttctatgtgcgcttttaatttatgaaaatcaattaatacaccctcatgtccgtacaatattaattgcacgaggaacaattgtattttgcattttaatttcttgttatatatcagcagccttttccttcacgtgccaatctgccatcagtaaattattatattactgatcatctataagaggaaggccagaaagtacatgaaatacacctggctttggcagatggagcacatgctcaaaagagccatctctgaacaaagcaattcagatggacgtataattgggccatggggtggaggaaaagaaaggtcatgtacactatatacatacgggcccatgtacgacagtgttggatccacacattttcaatctactgctgcgtgctggaaccgttcttccacacacatgcatacatttctgtgggtaaattaattattcctgtttattcaagcaaattaattaatttaatttcctgtttattcaagcaaattaattaatggactagttttttcttctgtgttttctttgacttttcaagccaatattgatatccataacaagtgcatcttttgccgttttggaattgattttttttaactgatctttgcaattcgaaggattttctttttctttgcctggtaaaaataaagtggcaacacaagctaggtagctagctaaacttggatccggacaaggcaaaaagagtagattatttaagctatgagaattaacataccctttcttgcgactgctaatccacaagaagaaaacctaattagacatggattacaaatggaggtccaagctgacaccctccttctgccccaattcacacctacctagcatctccggcgacgtcgacgagcacgacgacaacgaaggcgacgaggacagcaagctcatcggcaccatctcgtccttgcatgccacctcccccgccgccggcgtgcccgccaccgtagtagccagcttgtcagcgccctgcctgccggccgtgctgccgaaattctccgtcggcggcggcacgctccacagcccggcctgcacggggctaccgttgatgggctgcgccatggaacctggcccggcgaaggcgcccggggcggcgctcgtccacatcgggtagtgcgccggcggtggcggcggcggcggcggcggcgggtggtggtcgaagcggccgccgatgtggtggtggtagttgaagaggccgtacatgtgccccggcatgtagcggtgcatggcgagggaggcctggaggtgagctcgcttggcgtgctgccgctccctcttgtgcgcgttctggtggccgcccagcgcctgcgacgtcgggaagttgcggcagcagtagtggcactcgaacttgcgctccgccgccgccgtcgcggcgccgccgttcttggtgccgccgtcgccgccgttgctgccctctgacgtgaccgtgctgccgttggccgcgtcgggggagcctgcaccggcctccgtgggccgcagctgcaggtcgttggagaattcgcagccgaacagccggattgtgtcccgcgcctgctgctgcggcggcggcgccggccggatgaacggcagctgcgagaacgagtcgacgctgcgcatgtcctgcggcttcgccatggccgtctaaccaaccaaccaagctatctgcttctacgtgaaccaaaaccaagaattaaccacccaactcggggcaattcttgctagctgctgctatatcttgcgtctccgcgctgaagaaattggctacgagttggtgtggttttaaggggatatgggagttgtaagctggggcggaggagagggggacgaagagggggaccatgcaagaagtaagagcagagggggactaccaagcttaaagctcccccctctctcatcaccaagtacaaatgcagctgcagtggcagttgctgttgctgcttgtgccctccctgcctagctaagctactgctagtgcaagctatcgcctcatcagtctcacacacaatgacacaaaacattaaccccggcccatttctttcttggcaaatatgggactagtacatatacgtactcacacaagtgcagctatagctagactggttaggtatagctagctacagagagaaattaaaatctggtagtgtttattttctttcaaacttctaaaaattctaacacatcagatgcttaacacatgtatggagcattaatgtggacgaaaaaaaccaattgcatactttacatgtaaattgcgagacgaatcttttaagcctaattacgcgatgatttgacaatgtgatgctacagtaaaatttgctaatgatggattaattaggcttaataaatttatctcgcagtttacatacggaatttgtaatttattttattattagtctacgtttaatacttcaaatatatgtccgtatactttaaaaaagtttagcacacgaactaaacacggtctctctgatgatttttttttttgccctgtccagctttcatgcatctgtagctatcagtgggcatcaagtggggggagatgggtagtgtgactccgtctatccgtcgctctctccctcccctctgctgcctctgggattggctgtagccgggggttctttatgggaggttggcttctttacaacatgagagaccgcaggtggtcctcctggggacggcgacgtgctcgatcgcattctgcttgcttgcttgcttgcttgcaatattgctctctccctccctgttcatgctgctgctcctgttgctgcagatgcatgattactgcatgccggccggccggtagtgcagcagtcatgcatgcatcgtttgcatgcgagtttttatctctttatagctttgcgcggtggtactgctgctaccatcgtttgtagatcgatcgatcgatgttctatggatggcatggcatggcagcaagctgcttcaattcgttcgtttctctccgtttctccgcctgtcgatcgatatggtggtatctttttgacagcgcggttataataatcgtgggcgcgcgtacgtacgtgttcgatcgatggcgcgcgctgcgtcgatagctgggatccacatgcatgcttgattgctggatcgaaagctagctaattgagatagccagctgagtgctgcagttttgagatcatgtcgatctctacatacactccatggctgctacagtagcttttttttcccctcctctctttttctgcaggcttttgtagaccttttctttttacggaattccatgcatgcattcagcgatttttcgcctgcttgttgtagtagtgatatggaaaaagggtaatttcattggagttgtttcagagagatactacgtgaaaagttgtcaatgtcagtaactcactctcctccaggacgtctggtttcatatggcttctgaattaatgacccctatctaccacaaatggaattggccgtagttgagacttgagagatatactactgtcgttgttgtccatctagctagctagctgttcgagtagaaaaccaaacatctcctacacaggtagtatagatcagtcgatccagtctctccaacttgtgatgaacattaatgctcgataggacaagaaaacattttcaagcctcatgggcgcgtaaggccgtagagtgaccgtgtgccaaccgcgatgctatttgaacttgtgttatctctttaagaggtactcgtctggataagtacatcgccaacatcgaaacagtgcacgcatgtgtctctcgacaagtacataatgatgacaccaatgaaatctccatcttaatttcatctgtggtacagacatcgcatatgcatgtcttttttttctttttttaatttcttcatgtccatgaattaagattgtttgtgttacaatatttctactgcctaaattaacggcggctcccaggatagagggacacatggaaaagctgagtgaaaacgcaagctcgactgggactcatgatctcagtaacattttctgacacttacgtgtatgacagatatcaatatcgaccagaacgagctcatcctaatcataatgaccactcagagatccacgtttatttcaagttgagaaatcgttccaaatgatcaaaattccttactacgatttggacagtttttcactggtttaattaacctggcgcaaaaacgaagaataatcaaggaaggaccaccgtgtagctgtcagtagtatgagagccatctatctgaaaacacgaaaatgggaacgctcagagaaaataggagtagaaacaaagcgttgatgcgacacgcaaaagtagcaacatttatgtacatcgacgtgcatctggtcatcagtactcatatgccctgcttgttgctgccttgcttttcttttttttcttctctgcccctgtactggtacatgtcgtcgtacgagttagctagcgggcaacagttgtagccacagcttcgccgacggcgactccgaacccctgcaggtgcaggtgggtgcacgccgctttcacggcgacgtcgcggccgcgcgctcgccactcgacctgccggtcgcgccagatctcgcaggcgtcgccaaatattctcgacatggacttccatttgtgtgttgtagtagtatcatcgatccatcgatcgattgtctcacgcgtttttcaccttttgccccctctccttgtccaaattgacaccgtgttcagttccaaa

SEQ ID NO: 5243 - DNA, 4887 bp, Oryza sativa
aacttttaattttaacgtgaactaaacacaccgtgaataagcttcttcttctccttctcatcaggttgcagtaatttattggcagatccaactcccccgatccatccaccacacagttttcctcgtaaatgccgtggccgtacgatagatatattgatggtaggctcgagctagccgtcgataagacacaaacgcttgtcaggctggaaaggatttgacagggaaaaggtacgggtacttggtgcaaataattccgtgccggttaggctgctgttattaccgtgggcaagtttctcacccacgcacacaccgatcgaccgatggatccgtacacttttgcacgcgtgagccgtgtggaaaagtcgactcgcagcgggcagagacgacggtgcggccgcggcggcggtagcatcagcaacgtgatggtcgtcgtaactgccggaaaaggacgccgcttgcatgttattttcggtaggaagcgatcgagatcagcgcgagacgagagctagctagctgcaattctgcggctctgcccaacccaaccatgcgaattgcagtgcatcatcaccgatcgctcgctcgctgtctctctcgctctccttttcgctttcgctgcttccaacgaggggcaaagcacgcatatggatgtgcaggtacggagacgactagtatgcatgctggtatacgtgcttttcaccgcgctagctagctaactctagttgcaggacatgacagccttaccactgctcgaccagagtactacctcccctctctcccacaatagttgtcactttgacttttttttaatatttaatcattcgttttatttgtaaaattagtgcaaatataaaaaaaaataagtcacttaaagtacttttgataataaaacaagtcataaataaaataaataataatttcaaatttttttaataagacgaatgatcaaattttacaaacaaaaactaaaagcgacaagtaatatgggacggaggtagtactctcttcacattttgttttggatttttggtgggaggctagttggttggagaactacctcatatcaggtactacataccaaggatatggatattcatctcttgagatgatatccctcgttacttacatgtcacctaaatagttataaagaatacgaaaacacgataacatagtgacggagcgtggggctcctcaccgggagaccgcgcaggcccccctttgccggttcggccgggggccctgggtgagattctaagctcctagtctgtgtgtggaaggttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttttctccttttctctttttttctaagtgggcaaggtcctccttttatatctcaaggggataccacatgcaccatctctccctctctttcttttgtgtggggactcatcctctcttccctccaacttgactcctcttcattaatggacggagatttgtatggctgccgtccgaatgaccttctgatgggacggcccatacctacctccacttccgtcggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccgggaccaacgtgccatctccaggagctaacacgccggctccggctagggacgagtgcttggaggctctcatcctgacgggatggggcgaggcgtgcgtcagaccgcctgtcgccatctaacccacgatctgatcggtctgtgactggtcactgaccggataaacaagcgcgctgcactgcgttacatgcggcgtgacgcgctcgtccaaaccgcaataaatgtggttaggtgagccccgctatgctcacctacccaatatacgcggcgcaaaacccacaaggggtcggtgcgcctcggccctcggggccgagacgggagcggtccgacccctcggggagacaaagagaagggcggccgtatcacccttgggcccgaccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgtgagaaacgaggagccgggcacaacgttggcaagggtataaagtcgccgaggaagagatttgcttccttcctctcgccattattccccttgtcttcgccgcttgcgccctaactccttatttcctgtgccctaccttcgccacacgcgctcgctctcaaacatctcttcttccggcgtcatggcacggggctccgctccgcttgacggtagcgtgctgccgccttcccgcatcgtgagcgagagacaggccggtctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatctcttcggctgttccggtggttcttcaccgtacagccggtgtcgccgccgtcagtgattggtggttgctacttccagccgcgggggccggtgctgaaccgctacattccctgcgtcttccgcaagaagtgggatgactggaagagcgactggttctacacccccctcgccgacgaagcgcgcctccgacttccgagccagcctccagcgcaggcctccaactggcgggcgccgatagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccggggggtcaaatgggactgggctcctgaggacttcaagatagtggtccaacgggtgctgaatctcagctccgtggaggcatccctcattcctcaaggagtcctccccctctgcagcgatccagatcgcgccaacatcctgaccatcatgcaggcggtaggggtgtcggaggagcgggctcctcgaggccacgatggcacgggcgggagccgcaggggggaacaatctaccccgggagggggtcgtgcttctgggccccgcgacgggggcccggggagcggccgccctgccgacgcccgggggaagaggaagcaggaaggaacccctcccccgtctcctccccgagggggcggggcggcgcgtgccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacagaggctcggaggcgggaatctgaccggcgagaagccgtggatcgcctacgggaagccgaggaggccgcccaggtggccgtccgagctcgccaagctgaagaagccgctcgggaggaggccagacttcgccaggccgaggcgacgacatcctccgaggcgacctgtgaaactgaccggcaagaggccgcggatcgccttcgagaagccgaggaagctgctcaggtggccgtccgagctcgccaagctgaagaagccgctcgggaggaggccagacttcgccaggccgaggcgacgacgacttccgaagcagctcgcgacgaggccgcgggcgcatcgcttgggcccactccctcgtgcgacgctcaggacaaaccaggtccgggggacatccccgagtccggcacgtccatcggcgggccaagccgcgcggcatcctcttcgaggcggctcttccccacgccttccgttgctccactgagcgcagaaccccttctgcaggccttggccgtcgcaaacaccacggtgttggacgggttaagtgcccagatggaggccttgcaagcagagcgggtggagctcgacgccgcatgggcatgtgtcgaagaggggtgtcgctcggtggaggccatggtggaggtgggccgcaaggcacaccgccggcacgtctcagagctcgaagcccgtcggaaggtgctgggggagatcgccaag

SEQ ID NO: 5244 - DNA, 7781 bp, Oryza sativa
  unsure (1)..(7781): unsure at all n locations
gggccgctgagctcgaggcgcgggagaaggagctggacgcgagggcgcgcagtggcggggcgggcgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagaccgtgccggccggcaggcgggcctctggggcgggcggactgcgaagtacgccgccaaccaggggggcctcgcccagcgcctctcggagatagccgggactctccaacagctccccgaggagctcgagaggacgattaagtcatcctcgagggacctcgcccgaggagcggtggagctcgtactggcgagttaccaagccagggatcccgatttctccccatggacggcgctggacgagttccctcccgggaccgaggatggcgcgcgcgcgcaggtccgggacgccgccgaccatatcgtccacagcttcgagggttcggcccctcggctcgcgttcgccctcaactccgacgaggaggacgatgacggcggagtgggcgacagtggcgacgaggctggcgacccgggcgcatcggagtgagcccccaggcccccgccaatctttaaatagtttcttcttttcttcttccgaggccttcgggcccccttcttgtatagactaatttaatatgcaatcaaataaagaggaaatttttttgtgtcaattctatttgttgtgtgtatgagacgaggatgcctgtgccgcggttcttttgtgtcttggcttgagcaagggctcgtgcccaggtcctagtcctcaaatggctcgggtcggggctagtgcctggggagatccacatgtcgagactggctaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaatacgagtgacctatttcaagtcaagatccttcaaaaggaaacaacagcacatatacagcctttaggaaatcgaaaatgcttttattgaaatacagatataagagaaataagaatctgcatatgtggtagcccccggccagccctgcacgcccgaggggggtgcggggttggccagagcccgaaacctgacacccgatccccctttaggggtagaagcgacgaaggtgttcgatgttccacgggttaggcaactctgtgccgtcgcccgtggccagccgaacggagcccggccgggggacgccgatcactcgatacagaccctcccacattggtgagagcttgctcaatccagcacgcgtttggacgcggcgtaggacgaggtcgtcgacgcagagtgctcgggcccggacgtggcgctgatggtagcgccgcaggctctgctggtagcgcgcggctcggagggccgcgcgccgccttcgctcttccaagtagtcgaggtcatctctgcgaagctgatcttcatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttctcgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttattgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctaggccggctgatggatttgcttggcgtggaattgacacgctctgcatcgccggaccaggtcgactgcatcattgagagctgttggccaatagaaaccttgacgagaggctttgccaaccaaggtgcgcaaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgttggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcatcgggggcctgtcaggcgcgtccgtctcccctaaggggtcgggtcgcgccgacggctgggcaagcctttcttcaaaggcgcccggtggggtttgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaagcgaaccaaatatctgaggacctctccgctcggcgaggtcaacgtgacccccgcaccggcgccctgaagagacagggagccgttgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagttccctctcgattatgcaagatttggccgagggggtaagacgtaaccaccgtgacccgatgtgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggtgctctttgtccaagcggcctcacggggtgcactcgtcctctgtgccgacgacctcggggtcggaggacgacaggggcggccttcccacagtggcctcggggccgtcctgggggtcgggggctcctggcgtcgtcggacaagcgggcaaagggccaactccggtggtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctcccggctctctcccgggccaagccagcacagggtgggggtgcgcggaatgaggattgtcctcatcgcgctccacaaccaacgccacactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagagccttctctcccagcctcgatatgaaccgacttagggcggccatgcaaccggtgacgcattgcacatccctaagtttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttctgctagatccgagagtaaggtctcttggttgcgcgtctttacaaccaagtcatcgacataagcctcaacattacgtcctatttggctacctaaagaaattcgagtagtacgttgaaaagtaggacctgcattctttaactcgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcactgcgagacggtgctcaatcacctccctggggaccccgggcatatccgccggtctccatgcgaagacgtcagcgtttgcccacaggaaagagacgagcgcgtcttcctatttgccgtccagaagaccaccgatccgtgtggtcttggacgggccgtcgcccagggcaacctccttgaccgggacctcgtcgcatgtgactatccgctgcctcgggacggcgggggcggaggtgccaagcctctcgtcgcctcccttgggcttggacgcggcggcgaggtggtccgcgcgctgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtaaccgggaggtcgatatgacctagcggccaagtgtgacccggcgtcacaccgataatcggctgggacggccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcccccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcatgaagggaggtgttgtggacgatgcaccacatgccggttgggcgctccctactgagagcgccggcctccttcttttggtcgctcgcaggcctcccctttcgggtggcccacggagcgccctcgacggcgaggacatgaccctcgtcgtcagaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacacccccctgaacgcgtagatcaccgcgtgtgcagggatgcatggtatggtgttgcggacttgacagaaccgctgaatgtaggagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgcccctgtcgtcacccctgccggcctcgatcccggtcgtgtagacctggagaaactcggcggggttgacgctcccgtcatatttttcgncgatgtgggccggaaccttgggggccaacgnacgttccgaaggctcgccacaaaggctctacagccgacaccaccacccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggctgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccaaccaacgttgggctggagactccgggtcagggacaatgggcgggtgacgtaggagcgcgccctggggcgtgctgccgtcgccgtagacaaggaggcgacgctccccatctcgccgcccttccccatcacccgtggatgtcgaagtcgcggatccttcgaccctctcgagcgcctcctcctgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtgtgtgtagggttcgcgggagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttttctccttttctttttttttctaagtgggca

SEQ ID NO: 5245 - DNA, 223 bp, Oryza sativa
tggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaataca

SEQ ID NO: 5246 - DNA, 40665 bp, Oryza sativa
  unsure (1)..(40665): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaaaggcaaggttgttttgcaaatcttttgtttgaagtccattttgaaaccactaagtgatttatttctttctaagtttgggccgaaaagtgacttgcgtctagattcgactttaagagatgtttttcaacaactcaatttgtaatgtaccgacctcccgggtcagatcattacttctcggctcacagagccatttcacttgattaagcggctcctagagccttattcatgttctcgaactcccagagtccagctgcccaacaacacaacgatccgcttccactcgggaagccaagtctatgatgcccgcagacatcctgaatcacacagattcgtttcttgaccactcaggtcatccatctgccacataggctgattctagtaacgattcccaatccacaacaatttttcacaaagcacaggcaaacaaatctacgctacaggaaacacctcgcatccgcccatgaccgtgggcacggctgttcgaacagtttaataacctctgcagagggggtacactttacccacacggcattactaacccggatcacccagcccgttcagaacggacacgtatggagaccttgaggctttcatgacaaggcaattcgaaagccgacacaggtttaccatatgccaacgagaggggtcccagaccaacacccggttaggtcccagaccatactatgccaggaagcccgagggttctccccgataccaccccgttgaatccacatgtctcttggcatcatggctcccctgattagctaccggggtcggcttgacccggtcttggccgagctgtccctttctctcgggccgcgccctacccggccgagggaaggctgtttcccctccctctttcttttcttttcaaaagggtttaattaaatcctttttcctttaaaacaaaaatccaataatcttagaaattcaatatcttctcaaccgtatgtccgtttgactccgttcaacttccaaaactcctcaaatctcgatatctatttaatggcacgtttagaggtcaataatagggctttatttttgccgtttgttgagctgtcccgtttcgcgtgtagtttcggagcccgaagacccgtagtgcgaggatttcgaggatcaagctcaagatttcgagcaaggcaagtcacctttgatcatcttgcacctataatttaaatctaagtatttcttttccgcaaatattgcatgaataagtttaacacaagtatttcggccgcggcttgcgagatagcttgccggccacaatcctaattgctgcaattaccctccttgaattattgaacacttagatctcctttgtcgactgttgtgcttcgatgcatgggccttcgggctcgagcatcggaacacttcccttgaaatttaaaatatccaacgatgggtaaaacttggggttttataaaagacttggaaaaacccgacacctgggtaggtgcttgcgaactaaataaatttccaaaatcgtagatcggggaatgtaccgggagtacggtttcccgctcttgcacttaaggaccgttttctttggaatttcatccaaacataaggcaaatgtgaccacataggtggaatgggacgcccctggctgagtaattagctaatcaggggagccatgatgccaagagacatgtggattcaacggggtggtgccggggagaaccctcgggcttcctggcacagtatggtctgggacctaacctgatgtcggtataggacccctctcgttggcatatggtgaacctgtgtcggctttcgaaatgccttgtcatgaaagtctcaaggtctccagacgttgccgttctacacgggctgggtgatccgggttagtaatatcgtgtgggtaaagtgtatcccctctgcagaggttattaaactgttcgaacagccgtgcccactgtcatgggcagatgtgaggtgattcctagcgtagttttgtttgactactgctggtgaaattactgttgtggaatgggttcgatgtttgaaaaatctgcggctgatgggatcagccaggcccgggtggccgtttgaaagctgttggacgggtgccaaccttgaatcaattcaaaaactgatacattgcacatactccgaccggacgagacacactgtctcatccgtgtcgtttgagaagcactcacttagttgtttcaaaaaggagtttaaataaaaccaattgcaaaaacaacagcctttcttttgaagcctgcattaaacacttaattcccatggcttgctgagtactcctgtactcacccttgctctatgtaaataatcccccccaagttgctgaagaggatgatgtggatcctgctgatgaggagttcttccaggagcaagtcggctacgatgagttttagggtttcggcctagttcccaagtcgcgcctgtgatgaatggtccaagtcttggcttccgctttcccttttgtaatgcagttgtgacctcgggatctgtccacagcccaacttgactgtactcctactctataataaagagacctctgttgctatgatattctgtcttcctgtgataccagcactgtttcctgagactggtatcgattaacaggttaatttggagcgtcacaggctagttccgttcggggctagttcggggcgtgacaaatcaactggcacgctagtacacccaaaggcgagctttggacctgcactggagttaagcaaatctcccaggcctcgtgttttctgtcactacatagtaagcaactattgtataaattaaccattagattggctatagataaattggagctagtagtgggctatactattaagctttctcagatattataagccaactataaatacatattgaggagataaaagaagagagagagtagcagcgggctacagatctgtaaccagctgcagtacggaatctaaaacacaacatgtgtataatagggaccatatattaatagtgtagtatatgtgatatgtttatagataactatcgtataaattgattattaaagtgatcgtaaatgatttaaagcaattagttaattagttagctacaccactagtacattaaacttgctctaatactagtagtagtgcaactaggactgtagtaggagtatgtaatcatgatgttgtacttgctatcctgattaggagttgtgactgacgcattcataggacgagacagtatgattaaacggaacaatgactgttcacttctaatgacacattaattcgaccaaaagggtgtgcatgctctcacctggagtggtagtagtacagcgaagagggatcctgattttttatacggtgggtatcgcccaactggtgaccaacagtacatatttctggtgtactctacacaaagaaattgcacagttttttttctgagtatatatatatatatatatatatatatagagagagagagagagagagatgagtgtgaggtgggtgtggggtgggtggctgcaggctatctgcgtggggtgtcagagtctgcctgtctccctctcactgctgctgccatctgcaacctgcaccgttgcagtcaataataataataaacaataacattcaagtggggcctctcgctactgcgcatggtggcaccgtggcagcatccacccgcagggctcctctgacaccgaccagcattgcccattaactatagaaacccatagtgccttctactgctacatgcaccaactaccattcgacgcccgaaagattttactactaccctagaaatactgttcttgcggtaatattcagaagaaagcccccaaaaaataataatataacttatctgaaaactaaattgtgctcaaaattatttgaaatgtataaaaataaaccacaaacatcagcgctaagcctggtaatgtcaaagtccaaaaacaccatatattttgacaccaccatgttgtcgttgcgtcctaaacgagttgttcaccgagactaggccagaagtttaagatatcaacgaggctgtggtggcgctactttttatcctccgtcaccattttgtgctaggtgagttgtccgcaatattagctaggaatttcgaagcttgacgagaccacaccaacactgtatttgatagagctcgatgagggatagcaatggcaagctctaggtgtatcgtccttgcaaggttcctttgcactaaccacttatcaggtggatgagtagttctatgctaagatcatggtttattttttatatcaatgtctgatgtggttcatcgttgaaactaaatttttccacaaagatcgaaccgtcaaaaatttggatagaagaacaagctatacgccatgcaaagggccttattgtttggcttttttcatagtaagccaaaacggcttattagagaataaaaataatttgtagataaaagttttatatatgtgttctcggtgatttaaaagccaatgccgtaaaagaaactacgttaaaaatatctcaaaatcaatgtcaaaattaagtttaaaaattcaaattttgtttttttttctttagttgaataggctatccgatgggagccaaagtttcccggtgacagtctagactatagagacgacgaccaaagcgcttacgactacagtaaatacggcatcaagcggcggtggccagttgctcgcgtcgtcgccggggagaggggagacgcgaggaacctgtggagtttttgcgggtgagattcctacggctgcgcgcgcccacgaggggggcgcacagcagattctgcagcgcactctctgctctgcctctgcatcttgactgaatgacctatcttctgtacccgggacataaattatcggagttaaatatccggaaactattcaaacaggccatcgttcgcacgcctacgtttttcttttaagaaaaaaaaaatatgtcctctgcttcgctcacacgcacgtactactacgtgggctgcttggttgcaagcatccttttatgacaaatctgtactgtgcggtagggttattttccattcttcctactcctacggtttgttcttgacattttttttcacaaagaaaaggacggaaggagtataaagcatgtcgcttgtccaagcaaaagaacagtagccagtggcaaacaaagccctgtttaattcaccccaaacttcccccaactcctaactttctatcacatcacatcacatttaaaactttcctacacacacgtaaactcccaactttttttccaaactaccaactttccccaaacttctccccaatttcagaaactaaatacaaccatagtaccactggacaaacgagtcctgagaatgaaagtgattgactaaaaactattatggccgagtttagtttcaaagttttcttcaaacttccaactttttcatcacatcaaaacttttctacacacaaactttcaacttttccgtcacattgttacaatttcaactaaggctgtgtttagttcacaccaaaattagaagtttggttgaaatatgaacaatgtgatggaaaagttggaagttcgtgtgtaggaaagttttgatatgatggaaaagtcaaaagtttgaacaattattttcgaactaaacacggagtaaacttccaattttatcatgaactaaacacaccctatgtgtaaatgtctcactgttaatgagaagtgaaagatctataaatttctatccggcctagaaacagttgaagtaataacatcactaccttaactaaagatgttgggtttttttttaaaaaaaaacacattataaacgtacacccacctgtaaacatatacactcactttgcatattcggttatattccgacaatataaatggcaaaacttgaaaggtgccatgcatagggaaaaaaactgtcatgctaaacaggaaaatacatacttggtgtcaactacttcgtgggttattatattttgacgaacgcattagtgttaattcacactataatatatttgttgaaatacttttcactaaaaacaccctaatcgctgaagcggtaaaaaaagattagatcttatttggactatagggctcgtataatatgtttgatatgtcattttaaagtttaattaattagataattaccttctagtttacaaatgtctagaacttcaataacatatctggttcatatgatgtcacaataaaatgccagtccgagtgattttctttctaaccgtcgtctaagccgtacatacgtaaaatactccatttgtttctaaatatttgacaccgttgactttttagcacatatttgaccgtttgtctttttcaaaaacttttgtgaaatatgtaaaactatatgtatacatataagtatatttaacaataaatcaaatgatagaaaaagaattaataattacttaaattttttaaataatactaatggttaaacgtatttaaaaaaatcgatggcgtcaaatatttagaaacggagggagtatatataagttagactcatgataatccaactctatacgttaatattgcaattttaaaaggtaaaatatactttttatgcaggactaattgactgtattgaaagatagttgatgcatttacgtagtagtacagtaacgttttatagaattcacattcgtttaattaaaacccaccgtttattaattagaaaatgtattaataaatggccgaaacctgatatttttggcaggcaggagcgcatttcgcagtattaccctcgggttttcttctggatccggaaacagcctccggctcgcaagtcttaaatgcgcacggacgtcgcttcccaccctcaccccacccttccccgcccattacaaaaccccagccaccgagagctctcccgctccactcgccgcacaccaccaccctcacccctccccccatccgcgtgatctcccgagcagctagagcgcgcgcccgcggcgcctgtactgcgagaccgcttcgctcgcttccggtcggtgaagaggcggtcggtcgcagctgaagtagttgttgcagagatgatgatgatgagcggtcgcccgagcggcggcgccggcggaggtcggtacccgttcacggcgtcgcagtggcaggagctggagcaccaggcgctcatctacaagtacatggcgtccgggactcccatcccctccgacctcatcctccccctccgccgcagcttcctcctcgactccgccctcgccacctccccttccctcgccttccctccccaaccttcacgtacgttacacacatcctcctccacgtacgtacgtacgcgttgttgccgatgctaacaaagtccatattgtgattggtgttttcttgggaatgcagtggggtggggttgctttggcatggggtttgggcggaaggcggaggacccggagccagggcgatgccggcgtacggacggcaagaagtggcggtgctccaaggaggcggtacccggacttcccaaggtactgcgagnnaagccaccatgcaccgnntggcaanngaaccgtctcaanngaaagnncctgtggaaatgtccttggccacgccgccgccgccgtcctcctccgccacctccgccgcgtcgaacacctccgacggggtngcccccaccaccaccaccacctcctccccggcgccctcctacagccgcccggcgccgcacgacgcggcgccgtaccaggcgctctacggcgggccctacgccgcggccaccgcgcgcacccccgccgccgcggcgtaccacgcgcaggtgagcccgttccacctccagctcgacaccacccacccgcacccgccgccgtcctactactccatggaccacaaggagtacgcgtacgggcacgccaccaaggaggtgcacggcgagcacgccttcttctccgatggcaccgagagggagcaccaccacgccgccgccgggcacggccagtggcagttcaagcagctcggcatggagcccaagcagagcaccacgcctctcttcccgggcgccggctacggccacaccgcggcgtcgccgtacgccattgatctttcaaaagaggacgacgatgagaaagagaggcggcaacagcagcagcagcagcagcagcagcactgcttcctcctgggcgccgacctccgtctggagaagccggcgggccacgaccacgcggcggcggcgcagaaacctctccgccacttcttcgacgagtggccgcatgagaagaacagcaagggctcctggatggggctcgaaggcgagacgcagctgtccatgtccatccccatggccgccaacgacctcccgatcaccaccacctcccgctaccacaatggtgcgtagagtactaaccttcgtctccactgatcagaaccgtttcttgattcttatggcgagccgtgctgacgatgatccaacttgcttcctgtttggtcttgtgcaatctgcagatgattaatctcttgaagaagccaagaagtgatcaacacgcggaagaaatcaacagcttctttcacggcgtgcgagctgcatgctgatgctccaggatcgatcgatcgatcattgcatctccaaactaatcacgcttcgatctttcaggacttcatcaatgacaggccgaaacctcctacgagttctctgatgatattcttatttttttcccacttcttttcgttgagctttttgtaatgttgcttcgagtgttactcctacattttctccgaaatggcctcagaatgatgcggtcgggctgattaattaggttagactcttcctgaaccaactaggaatagattttctgcctggttcctgtcagtccttgtaatatctgcagcagcttgtgagacaagcgtgttcgcttttgtgaacgccctttttcttctttccgattcctctgcctgtgatagtactcgctccgaaaaaaaaaaaaaaagcaaaccgtggattcttgggtcaacgtgtccgttttatattgtccgttttatatgaaatttttttataattaaaatttctattgttgttagatgataaaacatgattaatatgtgacttattttttttatatattttttttaaataagacggacggtcgacacggttttttttttttttaagaaggagggagtaagtcacatctctggattctgctgaaaagctcactagcgccatcctgcttcagagaatactttatgctttctgacaagtcggtgtaggagtagtagtattgctaggtgtactccactcccctccttaagtacattaccagtgcaacgtaaaacagctttgctcctgagcaacggaaatgcttaataccgtactcttgcacttcgtcagttggttgagtacactgtgcaagtaccaaattggtcttcttaagtgttactactaggttgatcacttgttgaaccgtttaggctgtcgatcattagcattcagggttatcactgcaaagtcccaaacaaaaagattctcccagggtctattctcccctgaaccgttttcccattgaccggccaatgctgcaagaagctggatgcagagctaggagtagctgcagtgcccccactcctgcaccttcctgcagacactcagagagagggagagatggaggactgtgatgactgaccagcacccctgctttggtctccatggattcaatgccaactgcactgcaattgctgccggccccctgagacaatgtcaggcgctgtcagctctcgcgtccatgcgattgaatgatccattgctggcgtttggaccgtcgcctctcctcccctgcctcgcacacagtctgcagcgcatgcatgcatccatcatgtacagtgcagcattggacacaagcctccacatggagtaattgttactgaagaaattcccagaaattacatgtcccgcgttacagctttcggttcatccaacagcagaaattaacctgagagagtgtttgggaattagtactaaactttagtttctcttctagagacttatgttttttagaaagaggctactcccagacaccccctcagttttcgtagtactggcacctgcctatatgtgctggttttcgacgcgtactctactaatctggagtttactccaaaacgaggaaaaactcagctgtcactgtatcatcttcatcaccgaatccagcggagcacgtactgtatgacgtatctgttctgacagcgaagttgaacaaatccacggcgcccagtattcccacgacagagcccacatgagcccgtctccagcacgtacgcgtacaataaaaaggctgtactactactctgtatacacatctgcggctctgcacccatctcgtcagcaaaacgaaacgcatgcatagagaggagaacgttcaaaaccattcattcatcaaccggaggatcagctgcacaagcaagccacagtgcagcatgcggtgaatcgcacgtggagaggctcaggtgaccccacgacttgcacggttttggctcgcaatatcgcgacgagacgaggccgtgacggcatgttattctgctcacactgtcttcgcctcccccactaccacgaccactcgcgtgttaagcccgcatgtgcttgcacctgatcccgtggcacgtactccctcggtcaaaaaaaaaaaaaagagaaagacaaacccagaccgtccgtcttatttaaaaaaattataaaaagaattaaaaagacaagtcacacataaaatattaatcatgttttatcatctaacaacaataaaaatacgaattataaaaaattttatataagacggatagtcaaagttggatacggaaaactaggatttgtcttttttttaggtggagggagtaatggagattttttttcccgttttggacgggttgttcagtcagtcatggctgggagaaaaggctgtggagatgagatttttagcagcggtgcacacatgcgtgcacgggcaacctagacagttgggattttactactgacaggaagaggttgaattaaactagtgtcgtcattcgcggcaactctgagttaggacagactgattgcccagattattcggtttttagtgtatcggcgagggcatctgacgccctcgggatatgaggccctgcaacgtggtggtcgcgggcgccggagttctctcccggttagtttacggagcaggaggaggtcggcgactacttctactacgctctcgttcagtttcagattcttaccgctgtatcgtggcgtttagtttaaaatccctcgcgcgtttggggtgaagggatccgatgtgttttttgcagggatgtggcctggttttccgtgtgtaggggagggagatgtcacggcgcgcgacagcatttctcgtgacagccgcttaactaaacgcctcaatctgagagctggtcgtcagggatcagcatctgtcaggaggccgcaaccagtggttcagctgcaagtgttaagaacagtaaatgatcagctggtggtggtagtagtgctgctgctgctacttgcagtccctgcagtgtcagctgaacgtcaggggacccttcaattcgctggaattgtactgcggtgacatcatacaaaccctggaccaaacgaaacaaaactaggaccttgatcacttgatgcggctcggcttggttggctactggatttaacccactctttgctttcgtccaccctcgatggccggtttccagttgagtaaacaatgtacagcttgtgttgttcacaccaaaattagaagtttggttgaaattggaacgatgtgatggaaaagttagaagtttgtgtgtgtagaaaagttttggcatgtttagttcacactaaacttcccccaaactctcaactttctatcacatcacatccaaaactttcctacttacataatcttctaactttttttccaaactaccaactttctccaaacttctccccaatttcagaaactaaacacagcctttgatgtaatgggaatgttgaaagttcgaagaattattttggaactaaacacggccacagtttcttcatagatttgttgttactactccaggagtactatcttttataccggtcaacgcacagcttacagcaaaatgcaatcccccccccctgctagtgaacagtgtctcatatcccatccaatgacccaaaacctgcacctgattgaactactcaatgaggctgtatttagtttctgaaattaggaaaaagtttagggaaagttggtagtttggaaaaaaaaaatagaagtttatgtgagtaggaaagttttggatgtgacgtgatgtgatgaaaagttggaagtttgggggaaatttgatgtgaactaaacatggccgcacaatgatagaagtgcaatgtgcaaaatggtaagcaatcagccaatcaccacaatactggaccgcgttatcactcatcggtgtcaaccgctgcggcaacgtgggccgaggcttcgaattcgccgcgccgcgtgacggcccatcagaatacgagatgggccggcccacccgcagcgaactcatccctgcccaggccagcccatccactctgggatattgtggccgtccgatgcgatcatgccaaatctatccaacggctggtgtatctgaagcgtgtcgatgtcttcctccgaaaggagcagcctccacatcaaccgcctctctcattaattagcggaccatttctaattcacccctcgcatcttttcgaattttcgagagctcaaagcctcgaaccattcccttcttcctcgtcccaatccaagttccaaccatccagggcgggggttttcccgttaatccgcgcctctccgtgtcggattgaattgaagcggagagggggaggaggaggtggaggtggaggtggaggagggcggcgggtggcgatggcgatggcgaggctgacgccgaacggcgtggcggcggcgctggcgggggacacgaacctgaagccggtgctgcagatcgtcgagctgcggggcgtccaggtcaacggcgcgggcgtcacgcgcggggagaggttccgggcggtggtctccgacggcaccgccgcgtcctccgcgctcttcgccgcgcagctcagcgaccacgcccgatccggcgccctccgacgcggcagcattgtgcagctcagcgagtacgtcatcaacgaagtcggccccagaaggttttgttgcctcctcctccactttcccccccattcccctgcctctgatcgatgtgtgattgcgtgcgatttttggcccgtttcgttttagggttcatgcttgcccctggttttatgtgtgtcagtctgcgtgtggtttagattcccgctttcagctagtttgcaatttaaattaatacttagtacttgccattctgttggtaaattgtcgatgagcttcatgtttcctactagatactagtagaggtgcatcaaaatttttctgacaatggttttgtttatgacatcatttgatcggtgcttgttaaccatttgtccaattgattttaattctgatttgaattattattgtcagaaagaggcctcggtattgcagtactaatcagtggtaactaaggctgtcctgtgacacaaattggtgtttgtcgatactcagtagttaattggctggcattagtattaacgattacaaaatagtgtgatatatgtgcttgggtagcctttggtgttcgccatttctggcaggtagcatgtcaaacgatgaaggtaatatggtcagtttgactactacacactttacagtgttgtctgatttagttcactaatttagttgtgtgcctttttttctctagccaacaaatcgccatgtttgggtgcatcgatttggccaatgtagttagatattgatcagcattaatgctgcaactgtctggtgctgtgaacagtttgggtctaagtactaagtattttttatcttttagctgtagccattcagttcaacacaacaccgtactaaatgcatttcttttgtatctggttcataagtaattggaagcatagttgtgtccattcaaatcatgttggcaaggcgacaaatgcaaaagtgaagataagtttctgaccaaaaggtgttgtaattaaacatagtattcatgtagcagtgtgaatcatcatattctgagccttttgcattcttattttcaactgatctactggttgatagagcagaatcaagaattgttttttgttggttgagctgacttgttgcaatacctgtaggattattgtcattctgaacctggaagttcttgtttcggagtgtgagataattgggaatcctacagcgctttcagaaactggatctcctatcccaaatccgacaagagtagagcaatttaacggagcacctcaatatggtttgatggcagggaactcatcaaatacaaccacaaagcctagtgacaatgttccattgttccaaaattcgatggcaggaaactcctctaactttgccactaggcccagtgacaaagttccggtcttccaaccaacagtccagccatcttatcgccctgcacctaattacaaaaaccatggagcaatcatgaaaaatgaagcccctgctagaataatccccatatctgctttaaatccttatcaaggccgctgggctatcaaggctagagttactgccaagggagatatccgccgataccataatgctaaaggtgatgggaaagtattctcttttgacttgcttgattctgatgggggagagatacgggtgacatgcttcaatgctcttcttgatcgattctatgaagttgtggaagttggtaaggtctatgtggtatcaagaggaaacttgagacctgcacagaagaactataaccatcttaacaatgagtgggagattttattggagaatggatcaactgtggatctttgtcctgatgagaacagttccattcccacccagcggtttgacttcagaccgatcaatgaaattgaggatgcccagaacaatgctatccttgacatcataggtgttgttacatcggtcaatccttgcaccacaatacagaggaaaaatggcatggaaactcagaaaagaactatgaacctgaaggatatgtctggtcgaagtgttgaggtaaccatgtggggtgacttttgcaacagagaaggctcacagcttcaaggaatggttgaacgtgggatctttcctgtgctggctgtcaaagcaggaaaagtgagtgatttcagtggcaagtctgtcggcacaatttcttcaactcagctcttcatcaaccctgattctgctgaagctcatagtctcaggcaatggtttgatagtggaggaagagatgcttctactcagtccatatccagagatatcacgcctggagcatcaaggaatgagatccgaaagacagtagcacagatcaaggatgaaggtcttggaatgggggacaaacctgactggattacggtgaaagccaccgttatattcttcaagaatgagtccttcttctacacagcttgccctaacatgattggcgacaggcagtgcaataagaaggtgacaaagagtactaatggcaattggacctgtgacaaatgcgatagggagtttgaagagtgcgactacaggtatctcctgcagtttcagattcaagatcactcgggaacagcttgggtgacagcattccaggaggctgggcaggagttgcttggctgctcggcaacagagctcaacgcacttaaggagcgcgaggaccctcggtttgcagacaccatgctcaattgcttgtttcaggaatatctgctcaggctgaaggtcaaagaagaatcatacggcgatgagcgcaaagtgaagaacaccgcggtcaaagtggagaaggttgatccttcgggtgaaagtaaatttctgctggatttgatctccaagtcctcggcgctacattagcagactgtgctactctatcagctgctcgctcgtgcgtggtgaggtgagcgaggtgaggtgttgcagtgcccatagccctcgccctcctgctcgatttttgtgccggtactttaatattaacgccacttaatagtttatatccagattagtgctttaatagtttatatccagattagtgctgatatttccatttttgtgccggtactttaatattaacgccacttaatgtatcagcttttatacctttttctcgatcaaatgattgccttctagctgcagtgcaatttctcccttagttttggtttgtacatgcctgcaaagccttactctgtcgcgactaagaaatctcttgtgctcttccatgcaatcgaacatctgttttacattcgcaaggctattaggacttgggttagatgcaaacaagcggatccagagaagaagttaatatccgtgcaaacgaaaaaggagcatttattctttcaataacaaggtgtttaaggtgactatgtcaatctcaaggtacgttagtcaaatctctcggagaacataggaagtgttcgtgtgtagaaaaaggagcaaacaatacatacgtcgactctttcttttgcacgagaacgcgagtcgcgatcacaactttgctatacaagtgtggtattcacagacgtccaaaagcgtacatcaatctcagtggtttccccctctatttgcatgcaacacgtggatcacaagaaacccgaaactttcccctgtacaaccgtagtgctctgccctgaaaacttgatcggcactctcacgtcgccagcttgagactgcatctcagccagtttttttactcgtagcagaatcgacactggtatcggtatggcagaaggattgctcttccgtggacaaacaccctgttcagtggcaaagagaaagttgggtaaataaatcaagatgcaaagcaaaggggaaaaaatgccagaacgtgagaaagtaggtcgaacagaacagcctgttcatcatacatcgttttcagtggaaagttgtgtctggctggccctgatcagattccgccatttgtcctgaataagcatcatgattcattagaagaaataaaatgcacgaacaaacctaggagttgaaaaggcaattgcaccttaagatccaccgaggtgcggtacgaatatgatgagaaggctagtcttctaatctcggaccatttgccagccccatatcgggccacaccatcgaccagcttcacaacctcacacaatgtccatgctcgatgatgcttccgcttcccaccccgctttgttttgggattgtcatcagagtcgcaaaaatccttgtcctgcagaccctgaacatccttttcacaagatgtttctacatgtactcctttcttcccagtgttcttctgctagcaagttgaagaaaaatattatataacacataatacagaagtagattacacagcattaagccattgaggtactatgtgtttcaaatatatttctagtcagtacttcattctgaagttggattttcactatattgtccaacatgaagaaacatcatactagtggaacttctatggctttgcttacatggttcttccgttcaccttccttttccaaattcactacatctgcagcaggggcctcagtacattccacagaaggctcaggatcctgatgcaataaaaaaaggattcaggtagctacattgagataattataccaaatctaatagcgtatgacacatgaaaatatggttttgtcctaaattattctgaattggtatatggtgcaatatggtacatcagatcaaatggaatattggcacaatgatgaggaaactatcaaataaagactacaatggcaaaatcagttaacaaaaagttcagagatttcccacatttaatttatgaaatatagcacacggtgtttgtaggaagtaccatgggcaaagagtgaaattgtgaaaaagaaaattaataatctgcttgattgaaaatgggcatgagtctttagttagttggcttccaagaacattttcccttagataagtttcttaggtcagatgcattctgagcaggaagcaatttacaggccaaaatgcgttaacataatgctttatggaaatccatattattttgataaatagagaaggtacttgcaatctcatatcaaaagaagaaattctaaaaaggagcagaaaaaggaagcatctaacataaaaagaggacatccctaaaatagttccaaaaatggagtaaccaaatatattgttggtcctgtatacttgtatagtaatcgaatatttgcgcaaatgtcacaatgataataaatggtagtcaaattgtccagagctggaagattatataatgcataggtagacaattaccaaaaatggaatgaagttactcctagggcgcccccttctcatccttgaaacataaggcacatgcacactacaccctccaagagtatcttctctagtaggataggctgtgctcaacgaatcaacctcatgcaaaggcgctatccgtggtctcaataacacctcatcatatacatgcctttttccaggtgaagaaagtctcccagtggattcatgagtgtcaatatctgagagctcctcaatgtatctttttgttggctttctaattctcttagtagttccttgttcggcaaaaatagttacttgtggttcatcattatctgttggtactcttttgagtctcttggacgatctctgttgctcctcactatgataggaaagacttgatggtaaatctctctcatgtccaggattcattacttggtccctaaccaaattagcctcaagttccatctttggtattgcttcaaccactggtatttcttgtttggcacccatggcaataactttataatccctaacaacacaacctgaacttggaacatcacatgaattgatcaaccccattgcaatccgtcttttgagccatagcttgtccttgacagtagtttgacgcccaaatgtggctctaaatgcttcctgaagttctctcattgtaagatcatccaagcagacttctccctttaaaatggaaaaatcaggaactgaactagtaaccccagaaacagattgtcctgcagatgcctcatttacaggtttcgagcaggcatcagccttttctttatcagaagaaaggtcatttaatactgttgattttgtagtctcagtcgaagcattgtcctgttgggcaatgatatttgccccttgttctgtatttagtttatccagctgctggtcatgaacagctgaacaatttgaaggaagaactatcgaatcattcaatgtacataacctgtcttcctgtgaaatgatatgcatctatttagtgttacatcaacttgaatatgtagattgaaagaagatgtatacaggtgcatgtttagtggatggttttaagggaagtgctcaaataaaaatagattgccctgggattgtatttcacacagatcaatctcttattaccacatctttcaatgatctacagtcagtcagatatgtctcaccgcatatcctgtgttcacttaaagaactcagcatcttctcattacattgaagctcatcccatagttttgatccatccatccatctctatgtcagttcttgatgacgataaaaatatgttcctaactagtactaaacaaagttgttacatacaaaagtggaatttgttgagaccgcatacaattgaactttgaactgctaattagacaaaaaagaactaatccatatttttaccatgccagaattagcttgaaaaaaatgaccacagaggtacctaagaacaaactaaacctattatctaatagaattaacatactatctggtcataaaatgcttatactcaatcgaagatacttcacttcgattagtgagggtattgaatgaaacagaaaataggtttagtgaatcatgttcatgatgcacaatggataagcaatatacctcataggtttagtgaatcatgttcatgatgcacaatggataagcaatatacctctaagccagcatctaacttttgtgtctgtacatctgcagtgtctaatttggaaggcccctctgtgaaaatatagtaataagtcaacatctcaagtaatcaaaccaatcgaatcaattcattaatcatgctagcttgcaaactacaatttatcctcacatggcatgatattcagttatcgatctaaggaagtatgatcacccaaacagaaatgacaataaagtagaaattgagatagaataatatttctgagggcaccttcaaactcaggcttcttcactatgcaatcattagtaaaatattcctccacatgtgttacatcgtcaatagaaggcagatcatcatcaaccttctcatcatgaaggaaagtttcaaactgtaagacctcatcctccgtagcaggaataagtgttccatcaccttcaacctgaacattttattttaaagaaaatgtgtttctcaaagaactgactaaacaattggaaccaattatgtatattagtgtatagccaatagaccctatgatgagaacttacccgaactaactggtaaacaacaggatcagaattgtcattcttatcaaagtcattatcatcacttctgttgtccagagcatcttgtggaccacccacctccatagatcagtacaagcttcatccaatacccttactaatcgaagtctaccaaggtgaaattctacagtcagctaataagtttaggattaagattaagtcaattaagtaattcagcaatcctggagagtagagagaacaaatataaagaacatttgcaaggatttatgactaaacaaaaggattcaggtaattgttggacagactattgcgatatgatccacgctatctttaggcaccactctttttcccctattacaaaatgagcaaatccatgtgtggtgggaatgacaaaagcgatcacacaccatagtgagatcctcaaaatcccaccaaaaactactgaactggcagacaggggcggatccaacttgggacatgggggaacaaacaaactgtttcttgtattaaggttaaggctctgaaatcaatagaagaagcttcttccagatctagaagagaaactagggttaacgcaagcaaattccagacaaaagtactcccggtgggagagagatgaaccagaaagaggatgtggatgctcaccaggatcccctccccctgctctgcgcgccagacggagatcggcgcccctcccctgttcagccgcgagatggcgcaaggagcggaggagacgagacgggggattttcttttacgcgaagggaagggggagatacggagatactcgagctgctccactctatctcagtttttttactttaaaactgcacttaaagtttgagatggataatcttgtgctacttcataatatgatatttcgaaatttttgttcaattttgaacactttttgttccatggataattgcgtgagttaattaaaaaaattatacagtgataatggagtctaactagagggcgatggtatattatactccctccgtcctaaattataggcgtcctccttttaagaaaaatcaagctcagtaacttttaactaacaatcatactaaatatatatacgctaagtattatacatgttacttcctccgtttcacaatgtaagtcattctatcattgcccacattcatatagatattaatgaatctaggcacatatatatgtctagattcattaacatcaatatgaatgtgggaaatgctagaatgacttacattgtaaaacggatgaagtatatcactagatttatattttaaagtagtttcatgtgatgctaattttatattcgttggcaacaaaatatagagtaaattaatggttagagtatgtcagtaaagaccatgtaagaaaaatacatgccttataatttgagacggatggaatagaagttaagcaaaatacgatatcatattatataacgagtcaaaatcagtgacacaatgaattctctttgaaaaataatatagtcgaatcgttttttttattttagtcataatagaacttttttttacctaaacatgattgggggactttgagagaagataggaagaggggataatgtcactagccaaaacacatggggggaggggaagttgcttacatccatggtatgttttgataatatactattattattaattttgttcttcactgtaatacgatgtaaaactaaaaaattaacatatattactatttcattattcacttttcttcttattttctcgatcttttttattttcaatgacaatattgctagaggtccgcggagccgataaccatgtgggggtatttcaatgaagctaattttgcatagtagatattgctaactattatctataaacttagtcaaatttgtttaagcttgacagtcaaagtgactcataatatgaaatagaggggtagttgcatgcctatgcattacaatatgatctatagataaaaatatgatttagtttatttctaatccatttttatgagatgttggctttttttatttctttaaagaagttatttagggtatagttttttgaaaagtgaggtcaattttttaagggagaaggagcattaatacttagatggattcttttttatttctttaaaagttttttaaggagaagagaatttttttttgaaagatataggaatatgtttttaaaataattaatatctccctcactgtcgctcacccccttgtcgtcttaggtactcctctaggctttaacttttcgatttcgaagtaaaaaaatcgctcttcactggtttaccaaatccgatcaaaaacgataaaaaccaacgatttttagtcaacgccgtacggaaaactagctaataccgaccggttttcataaattcagacctaacagtttcacaaaagtcaactggttttcatgaaattccatcggttttatgaaccgtgccaccctccgctgccttctctccctcccaccttcctcagtacactcctcctccacagaccacagctagtcgtcgtgccagcctgctcgtacattggagccgaatctagttcgagaaagaaccaccatgatgactatcaggaggaaaataaacatggcgggcgctaacaggtatggtggtaagagcaggtacaatagctgtctataaaccagctataaaacatattttaaagagttaaaagaaaagagagaagagcagctggctacagatctgtagctagctgcagcacgaacttcaaaacgtaatatttgtatgacattgtgggaccatatattaataatacaataaacaattattgtataaattgactattatattggttatagatgatttatagctagtagtgagctatactattgaacttgctctaagcccatcgtcgacaagagctcgttaggctgcatccaagagacaatgtcgcaacgtgggagcagagcagagaaagacatgcggagctctcgtcgcgggctcatgctcaaagggagagtacacttctcgtcggagcttctcgtccacccacggaacaggccggcatcagggacccggagtcccggacacacgcgggcgggaagtttaggcccatctcgattttactagctgcgtggccagcgtgggagcgtgcggcgttgccaaccgccaaccatggcacgcgcgcacgggacgaggcgcgtcggctgccgggagagcgccaccgcgccaggcgcccgtgacgtgcatgcgacggcgtggccgccccgtgcgggacgtttcaaacaaaaacataggcagattggtcgtgcgacgacgtgcgataaaaagtggaggaagcctagactagacgagacaagctgcgtgcgtgtgcgcgtagtggccaatgtgggggcggctgcggcgcagttgatcattagccgcggcgcaatgtcgcgggggattcgctttcctttcgtcgtccggtggaccgcgcgcccatatgcgatgcgccgctgcgcgaaagggaggatcgcgaaaagacgtgcggaggacgcgcgcgaagactatcagtgtgggcctgactcgtgaactcttttgggaacgtttttgctgcagcgagtcgatgtacgtgcacgtctggatcaccatattctagtgtaccgaccagtgttcaacacatcaatcattttattttagataatagaataaacatcccggcatttacttatcagagctacatccaattattacaaagtatcactttaacaaaatgtgtagtttaaatgaaattaaacacacccaacaaaataaaaaaccaaaccaagataagaagaacacatttattaaagtctgtttatgaatttccatccatagcttaaaaagagttgcataaccgtcgtcttaagcatcaatcatggtgggtggtgtttcatcgccaatttactttgtagggttcaggtttataagttagttttttatacaagcttttgcgtcggcactggcctgcaccatcatgaaccgtagttagaaaaagagcacgattcgaatatcttacaaggaaagaaattgttcattgtatccagcagagaaacgatgcaccacccccgcgcctttctttgctccgggaaagagctcgctttgccgctcgacggaaagcttctctgttttatgaactaactaacgacacgtacgttaatctagcatccctagcatccggctaaacgggctaaagtaaatggaaatcagtgaacggagcacatgcatgccatacggaagggccctaatagtcacaaaaatttccgatcgtccaaataccgttttcataccgagcgtcattttttttatataagaggtaccgtttacaaccgttaccaagtattgcaaattctaatttctttctgcatcatactgatatcaacgccgagtaatttaaatgataaatatgatcaatcaccgattgattgagcgtcggtttcgaagagatgctatcgattctcgttgttttcactcactacatcttttttttcgcgaactcatcactcactacatcgatagactgttttactgttaacgcttcaatttccactgcgggagaaagaaaatgtacaaattgtcgacgggcagtgtctttgcatgactcgagtttcgctttaccagcacgccgtcaccgcgcgccgcgcagagccctcaccgtccgttcctccccaacaaactccaccgctggggaagagacgagcaactaaaaaaaaaaaaggcgaaaactcgagtgcgcgcagtgtcatccgcccccgtttccacctgtgcgcgcgcgcggcgtttttcaacccccacggacacctccgcacgaacgcaccaaccaaaccaaaaagcccctgcgaatctgtgatcctctctccctcgccgcgatcgcgttcgtcccacggccgcgcgcgcgtcgcgggggcgtcactatgtctccgcaccacagcggccgtctcgcgccgccgcgccgcaaccgggagaacccgtccttctccgccgcgctgctcgacgccatctaccactccctcgacgccgatggcagcttgccggcgtcccccgccgacgccgaggggtcaccggtgcccggacgccgccgccgtccttagcagtgcaacaacctgtcgccgtctgcttcttccgtgcggtcgccgcggctgcagaagacgccgcggccgtgtcgcgtgcggcctgacccacagccttcgcttctcttgccgccgccgcagccgccgccgccgatgccggagtcaacaggagacgtcgcggagaagaagaggggcagaaggaagaacaagaatggtgccaagtcggcgccattcgcgtgccttctgaatgctctgctttgcaacaggaggtcagccaggtcggccgagccgacgacgccgcgggctctggcggtggcgccggcggcagtggcagtcaccgccgctgagccggcgtccgcgaggtcgatcctgtcgtcgcgcgcttcccggcgacagcccgcggcgacgggtgggatcctgactccggcgaggcgggcagtgcggttctcgccggtggcggtcgtggtggacgacggcgagcacgggtgccgggacgccggggtggcgaggctgcgcggcgcggagagggaggtggccgcggcgcaggagtcggcggcggaggcggagaggagggtggaagagctgctgcgcgcgctcggcgtggcggaggagagcgagagggccaaggagagcagcgagtccagctccgacctgttcgagctcgagagcttgccggcgttcgacgacgccgagctgccgcggccgcgagctgccgccggactcgtgctggcacgtccgcgacctcgcgtttgttgagagttgcacacaagaattaatacctcttcttcgacgtgtaagctcaatgcagctatgcagcgtgcttacgcttgtctggatgctgaatggctgatgaatgtttggaaatggcactgcattgtcgagtgaaaaacaagtacaggcatagcattttgcatggggctatcacatggcgctttgttgttttccctgccacagaaaagagtgtaataaatttcaccatggtgcccaggtttctccagccggcccggcagatttgttactctgatgtctttctgcccgttgtttccatacaagcaagtaatttttttaaaaaaagagatttggaacgagagacctccaaacattttttttaagaaaaaaaaatgagtgtattagggattgaacacaatatttcagggttgaagccatacacccattaccattgcactaccaagtacatctccatacaagtaattgattgtgttacttccattgtttatctacaattctacaaacgtagggctgttttggtttgacgtcatacttatcttactagatatttggtaactttaagtagtagttgtttggattgctttcaatctttaccaaatcaatacaattaatactactattctactatactaaaactgggtactgccaaatcatacccaaaatttgacactactaataaattagtgggatggtagagaaccaaacaaatccgtactaccgtaagtttgtcttacaaaacaatttcaaactcccttgtcgtgttaactttttcaaacgttttgaggtcaagaatgctgtcaaagaaactctttcgttctagaacacaatttatatttatgaaataaagggggaaaaaggaaaaagaagaacatatccatgcatctcagagtagttcaggaagaacatgacctgcgcaggacgctgcttgttgggcaaaaacatttgggctagttggcctagctctgtatcgcacatatggcccatcggctcacatgacgaaacgggccggaaattccactctcctggactcctgcgcttggagccggcccaaaccaaaccaaatcccaatcttgcaaaagtttttaccgctatcattctatcaagggctgttctgcaaaatttgctaccatcagttcgtcggaccgggagcgacttctaccattggatgtagcatcaacggtgggcgagagcccgcgccgctcgccggaggtctcctcgcctcgccgcctccttctccggcgtgtgcccctcctccgctcctcgtccccaaagccaatgccgcctcgatctcctcgccgacctcctccacagtacagctgggccgccgccgccgccgcctcctccccgcgctgcctccctctcgcggtctcgttccaatattggcctccctctcaggtctccgcggccgtctcctcctcaaccccaccatggagcgtcacgaggaggtgggttggagcctggacaccgtacctggctacctgtttgctgctgtaaactgccaacttgttcttgttgatctctgcactaagacctaatcttcttttgtatcaggagttgcctcctaatgtcccataaaaattcctcgtgtgtctctttcctggttttgggcgcttcggatcaatccactttgggctagaagaagcttatggtaaggtgcattttccctgctaacaatctgattctggaggagaaacaacattagtgcttttcgattctcacagattttttgttaactgttctgaactcttgatgataaattggcacgtactgtttggatgtagaaaaggacatgttttgcatttcaacttgttgtatgagaacaagccttttgtcttgcaatctgatgaaacactgtcattctgttatcaagttccattagattttattttgttgttgttgttgtgagatgttgagtatgcttctgaaagcgtcagtggagagatcctgacttcatgagaagggcaataagtgggttgagcagtgcgaatggaaattttaggaacaaattaattgatgtttttgaagagaataatgtttcaactgattcacagcgatcatctttgtctataaaacagaactctttcaacttcagctccttaattacatatagcaaacgaaaatgacaaaaactcggttatattatgtccatgtacttatttgtttggctgtgggtttgtgcttttgcagcttgctatctagtgaatgagtaagttgagctgagagctaggggtttgaacaagctattgaatctgtcattcttcagaaacaagttcatttaatccggtatgctggataactgcacatcaagcttgaatcatggtgtcttatcagttccggtttggttgaactaaatctgggacaggtgatacttttggagcattggtctcacttctgctcaccttgaatttgctgtactttttgtcctcgtaatgaaacctgataagttatatgacatgttggttagctgttattccagctgcacttgtttcaggtttttttagcaatatgtctccggcatatgaccattgctgggttgtgagctggttactttcttgtatgggctaatgttctttggagtttggatttgacacacgtccagaaaaacttcaaataacctttgaggtaatagtttttttactacatttttgctggtagtgtcttgcttgttatattctttgagtggtttcaattggagcagcatatggtgttatcagttttacattatcaattaaccatgctaactttatcaataagatgaaaagaatccatcagtgttattcttagtattacttccctaagaagtatagcattcactgctttggatctgctgtgatttgttgaactttttggaaacaagaaattaaggagtatctagaccttgtattcataggtgctgtcacgccccgaactagccccgaacagaaccagcccgtgacgctccaaattaacctgttaaccgataccagtcctaggaaatagtgctggtatcacaggaaaactgaataccatagcaacaaaggtctctttattatagagtaggattacagtcatgttgggctgcggacagatcccaagctcacaactgcattacaaaagaggaaagcggaagccaagacttggaccattcatcacaggcgcgacttgggaactagatcgaaatcctaaaactcatcatagccgacttgctcctggaagaactcctcgtcagcgggatccatctcatcttcttcagcaactgggggggattatttatatagagcaatagtgagtacaggagtactcagcaagtcatgggaattatgtgtttaatgaaggcttcaaaggaaaggctgttgtttttacaattgattttagttaaactccttttttttaaaaaaacaactaagtgagtgcttctcaaacgacacggatgagacaatgcatctcgtccggtcggagtatgtgcattgtatcagtctttgattgattcaagattggcacccggccacaactttcaaacggccacccgggcctagctgatcccgtcaaccacagatgttccaaacatcgaacccaaatcaacaatagcaatttcacaaagtagtagtcaaacaaaactacgctaaggaatcaccttacatccgctcatgaccgtgggcacggctgttcgaacagtttaataacctctgcagagggggcacactttacccacacgacattactaacacggatcacccagcctgtgcagaacagccacgtctggtgtccttgaggctttcatgacaaggcatttcgagagccgacacaggtttaccatatgccaacgagaggggtcccagaccaacaacaggttaggtcccagaccatactatgccaggaagcccaggggtcctccccaacaccaccctggcaaatccacttgtctcccggcatcaaggctcccctgattagctaattactcagccaggggtgtcccattccacccatgtggtcgtacttgttatatgttcggatgaaattccaaaggaataggtccttaagtgcaagagcgggaaaccgtgctcccgagacgagacgggcactgtgacgagaggccgacggcacgagagtgatctctccggcctcgggccggggaagaggaagaagatgagtgcccggagtccccttcacgcgtccttcgcatgcacctgctctcctggtgctttggcgacgaatggcggaggtgcaagcagggcagagcgacgatggtgtggcaggcgctgacggcggcggcgactggccggtcggccagcacggcgcgcgcgcgcgggaagcaacgggtggcgcggcgatttgagcggcgtcggcgggagcggcatcgagagggagcgagagcagagagagagagagggggaaagaaagagagagagcgagctctcttgctcagcgcccgagcggcgcacgtgcctcgcacgtgcgggcaaggatggaggggagaggagagatgggctgagaggaaatggccggggagaagagatcggcccacgaactcgagggaggcaaaatagactttttcgagaagatttgattcgggacagattgaggttagggtttggattcgacgatggattggggatttgagatctggaatggcacggacactggacaacaaacaaagaaacatttttcgcatttatgatttttaagagatagttttcccactaggtgccacgacggaacgggcgctagagaccaatccccctaacaagaatctcgaccccgagattcagcacctaagggagcagctccggaaactcggcgcggagatgatcttctcgttcccaggttgccttatctttagaatggttgctccattggaccttgtagaacttgatggtctttcttcgagtctgacgctttgcctcttgaagaaccttgatcggtctttccttgtaggtcaggttgttttctagctcgatgttgcccaggggaacttgttcttctggaactcgaagacatttcttcaactgggatacatggaacacgttgtgcacatctgcgagaccttcaggtagctcaagctgataagccacttcgccacgtctggctgttatgtggtagggaccaatgtagcggggtgctaacttgccggacatcccaaacctcttcataccgtggaggggtgatacccgtaggtacacatgatctcctttttcgaactcaagatcacgcctccgattgtcagcataattcttctgacggttctgagctgtctttaaacgttctcggatcagcttaacttgttcttctgctgccttgagtatgcaggaccgaacaccagcgcttcgccaacctcattccagcacaagggagtgcggcactttcttccgaacattgcctcattcggcgacatctgaatgctggcctgataactgttgttgtatgagaactcggcatacggcaggcaacgatcccatgtgccttcaaaatctagggcacaagcacgaagcatgtcctctaagatctgatttactctttccgtctaaccatcggtctgcggatggtaagccgtgctgaagttcaaattggtcccgagagcctcatgcaactgcttccagaaccttgaggtgaactgagtacctcggtctgacacgatctttttcggacagccaaatcgacataccacgtgggtcatgtagagctctgccagtttctttccatcaaaggtagttttcacaggcacgaagtgagccgattttgtgaattggtccacaattacctagatggagtcatacccgctaggggttcttggtaaaccggtgatgaagtccatcccaatttcttcccacttgcattcggaaattggtaggggttgcagcagaccagctggtctctggtgctctgctttaactctttggcaaatgtcatagagagccacatattccgcgacatctcgcttcattccagcccaccagaaatatcccttaatgtcctggtacatctttgtacttcctagatgaatggagtaggcagactcatgggcttcttttaaaatgatatcttttaattctttcttggctggtacgcagatgcgagatccgcaccacactgtgccttggtcatctatggagaaaccggtgtatttcttctcgtgtattctttctattaactcttttatacctttatcatctttctgagcttcccggatttgcgattccaatgtaggttgcactgtcaggctagcagggatggccgactgtaccactatcagccttaacttttctaattctctgcacagacgatcttggtctggccatactttaactgcattgcagtaggtcttgcgactcagtgcatcagcgaccacattggctttaccgggatggtaatggatcccaagatcataatccttgattagttccaaccaccttctttgcctcatatttagctctgtctgagtgaagatgtatttaagactcttgtgatcggtatacacttcacacttgtacccgatcaagtagtgccgccagatcttaagggcatggatcacggctgctaattcaagatcatgggtgggatagttgacttcatgaggtctaagctgcctagacgcataggccacgaccttacgatcttgcattaagatatcccaagccttgccttgacgcatcacagaagatttcaaagtcttttcgtatatctggcagggtgagaactggggcagtggtcaatcttttcttcatttcttgaaaactgtcttcacaggctgctgaccattcaaacttcttttctttctttagcaactcggtcataggtctggctaacttagagaaaccttcgatgaatcttcgataatatccagctaggccaaggaaactgcggatttctgacacattcttgggggaattccaagcaagtacagcttcaaccttcctgggatctacttcgacaccgttagaggagatcacgtgccaagaaatgctactcggtccaaccagaatttgcacttcgagaaattggccaacaattgatgttctcttagcttttccattatcagcctcaggtgttcagcatgttcttccgcattcctcgagtatatcaagatgtcatcaatgaataccacgacaaacttgtccaagtactccatgaagatcttgtttatcaggttcatgaagaaggccggagcattggtgagtccgaaggacatcaccgtgaactcatacagaccataccgcattgaaaaagcggtttttgggatattctcagatctgattttaagctgatggtaacctgacctgaggtcaatcttttagaaaactttcgctccttcaatttcatcgaacagatcgtcaatccgaggcaacgagtacttgttttttatagttacttcattcagggctctatagtcaattaccattctctcagagccatcctttttcttaaccagaagcactggggctccccaaggggatgagctaggtcgcacataacctttactctccaattcttcgatctgctttttgacttctgctaactcattaactgccattcggtagggtctttttgcaattggtgcggtgcctagtgccagttctatggcgaactcaatctctcggtctggtggcatacccgttaactcttctggaaatacgtcgggatatccacagactatgggcacttattccaagggaatggcttgcaaactggttaggatagaccgacttgcggtaagggtgttaggggtaaagcgaacttgctttcctccaggtccttgcaaggtgatggacctttcggcacaatctatctgtcctttgtgcttagccaaccaatccatccctaggatgatgtccaaactttgcgagtctaggattattggtttggctaggaaatcaattccctcaattctaatgttaacttcggggcatattttagttgcccctatatcccttccaggggaatgcactatcattggaacttgcaatttttgggttttccaaccatttctttttacaaaagcttgcgatatgaaagtatgggaagctcctgaatcaaataggacgattgcgggtacggagttgatagagaacatacccatcacaacatctggagcatcctgagcggtttcagcttgaatgtggttcacccggcctcgaccgaagttgttggaaacatgagatccctgtccactagcctgagaactaggacgagacggagctggtgcgggagtaggagtcctggcggtgctgccattagaacgtcctgagttggagttggcaggatcctgtgggcattgcctggcatagtgtctcatctggttgcatcagaaacactgaacagacgccattcctgatggtgccttgaaggaggacacactattcggtgcagtattactgctaggggcacgctgctgcggctgaggcgccaggcggttagtctgaggacgaggtgcatagcttggctggcggttagcatgagtgactgactggtgatattgcatgggttgtccaaagcgagggcgaggtgcacctcgggaggaattcccctgatgattagacttgcgtttcttgtattcctcggtagcttcttttctagcatcttcaaacagaagagacttgttgatcatgtcatggaaagtggggaaattatgagcaagcaactgaagtctcatcccaactgcaattccctttaagaacttcctgatcttcttcttatcggtgtccacttcctcaggggcataccgagccaacttgttgaactgactcaggtactaattgacactattattgccttgcttaagcctgttaaattcctccttcttcatatcaatggtgctttcaggcacgtgagttgcacgaaaagccgtagcaaactcatcccaagcaatgttagtggggtcaggatgagcattgcagtagttttcccaccaatcagcggcaggtcctcttagctggtgagaggcgtagagtgtcttctcgaaaggagtacattgtaccaagttgagcttcctttcaacatccttcagccaatcatcagcctcaacaggcacgacggtctgagagaactcgagcggacgagacctcagaaagtccgtcagcttggatctgttgttacccatgtggggatggccatttccatgtgcattatgctgaaagccggctatggctgtggctaatccctgcaagatctgtggctgtggctatgccatcaagtgctgcatgttgttttcaacatggggtggggaaggcatgcatcctccaacagggtcgcgattaacagtgtggtgagagcggtgagaaccatgggactgctcaacctcggcatcgcgggatgctgtgtggtgcgaacggttagtgtggtgagactgctcatcagccgactcgtgatctgcctctggctcaactctgccttcttcaaaaccaaaacggttcggtgcacgggtagcgcggcgaggacggctagccatctaaactccctgaaaaagggcggggtgagaatcggacaagcacttaatgaagacaaggagcaaaataaataacagctcagatagcacacactaggcataaactggttttctcaaatcataaagacacctgatacaacggatgtggacaagtcacagagctacgccgagcttgactgtacgcacaccacctaggagaaccagactaccaaacaacacccacatcaaacacacggacgcactacctcgccacgactccgaaagagttggcggcggaacaaaagggcctaacacacggacaactgctgaagactgcctcctctactcctcgcctgcctggctgcctcctgtggtcagttcctcagtcgaagaaacgtagatcggcgcacgcgaagggaccggcggaacctgtcgagggccggcaacagcacgggccgctggcggagggggagttgggtagtcgaagcggaacactgtggaagagccaacaacacgcttccgcgcagtgcggatgaagcgtgggccacggcaggaggaagcaactagagtgtgtccgggggtgtagaaggggctaactgggtgtgggtagggagagtacactggtgagtacggcgcacgcgagccgggggagtgcgggccactgggagtgcgagcagagccgcgggagctgtgggaagacaggtggctggcgtggcagaggcggccaaagtcccaagaggtagtgtcaactgaggtgacaccgtcctcggccaggcgggtctcgagtgcagcgtagcggcgtgcaagggagtggtaagcctcaaggagaaggtcgtgctgggtggcctgagccttagaaagctcaaccatgcgagtcagcacaggctgagactcgttgtacgggcaagggtacctggtgtcagtgcggccagaaggaaggcgtgggagctgccggaaggcagagcccccgaggcggtggctgtagtcgtgggccaagcgacgaagtgcagtccaggagaggtcctggtacgcgatctggagagtgggcctggccatagtgaagtggtgtgggcgaaggccagccccgtgtatacctccacaagggtaaaggtataccgaaagctcacaacgagggggaacacggtccacggagtaccccgtgtactcgggacacgagaagccaaggaagcgggcgaggtcacgaagctgagcgacgtggtgaccctcaccaaaaccatgggaactgaagctggcgttcactgccatctacaattttgaaagagggagaaaagatcagtaaccattttagcaacaaactactgaaaataaagaaagcaaaaagaaggcttagcttttcacaagtagtttttgaacttaatatccttagggtcgtcctaaacgtcgggtttcgtccaagggccaagcctgtgctctgataccatcttttatcacgccccgaactagccccgaacggaactagcccgtgacgctccaaattaacctgttaaccgataccagtcccaggaaatagtgctggtatcacaggaaaactgaataccacagcaacagaggtctctttattatagagtaggattacagtcatgatgggctgcagacagaccccgagctcacaactgcattacaaaataggaaagcggaagccaagacttggaccattcatcacaggcgcgacttgggaactagatcgaaaccctaaaactcatcatagccgacttgctcctggaagaactcctcgtcagcgggatccatctcatcttcttcagcaactagggggggttatttatatagagcaagggtgagtacaggagtactcagcaagtcatgggaattatgtgtttaatgaaggcttcaaaggaaaggttgttgtttttacaattgattttagttaaactcctttttttaaaacaactaagtgagtgcttctcaaacgacacggatgagacagtgcatcttgtccggtcggagtggatgagacagtgcatctcgttcggtctgagtatgtgcattgtatcagtctttgattgattcaagattggcacccgaccacaactttcaaacggccacccgggcctagctgatcccgtcagccacagatgttccaaacatcgaacccaaacccacaacagcaatttcacaaagtagtagtcaaacaaaactacgctaaggaatcaccttacatccacccatgaccgtgggcacggctgttcgaacagtttaataacctctgcagagggggcacactttacccacacgacattactaacccggatcacccagcccgtgcagaacagccacgtctggtgtccttgaggctttcatgacaaggcatttcgagagccgacacaggtttaccatatgccgacgagaggggtcccagaccaacaacaggttaggtcccagaccatactgtgccaggaagcccaggggtcctccccgacaccaccctggcaaatccacttgtctctcggcatcaaggctcccctgattagctaattactcagccaggggtgtcccatttcacccatgtggtcgtacttgttatatgttcggatgaaattccaaaggaataggtccttaagtgcaagagcgggaaaccgtgctcccggcacgtcccccggtctgcgatttttggaaattcatttagttcgtaagcaccgacccaggtgtcggtgacatgggatcaggagtatcatgactagaggtttgaggcaaactccatttcacacatgcaagggcacaacgaggggtcgtcagcacgcaaagcgatgtcgctccacatcgtttagtccatcagataggataagaccgcacccccattcgtcatcagggctgaggcgccctgacccctcgtgggtctttgctccgagtgcatgggttaggtcagcacagtggggctcacctaaccacatttattgcggttgggctgagcgtgtcacgccgtatgtaacgcagtgcagtgcactcgtttatccggtctatgaccagtcacagaccggtcagatcgcgggttaggtggcgacaggcgatctgacgcacacctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaaggacgagcatgtaggttgctaagctgacacgtggtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatctccttaagatataaaaggaggaccttgcccactgagatgagggagtagactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccatgagtccccggccgaaccggcaaaggggggcctgcgcggtctcccggtgaggagccccacgctccgtcatctggcgcgccaggtaggggtccaggcctcgggacccgaggggagtgctcccaactcccttagattgattgcttggatcgccgagatccaagcatatctcacagataagactctacccgaggaccgcgaagggagtgaacgcgtccatcgcatctccaaacgctacgtgctggtagaagggaccctctatcggcgcgtggctaatggaatcctcctgaagtgcattcctcgggaacaaggtgttgtgcttcttgccgatatccatgaaggcgaatgcggagcccactccgcctcgcgcaccttggttggtaaagcttttcgccagggtttctattggccgacagctcttaatgacgcggtcgacctggtccggcgatgtagagcgtgtcaattccacgccaagcaaatccatcagccggcccaggccctgcagaccataccactttcgtggccatttgctgtatggggactcgatatcctgggaccgtttaggcgggccccgggcgggtttgagtatctgtatgtcgcgatcgacaggttcactaagtggcccgaggcttatccggtcgtcaagatcgataagcactccgcacttaaatttattaagggcatcacggcccggtttggagtgcctaaccgtattattacggataatggcacccaattcactagtgaactcttcggcgactactgcgaagacatgggcatcaagctctgcttcgcctcacctgcccaccccaaaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaaacgcctttttttctcgtctacggcgcggaagcggttcttccat

SEQ ID NO: 5247 - DNA, 4434 bp, Oryza sativa
acatgtgtatttcaataaaagcagtttcaatttcctaaaggctgtatctgtgctgttttttccttttgaagaatcttgacttgaaataggtcactcgtgctcaatcctgccctcgggggctcgggtcggctaaaatcgccgaacggggcccagaaccgagccgtgccccgaggcgtggtgaactccggggggggggggggggaatcggcaaaaacccacaatcgggtcacccataaccctcggtcaccacgttcccggcctggccagtctcgacatgtggatctcctcaggcactagccccgacccgcgccttttgaggactagaacttgggcacgagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccaagccatcgaagctgtcgacgatatggtcggcggcatcccggacctgcgcgcgcgcgcggtcctcggtcccaggagggaactcatccagcgccatccatggggagaaattggggtccctggcctggtaactcgccaggacgagctccaccgctccttgggcgaggtccctcgaggatgacttaattgtcttctcgagctcctcggggagccgttggagagccccggccatcttcgagaggcgctggacgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgtgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggctgactgccagctgttgcgccgcggcctcggccccctcgagagctcgctcccgctcggtgagcacgtcctcgcggaggcggagcgtgaactcttcttcggcgcaggcagcctcgtgcgccgccagcgttgcttcccggatggtgacagcggcctcgcggtccgccagatccctctccacgacgcaggcgcgctcttccagcgccatggcgcgcgcctcaagggcctcttcacgctgccgggacgccgcttcggtctccgccgcccgctgttctcgggcagcggcagcgtcaagcaccccctgggcggcgtcgagcttcttccttagctccgcctcccagctcccgtattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtggggcgatagaaggcgtggggaagagccgccttggagaggatgccacgcggctcgggccgccaatggaagtgccggactcggggatgtcccccggacccggttggtcctgagcgtcgcccgagggagtgggcccaagcgacgcgcccgcggcctcgtcgcgagctgcctcggaagtcgccatcgcctcgtcctggcgaaatccgacttcctcccgagcggcttccccggcctggcgggcccgggcggcctcctcccgagcagtttcctcggcctggcgagcccgggcggcctcctgggcggcctcctcggcttcccgtaggcgatccgcggcctctcgccggtcagattcccgcctgagggcctctgcggccgccggatcctcggccttagactggccggacttggaatggcgggagggatgcgacgggatctcgctgaaacaaaagaaaaaaccagaagacgaacaagatgggtgagtgaaaactcgtgtcgagagaatgaatacagccacgatgggtgagagacgaacctgcgagggggtcggttaaacgaccactttggaggggaaatgaggtttccccgagatggttctgtctcccccatcttgcggggccgcttcttcttgcgctccccctcgggctgcgatgttggcgcggccccctccgggcgcctgctgctggcacgcgccgccctgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctacgccgtcgtgaccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcctcgtcggcgaggggagtgtagaaccagtcgctcttccagtcgtcccacttcttgcggagggtgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacaaatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggtgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcacattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagacaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgattgccctggcataacgccgggggctactgtcggtgacatgggatcaggagtatcatgactagaggtttgaggcagacacaatcgcacacgtggcctggtacccccgagggacgtcgggcccaagggtgatgcgttcgccctcctcttagtccccccgagggggg

SEQ ID NO: 5248 - DNA, 13611 bp, Oryza sativa
cccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcaagcatgtaggttgctaagctgacacgtggtggacaagaatgaccgacgtgactggtctgataccggtcatgtcgtcagcagacaaccacgattccacgtcgcgcctgcttccggcagaagtggaggtaggtatgggccgtcccatcaaaaggtcattcggacggcaaccatacaagtctccgtctgtttatgaaaaggtggggtaagtccccacaaaaaagagagaaatggtgcatgtggtatccccttaagatataaaaggaggaccttgcccactgagatgagggagtagactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaccaggtgtcgggtttttccaagtcttttgtaaaacccaagttttaccgatcgttggatattttaaatttgaggggaggacttcgacatgcgtgtccaaaggcccgtacatcgaagtacagcagtcgacaaatgaggtttaagtgttcaattattcaaggagggtaattgcagcaattaggattagggccggtaggctatctcgcaagccgcggccaaatttcttgtgttaatcctatccatgcattatttgcggaaaagaaatacttagatttaaattataggtgcaagatgatcaaaggtgacttgccttgctcgagatcttgagcttgatcctcgaaatccgcgcactccgggtcttcgggcttcgaagctacacgcgaacgagacgactcaacaaacggcggaattaaagccctattattgacctctaagcgtgccattagatagatctcgagatttgaggatttttggaagttgaacggagtcaaacggatgtacggttgagaagatattgaatttctaagattattggatttttggtctaaagaaaaaaggatttaattaaacccctttttggaaaagaaaagagggagggagggagattgaactttcctcgggcggctagggcgcggcttgagagaaatgggcaactcggccgcgctaaatgggccggccggcccgagagagcatggcccattagggcgcgcgggaggaaaggggagagagagccggtggtccgggctcacctcgcgtggtcccgagtgggacccgcttgtcggcggctcggctcaccaagagcgaggtgcatgcggcgcgacactagggttggggggtgggtgcggtgcacgcgtgtggctcgcggtggacgcggcgcgcgggtggcccacgcgcagcctcttggctctccgtgggccgcgcgcacgcgagcagggacggaaggattggctgaccggggtcagcttgacccggtccggccgagctagctctgacgtggcgccttcgtggctgccacgcgggctggcgggaggaagacaaaggcgctggctgctaatggacggcgggcggcggcggtttctccgggacaccgtgcgacgacgagggcgacggggtgtacaccggaatgacaaggggaaaagagagggagcgagccaacggctcggattcacctgagggggttcgacggcggcggattgtggcggcggcaaccggtggcgagaaagggggatatcggcgacggcgtgacgggagatcgattcggattggacggaacatcgccgaggaagtccggcgacgggcggctactaccgagcgcggcggtgacggcggcgagcctactgcgagcggcggcaacggtcagggcggcgcaggctagctacggggagactacacaagctactgctcgagtctgaggggaggagtaagagcgaggagggagaacgggaaggtgttctaccgagacgagacgggcgctgtgacgagaggccgacggcacgagagtgatctctccggcctcgggccggggaagaggaagaagacgagcgcccggagtccccttcacgcgtccttcgcacacaccggctctcccggtgctttggcgacaaacggcggaggtgcaagcagggcggagcgacgatggcgcggcaggcgcgggctcaggcgcggtaggtgctgatggcggcggcgactagccggtcggccaccacggcgcgcgcgcgggaagcaacgggtggcacggcgatttgagcggcgtcggcgggagcggcatcgagagggagcgagagcagagagaggggggaaagaaagagagagagcgagctctctcttgctcagggctcgagcggcgcacgtgcctcgcacgtgcgggcaaggatggaggggagaggagagatgggctgagaggaaatggccggggagaagagatcggcccacgaactcgagggaggcaaaatagactttttcgagaagatttgattcgggacagattgaggttagggtttggattcgacgatggattggggatttgagatctggaatggcacggacactggacaacaaacaaagaaacaattttcgcatttaggatttttaagagatagttttcccactaggcgccacgacgggacggacgctacaggtgcaaagttgtaaactcagattctctgctgagaagaatcttgacacttcaatagtactaccatacctagttaagctttgttgcctgatgggtgttactttattcgttgctgcttagtatccccctattgtttgacatttctacggttcttgcttttctgtagagtctgtactaataccactccatttgttgggcttgttctgttcttttgtgagacaaacctgtactagcactactattatatctgctgagctactgaatcactgatgtactttgcaaacatctcttagatcaagggagcttaggtagacataattaagctgtatcatgagacctaacagtctaacaaagcaacgaaaacctttagtagaaatagcaactagtgctggggagaataattctactttggggaagcccagcacgcatggaaccctggaagtggatagtatgatactccagcatgcagtttcccttttcttgccttccgtgttggtccaggaatcgcccaatttggcgttttatattgaaccatttggtctctcttttccattacgaggagagggatcaagttgtgcccaatgggcagcgaagaatgatcatgtaaagactcttctctggtttctaacttcctatggcttcttggttaactctcctcttgctgtaagcatgcagtgagcctgacgcttcaaaagatgcttaaatcttgggcacactagtagtaggctattggtgatttggaatgtacaagattcttgttatggggtgatctacaactataatggtgtgagtacttgtgcctacgtttgacccttcctagtttgtggtcgcaggaatgcaagttgaagaacctgaaaaatgcatgcagtacggaacaatcgaaatgctggctgctttatttccaggaattgagacttgtggagtcggaaagcaggtgttcatgattttacgtacaatttttaagtagtttctgttctcttatgctggtaacttggttggggtccgattgtattttgcagtggcagtcgtacatgtactcaattgttatgttcaacccatcatgcataatactagtagtatatgcaactattcaaacccccatttaaatacagggaacattttctgatttttgtaggaaccgaaccttttcaaaatagtttttaaaattctttctaggagaattaacatttcctgtgttttgataatggcagcagcctacctaaactttagtcctgttttcatcacagtcagccaccatgcaatgatagacataaaactataccttaaatcagtcaactataccttaaacttaggaagagaagttgccaagcctgtgggagcctcagtgcgtgtccagagaataatttctttcactttctttaactaattttgctactactcctgccatagatagcaaccccggacgtgcacccaaccaacctacacttaccagccgcattggatgccgttgctccccacacacaccgaaccaacggtgagcatgtgacctcagggtgggccataccctgacgctgccaactggaagattttggccaaaaaccgtgtttcctccattgttaattaccctgaggtgacatggcaaccataagtttttgctatgggtacatggaccaatctgcgtcttattgttttggttttattctgggaaaggtcaggctggttttttaagggctggaatgacaacgataatgatatccataggagtatgataagtaggcgtgagataagatatgacgttttaagtttccatcaactatatattatcttgtagatttgtcgagatgatagtgaacggaaggtttttctttttttctagtgctgttatcatttgttgtcataaccatgttcacatgttatgtcagtaaagtgtattataaatactatagtttaggagaaaagtaaacttaactataaaaagatattttttatagtcactcctacagtcatgcatatcaagttgcgccattattcgtttgtctgatactttcttcggaacaaaacaatcatttgttacagcacaacaccaaaccaccctcggtcatgataatgctagctctttatcgacagcacctctagaacagcaatatgtatttgatcgatagatcgagattctatgtacgaattggtccccctccttaattaaaaccaaccaaaaaaatcagctcatacaagattaacctatgggaaatttgctattggtaaaaccaaattatatttctcctttttctcagttttctctcctatatggtccccaccttgcagttatataatcggtgctccagatgtaggcatacaaaattgcaataaagaatggttttgtaggcgtcgcttggaacaaggaggaggattaaagaacatcccccagttggaatgatgcagtcgaggggggcagcagcggaagcgacggcggggaggagccgaggaggctgcaggcgcagcgagcagcagcagcttcttcgctcggcggaggcaccgagggaggaggcgcgtggtagccatgcttctcccctcatcgtcttcttattcctacgcctccaaaggtcataatccaaacctttctcttctcccttcctagacgatgtagcagtagctatacccctgatcttgtgcaagtgctgagaccactgggtaatcttggtttcttggagcatatgtttgtttgctgatcttgtgcaagtgctgagaccactgggtaatcttggtttcttggagcatatgtttgtttgagtgcgtgttcttgatctccaatctcctgggtagtttgtcatgcttgacttttcgtagtcaaagaacgattcttttataggattgtaatggagcatattcttgatgccgaggcttattacgcttagtgtttgtggatttgactggatgcatgtcgttttggcacaaagattgattgagtatggagattgttgactagtcgtgtgtggcttgtaaggctactattggatgtctttggggctctagggaggatctctcaagtctcagtgtcagactcgatggcagcagttgttgtcatgcatgttcttgggaatttagatcatatatcatcatcatataagcttgtgtttatcacttgatgtgggaacatttctagtgctgcctttctctcgaccatatttgaggacgagtgatgtgttgatgactgatgaagtgatgatatactcggactatagaaattcagtccacctattctgtgtgttcctatagataatttcctgctggttaatactctttatatttgttgtatctttaggttgtgttgtatggatttatttggtatattttgcttcggttgtattttcccagtgctattcatatacagtacatgacagtcttgcttttttttttctgaaggaagtttttggtttgttgatctttgtctacaaaacatagctaaatatgggacaaaggaactgtatttttccgacttttaagaattaaaatgacagatcaatgaaatcttgtgtgttttagctctgccaattagctaaacttgggtcatatctgaggcttactcgaggaaaacaccaagatagacattatgaacttggcagttggcacattgaacaaacagttcattttgtggcacgtgcatttattatctagcatattagatgagtttattagtttcaattaagacatcaattagaaagattggaggaatattatttctttggcaagcatcttcttcaatgttagcataagtacaacctctagttacaaagaaacaatgctgccctcaaacatttttgtgttagaccattcattttaactattctttttttgaaaccgatcattttaactattctctccgtcccaaaatttagcgactagtcctaggttgctatattttgggatggagggagtagaattttcttgacctttttgagagtccaaagcactcactaaactcagaatgtaccacattcaagccctggtgaagcacatgtgcaaatttccacactgaaacatgcacaaatatgtatccatgtgtgcttcttaaattggacaacatcaacacttgtagtacctagcagtcgggccatttcagaaagtagaaaattttattttgttttgtttgcctaaacgtagtaaataagaagcttgttgataaacgcaagattcatgtcctgtcctggctgattcactaaacagatagtagtatcttcaagaagcaactaaatatgtattcctgaaaaactaggtagaagggacaagatattgacataaatttgtggaggtaaatttaaaacattgcttgctacgcatgagtgatacctgcttataagcataagcaataatttgaattgaaaacttaattttcgagttgattttggtatattttcatcatactagtttattttacagcatttgcctttatatcactaagaacacatatataaaagttttacccataaattattttttaatcactaataaaccgtttcacttataataagtataagcgaaacgacgaggctgctaaattctacacaagtactgaatctaaactttctgaggatgttattctcttttgttgtttatatggtttggataatgccaggatacttcctgtgtttcctcatgattccttttgtaatttatcaacctacactacattttcctgctgtcaccaggtgactccttcaggagaactgttgatggtcctatgaggtcaacgttgacttttgataataatcattctgtagtgccaagtcaaaacattgattacggccagccaatggtaagatatgctaatggagccaacattagatctggcaaagtcagctcatcctattctttataagtaaccgtgcatctgattattttctgtatatttcacaggcttgcatttcatacccatacaacgattctggttcaggagtttgggcatcctacagttcacgctcggtggtatgttcttctaacaagttctctctcaattctctcaaggtcttcaaacttttgcagaggaagctaacaaactagtagtaacattttttttatcaacatatgtaattataagggtataattcatgcatccaggtcctgcttaggagatcccattatttatctatgatcagtccagcctgatttgatttagtctagaggcttaaaatatgtcacttttcccatttgtcgtaaagaaactgcctggttttgcataaaaatggattgagtcatcaacgtaacctcaacagggtagtatgtctgaagctctttatatagcacaaaaagattacctttgagcattattttaggttttgccaacctcacctgtaaatggtgtaggttgatgcattaaattaaactagtgagaagacataactaatgtctatttgagtaatgcagtcacatgcagttcataattcttaagaactagtactagatatacgtgagtttattcactagatcaatattattcagggagaacatgtagtagttatgcaaaccatgtgcacacacatctcttggggcatccagcttatttttatctatattttcatgggtcttgcctaatcagttgtacttaaaacagttccatcctcaaattgtgggaggaggcacatcgccaagagttcccttgccctccctggagatagcagatgatgggcccatatatgtcaatcccaaacaatatcatggaattcttcgcagaagacaactgcgtgctaagttagaggcccagaataagctcgtcaaaacccgaaaggttcttgccactgccaactgatccattgatgtttttaccttccattgccatctccttgtgcatcttgcattaaccttttaatattgttaaccactctgcttggcttaatattgtaaacaatctccatgtgcagccttaccttcacgaatctcggcatcgccatgcaatgaagagggctaggggcactggtgggcgattcctgaataccaagcagctccagctgcagcaacagtctcacactacctccaccaagaccaccacagacagccaaaattcttcaggttcagtccatctacggctaggtggtggcgcaatcggagatcaaactccatttccgttcaaagcaatggattcacaagctaacatcaagagagctgcagcttctgcttccaccttcactgtaacttctgcggcacagaaagacgacgccttcttcgaccgccatggccaccatctcagtagcttctccggccattttggccaggcaagcgcacaaggtggcgtcggcagcatgcataacgggtcacagcagagggttcctgctatgagatgagatgaagagcagcttgcaaatcatcatcatatatggtgtggtctggtccctccttaggcaattcatccttggcttaagtttcatggcttgtttaggacttcagagacgcttcatagtgctgtgcttttgcagcccataagtctgggcttaattgtgatgtgtaatatccatgtattggtgtgatgaagttgtccctgtttgaataaactctttgtctgttggttatacaatgtgttgcaaaactttacagtagtgttgtgcaatgtgcattaggacaaggtctgaaatgcccctcatttttgtgaatcacaaagggtaggatggaaaccggaaaattgtgtcaaaattaacatattggaaaactaggacatgtatatgttgtactaggtggtgttccaactaatttcagcttactatactgtatgatggagggagtagttatttgggacaaatttaaattgtaagggcttactcggatcacaggattgtaaaaatataggcatagggaaatcatagtaatatgataggaatgtatgtgtaaaatagatgattgaaaaacacgggaattttatagatatgattggtaaacatgtgttatgtgttcggatagacattggaaaatcataggaaaataaaaaaataaggtaggagtgaatgcaaattttcttttgtttctctattgattccacaggaaaggaattttttcctccgatttttctttgggtcaattcgtgtgaaccgaacaacaggaaacaaaatatttcctacctacagtatttctttgaaaatcctataaaaatccctcgatccgaagaggctccaaaaaaagagctataatttgagacaggaaagtacgtttggtgtattccacaagaccacaactggcttgctgcctgcatgcgcatgaagaaaatatcgctgtctaattgcaagttattcggtgtcaatcctagaaataaaggcgattaaattccatgaatgaaaaatcacacgagttaaacccattccaaaaatcaataagcacagcacacacgctataaaagaaaaccaacattatgtaaaatcgtcaaaaaaaaattccggtaaaaaaaaacattatgtaaaatgaaacattcctctttttcttgattcatcattctcggtaaaatcagagatgaagaacagccacgtattagcgctgctcctcgcctctgtccttctggtgtcaatgtcatcctcaggtaacaatgtaacataggaacactcctctctatctcgctgcagtttgcattttgcaatgaatgttaggaaacgataggcgaacaaacgataaaaaacaatagatcaatcacaaaagacacgagatttaacgtggaaaaccctcccaaaacaggagagaaaaaaccacgggcaatccacgtgataacccacgtgagatcgtgggcattggctccgttcagatcaagactcatgatggcatgacacgcacgctaaaagatgtgagacacataccagggatagcgagaaatctcatctctctcagcacacttgatgcagaaggatacaaatactctggttcaggtggagttgtaaaggtatcgaaaggttctcttgtttacatgattggtgatatgaattctgcaaacttatatgtccttagaggaagtacattacatggttctgttaccgctgctgctgttactaaagatgaacctagtaagactaacctgtggcacatgcgtcttggacatatgagtgaacttggtatggcagaattgatgaagaggaacttgctggatggctgcactcagggtaacatgaagttctgtgagcactgtgtttttggtaagcataagagggtaaaattcaatacctcagttcatcgcaccaaaggtatacttgattatgtacatgctgatttgtgggggccttctcgtaagccctctcttggtggtgctcgttatatgcttaccattattgatgattactctagaaaagtgtggccttatttcctgaaacataaagatgatacatttgctgcttttaaggagtggaaagttatgatagaaaggcaaactgaaagggaggtaaaagtacttcgcactgacaatggtggtgaattttgttcggatgcttttgatgattactgcaggaaggaaggcatcgttaggcatcacatcatcccgtacactccacagcagaatggtgtagctgagcgcatgaacagaaccatcatctccaagtctcgttgcatgctgtccaacgctcgcatgaacaagcgtttttgggcagaggctgctaacactgcctgctacttgatcaacaggtcgccttctatcccacttaataagaaaactcccattgaggtatggtctggtatgcctgcgtttttggatgcactgcttatgctcatgttgataatggaaaattagagcctagagctattaagtgtctatttcttggttatggttcaggagtaaaaggatataagttatggaatcctgaaactaacaagaccttcatgagcaggagtgttgttttcaatgaatctgttatgtttaatgatagcttgcccacagatgtcataccaggtggttcagatgaggagcagcaatatgttagcgtgcaggtggagcacgtggatgatcatgaaactgaaattgttggtaatgatgttaataatactgttcagcactcacctcctgttttgcagcacaagatgaacctattgcccatcgcagaacaaagaggagttgtggagctccagtccgttttattgaggaatgtgatatggtttattatgcttttacttgtgctgaacaagtggagaatactcttgagccagccacatacactgaagctgttgtttctggagaccgtgagaagtggatctcagctatgcaggaggagatgcagtctcttgagaagaatggcacatgggagcttgtgcacttgccaaaacagaagaagcctgttcgttgtaaatggatcttcaagagaaaggagggtttatctcctagcgagcctccgaggtttaaggcaaggttagtagcaaaatgtttcagtcaaattgctggtgttgattataatgatgtgttctctccagttgtaaagcatagttcaattcgcacattcttcagtattgttgctatgtatgatcttgagcttgagcagttagatgtgaagacaacatttttacatggagagcttgaggaggagatatacatggaccagccagaagggttcatagtacctggtaaggaggattatgtttgcaagttgaaaagatctttgtatggtttgaaacagtctcctcgtcaatggtataaaaggtttgattcatttatgttgtcacatggctttaagaggtctgaatttgacagctgtgtgtatattaaatttgttaatggatcacctatatacttgctgttatatattgatgatatgctgattgctgccaagagcaaggaacaaatcactacattgaagaaacagttgagtagtgagtttgatatgaaggatcttggtgctgctaagaaaattctaggtatggaaatcactagagacagaaattctggtttgttatttcttagtcagcaaagctacattaagaaggttcttcagcgttttaacatgcatgatgcaaagcctgttagcactcctattacacctcattttaaattatcagctttacaatgtgctagtactgatgaggatgtagaatacatgtctagagttccatattctagtgctgttggttctttgatgtatgccatggtttgctcccggccagatttatctcatgctatgagtttggttagtagatacatggctaatcctggtaaagaacactggaaagctgttcagtggattttcaggtacctcagaggcacagctgatgcttgcttgaagtttggcaggactgataaggggcttgttggatatgtggattctgattttgctgtagatttggataagagaaggtcactcacaggttatgtgtttaccattggtagttgtgctgtgagttggaaggcaacattgcagcctgttgttgcccagtctaccactgaagcagaatacatggctattgctgaagcatgtaaagaatcagttggctgaagggattgtttgctgagctttgtggagttgattcttgcattaacttgttttgtgacagtcaaagtgctatatgcctcaccaaagatcagatgtttcatgagaggacaaagcacattgatatcaagtaccattatgttcgcgatgtagtcgtgcaaggtaagctaaaggtatgcaagataagtactcatgataatcctgctgatataatgacaaagcctgttcctgttgctaagtttgagttttgctcaagcttagttggtatagtggtttagcccgagaggctatttggcgccgaaagtgttttttttgtctttgttgtgttcagggtgaaggattgattcatgctacaagaaggaatttgtctcaaggtggagtttgttga
